United States Patent 9,782,462 (MODIFIED POLYNUCLEOTIDES FOR THE PRODUCTION OF PROTEINS ASSOCIATED WITH HUMAN DISEASE) - sequence listing, part 43

SEQ ID NO: 79208 - DNA, 858 bp, Artificial Sequence
  Description of Artificial Sequence: Synthetic coding sequence
atggccggcctgggccaccccgccgccttcggcagagccacccacgccgtggtgagagccctgcccgagagcctgggccagcacgccctgagaagcgccaagggcgaggaggtggacgtggccagagccgagagacagcaccagctgtacgtgggcgtgctgggcagcaagctgggcctgcaggtggtggagctgcccgccgacgagagcctgcccgactgcgtgttcgtggaggacgtggccgtggtgtgcgaggagaccgccctgatcaccagacccggcgcccccagcagaagaaaggaggtggacatgatgaaggaggccctggagaagctgcagctgaacatcgtggagatgaaggacgagaacgccaccctggacggcggcgacgtgctgttcaccggcagagagttcttcgtgggcctgagcaagagaaccaaccagagaggcgccgagatcctggccgacaccttcaaggactacgccgtgagcaccgtgcccgtggccgacggcctgcacctgaagagcttctgcagcatggccggccccaacctgatcgccatcggcagcagcgagagcgcccagaaggccctgaagatcatgcagcagatgagcgaccacagatacgacaagctgaccgtgcccgacgacatcgccgccaactgcatctacctgaacatccccaacaagggccacgtgctgctgcacagaacccccgaggagtaccccgagagcgccaaggtgtacgagaagctgaaggaccacatgctgatccccgtgagcatgagcgagctggagaaggtggacggcctgctgacctgctgcagcgtgctgatcaacaagaaggtggacagctag

SEQ ID NO: 79209 - DNA, 579 bp, Artificial Sequence
  Description of Artificial Sequence: Synthetic coding sequence
atgtggctgtacggcctgggccaggtggacatgatgaaggaggccctggagaagctgcagctgaacatcgtggagatgaaggacgagaacgccaccctggacggcggcgacgtgctgttcaccggcagagagttcttcgtgggcctgagcaagagaaccaaccagagaggcgccgagatcctggccgacaccttcaaggactacgccgtgagcaccgtgcccgtggccgacggcctgcacctgaagagcttctgcagcatggccggccccaacctgatcgccatcggcagcagcgagagcgcccagaaggccctgaagatcatgcagcagatgagcgaccacagatacgacaagctgaccgtgcccgacgacatcgccgccaactgcatctacctgaacatccccaacaagggccacgtgctgctgcacagaacccccgaggagtaccccgagagcgccaaggtgtacgagaagctgaaggaccacatgctgatccccgtgagcatgagcgagctggagaaggtggacggcctgctgacctgctgcagcgtgctgatcaacaagaaggtggacagctag

SEQ ID NO: 79210 - DNA, 549 bp, Artificial Sequence
  Description of Artificial Sequence: Synthetic coding sequence
atgatgaaggaggccctggagaagctgcagctgaacatcgtggagatgaaggacgagaacgccaccctggacggcggcgacgtgctgttcaccggcagagagttcttcgtgggcctgagcaagagaaccaaccagagaggcgccgagatcctggccgacaccttcaaggactacgccgtgagcaccgtgcccgtggccgacggcctgcacctgaagagcttctgcagcatggccggccccaacctgatcgccatcggcagcagcgagagcgcccagaaggccctgaagatcatgcagcagatgagcgaccacagatacgacaagctgaccgtgcccgacgacatcgccgccaactgcatctacctgaacatccccaacaagggccacgtgctgctgcacagaacccccgaggagtaccccgagagcgccaaggtgtacgagaagctgaaggaccacatgctgatccccgtgagcatgagcgagctggagaaggtggacggcctgctgacctgctgcagcgtgctgatcaacaagaaggtggacagctag

SEQ ID NO: 79211 - DNA, 858 bp, Artificial Sequence; identical to SEQ ID NO: 79208
  Description of Artificial Sequence: Synthetic coding sequence

SEQ ID NO: 79212 - DNA, 558 bp, Artificial Sequence
  Description of Artificial Sequence: Synthetic coding sequence
atggtggacatgatgaaggaggccctggagaagctgcagctgaacatcgtggagatgaaggacgagaacgccaccctggacggcggcgacgtgctgttcaccggcagagagttcttcgtgggcctgagcaagagaaccaaccagagaggcgccgagatcctggccgacaccttcaaggactacgccgtgagcaccgtgcccgtggccgacggcctgcacctgaagagcttctgcagcatggccggccccaacctgatcgccatcggcagcagcgagagcgcccagaaggccctgaagatcatgcagcagatgagcgaccacagatacgacaagctgaccgtgcccgacgacatcgccgccaactgcatctacctgaacatccccaacaagggccacgtgctgctgcacagaacccccgaggagtaccccgagagcgccaaggtgtacgagaagctgaaggaccacatgctgatccccgtgagcatgagcgagctggagaaggtggacggcctgctgacctgctgcagcgtgctgatcaacaagaaggtggacagctag

SEQ ID NO: 79213 - DNA, 858 bp, Artificial Sequence
  Description of Artificial Sequence: Synthetic coding sequence
atgggcacccccggcgagggcctgggcagatgcagccacgccctgatcagaggcgtgcccgagagcctggccagcggcgagggcgccggcgccggcctgcccgccctggacctggccaaggcccagagagagcacggcgtgctgggcggcaagctgagacagagactgggcctgcagctgctggagctgccccccgaggagagcctgcccctgggccccctgctgggcgacaccgccgtgatccagggcgacaccgccctgatcaccagaccctggagccccgccagaagacccgaggtggacggcgtgagaaaggccctgcaggacctgggcctgagaatcgtggagatcggcgacgagaacgccaccctggacggcaccgacgtgctgttcaccggcagagagttcttcgtgggcctgagcaagtggaccaaccacagaggcgccgagatcgtggccgacaccttcagagacttcgccgtgagcaccgtgcccgtgagcggccccagccacctgagaggcctgtgcggcatgggcggccccagaaccgtggtggccggcagcagcgacgccgcccagaaggccgtgagagccatggccgtgctgaccgaccacccctacgccagcctgaccctgcccgacgacgccgccgccgactgcctgttcctgagacccggcctgcccggcgtgccccccttcctgctgcacagaggcggcggcgacctgcccaacagccaggaggccctgcagaagctgagcgacgtgaccctggtgcccgtgagctgcagcgagctggagaaggccggcgccggcctgagcagcctgtgcctggtgctgagcaccagaccccacagctag

SEQ ID NO: 79214 - DNA, 858 bp, Artificial Sequence; identical to SEQ ID NO: 79213
  Description of Artificial Sequence: Synthetic coding sequence

SEQ ID NO: 79215 - DNA, 858 bp, Artificial Sequence; identical to SEQ ID NO: 79213
  Description of Artificial Sequence: Synthetic coding sequence

SEQ ID NO: 79216 - DNA, 858 bp, Artificial Sequence; identical to SEQ ID NO: 79213
  Description of Artificial Sequence: Synthetic coding sequence

SEQ ID NO: 79217 - DNA, 858 bp, Artificial Sequence; identical to SEQ ID NO: 79213
  Description of Artificial Sequence: Synthetic coding sequence

SEQ ID NO: 79218 - DNA, 858 bp, Artificial Sequence; identical to SEQ ID NO: 79213
  Description of Artificial Sequence: Synthetic coding sequence

SEQ ID NO: 79219 - DNA, 858 bp, Artificial Sequence; identical to SEQ ID NO: 79213
  Description of Artificial Sequence: Synthetic coding sequence

SEQ ID NO: 79220 - DNA, 567 bp, Artificial Sequence
  Description of Artificial Sequence: Synthetic coding sequence
tgaagaagacccgaggtggacggcgtgagaaaggccctgcaggacctgggcctgagaatcgtggagatcggcgacgagaacgccaccctggacggcaccgacgtgctgttcaccggcagagagttcttcgtgggcctgagcaagtggaccaaccacagaggcgccgagatcgtggccgacaccttcagagacttcgccgtgagcaccgtgcccgtgagcggccccagccacctgagaggcctgtgcggcatgggcggccccagaaccgtggtggccggcagcagcgacgccgcccagaaggccgtgagaatgacccagctgctgaccgtgagcttcttcgtgctgggctgcctggtgtgccccctgagcagctgcaccgtggaggtgggcatctgccccaccgccagaagacactgcagaagcagcctgatgagcccctggtacctgtgccccgcccagaactggagaagactggcccccggcagcgcccccagcgcctggtgcagcgcccacgcccccaccgccgagggcctggccctgggctactgctggcccggcgtgggctag

SEQ ID NO: 79221 - DNA, 567 bp, Artificial Sequence; identical to SEQ ID NO: 79220
  Description of Artificial Sequence: Synthetic coding sequence

SEQ ID NO: 79222 - DNA, 858 bp, Artificial Sequence; identical to SEQ ID NO: 79213
  Description of Artificial Sequence: Synthetic coding sequence

SEQ ID NO: 79223 - DNA, 858 bp, Artificial Sequence; identical to SEQ ID NO: 79213
  Description of Artificial Sequence: Synthetic coding sequence

SEQ ID NO: 79224 - DNA, 858 bp, Artificial Sequence; identical to SEQ ID NO: 79213
  Description of Artificial Sequence: Synthetic coding sequence

SEQ ID NO: 79225 - DNA, 711 bp, Artificial Sequence
  Description of Artificial Sequence: Synthetic coding sequence
atgggcacccccggcgagggcctgggcagatgcagccacgccctgatcagaggcgtgcccgagagcctggccagcggcgagggcgccggcgccggcctgcccgccctggacctggccaaggcccagagagagcacggcgtgctgggcggcaagctgagacagagactgggcctgcagctgctggagctgccccccgaggagagcctgcccctgggccccctgctgggcgacaccgccgtgatccagggcgacaccgccctgatcaccagaccctggagccccgccagaagacccgaggtggacggcgtgagaaaggccctgcaggacctgggcctgagaatcgtggagatcggcgacgagaacgccaccctggacggcaccgacgtgctgttcaccggcagagagttcttcgtgggcctgagcaagtggaccaaccacagaggcgccgagatcgtggccgacaccttcagagacttcgccgtgagcaccgtgcccgtgagcggccccagccacctgagaggcctgtgcggcatgggcggccccagaaccgtggtggccggcagcagcgacgccgcccagaaggccgtgagagccatggccgtgctgaccgaccacccctacgccagcctgaccctgcccgacgacgccgccgccgactgcctgttcctgagacccggcctgcccggcgtgccccccttcctgctgcactag

SEQ ID NO: 79226 - DNA, 681 bp, Artificial Sequence
  Description of Artificial Sequence: Synthetic coding sequence
atgggcacccccggcgagggcctgggcagatgcagccacgccctgatcagaggcgtgcccgagagcctggccagcggcgagggcgccggcgccggcctgcccgccctggacctggccaaggcccagagagagcacggcgtgctgggcggcaagctgagacagagactgggcctgcagctgctggagctgccccccgaggagagcctgcccctgggccccctgctgggcgacaccgccgtgatccagggcgacaccgccctgatcaccagaccctggagccccgccagaagacccgaggtggacggcgtgagaaaggccctgcaggacctgggcctgagaatcgtggagatcggcgacgagaacgccaccctggacggcaccgacgtgctgttcaccggcagagagttcttcgtgggcctgagcaagtggaccaaccacagaggcgccgagatcgtggccgacaccttcagagacttcgccgtgagcaccgtgcccgtgagcggccccagccacctgagaggcctgtgcggcatgggcggccccagaaccgtggtggccggcagcagcgacgccgcccagaaggccgtgagagccatggccgtgctgaccgaccacccctacgccagcctgaccctgcccgacgacgccgccgccgactgcctgttcctgagacccggctag

SEQ ID NO: 79227 - DNA, 711 bp, Artificial Sequence; identical to SEQ ID NO: 79225
  Description of Artificial Sequence: Synthetic coding sequence

SEQ ID NO: 79228 - DNA, 858 bp, Artificial Sequence; identical to SEQ ID NO: 79213
  Description of Artificial Sequence: Synthetic coding sequence

SEQ ID NO: 79229 - DNA, 858 bp, Artificial Sequence; identical to SEQ ID NO: 79213
  Description of Artificial Sequence: Synthetic coding sequence

SEQ ID NO: 79230 - DNA, 858 bp, Artificial Sequence; identical to SEQ ID NO: 79213
  Description of Artificial Sequence: Synthetic coding sequence

SEQ ID NO: 79231 - DNA, 681 bp, Artificial Sequence; identical to SEQ ID NO: 79226
  Description of Artificial Sequence: Synthetic coding sequence

SEQ ID NO: 79232 - DNA, 858 bp, Artificial Sequence; identical to SEQ ID NO: 79213
  Description of Artificial Sequence: Synthetic coding sequence

SEQ ID NO: 79233 - DNA, 681 bp, Artificial Sequence; identical to SEQ ID NO: 79226
  Description of Artificial Sequence: Synthetic coding sequence

SEQ ID NO: 79234 - DNA, 681 bp, Artificial Sequence; identical to SEQ ID NO: 79226
  Description of Artificial Sequence: Synthetic coding sequence

SEQ ID NO: 79235 - DNA, 858 bp, Artificial Sequence; identical to SEQ ID NO: 79213
  Description of Artificial Sequence: Synthetic coding sequence

SEQ ID NO: 79236 - DNA, 681 bp, Artificial Sequence; identical to SEQ ID NO: 79226
  Description of Artificial Sequence: Synthetic coding sequence

SEQ ID NO: 79237 - DNA, 567 bp, Artificial Sequence; identical to SEQ ID NO: 79220
  Description of Artificial Sequence: Synthetic coding sequence

SEQ ID NO: 79238 - DNA, 567 bp, Artificial Sequence; identical to SEQ ID NO: 79220
  Description of Artificial Sequence: Synthetic coding sequence

SEQ ID NO: 79239 - DNA, 681 bp, Artificial Sequence; identical to SEQ ID NO: 79226
  Description of Artificial Sequence: Synthetic coding sequence

SEQ ID NO: 79240 - DNA, 858 bp, Artificial Sequence; identical to SEQ ID NO: 79213
  Description of Artificial Sequence: Synthetic coding sequence

SEQ ID NO: 79241 - DNA, 711 bp, Artificial Sequence; identical to SEQ ID NO: 79225
  Description of Artificial Sequence: Synthetic coding sequence

SEQ ID NO: 79242 - DNA, 711 bp, Artificial Sequence; identical to SEQ ID NO: 79225
  Description of Artificial Sequence: Synthetic coding sequence

SEQ ID NO: 79243 - DNA, 858 bp, Artificial Sequence; identical to SEQ ID NO: 79213
  Description of Artificial Sequence: Synthetic coding sequence

SEQ ID NO: 79244 - DNA, 678 bp, Artificial Sequence
  Description of Artificial Sequence: Synthetic coding sequence
atgggcacccccggcgagggcctgggcagatgcagccacgccctgatcagaggcgtgcccgagagcctggccagcggcgagggcgccggcgccggcctgcccgccctggacctggccaaggcccagagagagcacggcgtgctgggcggcaagctgagacagagactgggcctgcagctgctggagctgccccccgaggagagcctgcccctgggccccctgctgggcgacaccgccgtgatccagggcgacaccgccctgatcaccagaccctggagccccgccagaagacccgaggtggacggcgtgagaaaggccctgcaggacctgggcctgagaatcgtggagatcggcgacgagaacgccaccctggacggcaccgacgtgctgttcaccggcagagagttcttcgtgggcctgagcaagtggaccaaccacagaggcgccgagatcgtggccgacaccttcagagacttcgccgtgagcaccgtgcccgtgagcggccccagccacctgagaggcctgtgcggcatgggcggccccagaaccgtggtggccggcagcagcgacgccgcccagaaggccgtgagagccatggccgtgctgaccgaccacccctacgccagcctgaccctgcccgacgacgccgccgccgactgcctgttcctgagaccctag

SEQ ID NO: 79245 - DNA, 858 bp, Artificial Sequence; identical to SEQ ID NO: 79213
  Description of Artificial Sequence: Synthetic coding sequence

SEQ ID NO: 79246 - DNA, 567 bp, Artificial Sequence; identical to SEQ ID NO: 79220
  Description of Artificial Sequence: Synthetic coding sequence

SEQ ID NO: 79247 - DNA, 567 bp, Artificial Sequence; identical to SEQ ID NO: 79220
  Description of Artificial Sequence: Synthetic coding sequence

SEQ ID NO: 79248 - DNA, 858 bp, Artificial Sequence; identical to SEQ ID NO: 79213
  Description of Artificial Sequence: Synthetic coding sequence

SEQ ID NO: 79249 - DNA, 711 bp, Artificial Sequence; identical to SEQ ID NO: 79225
  Description of Artificial Sequence: Synthetic coding sequence

SEQ ID NO: 79250 - DNA, 567 bp, Artificial Sequence; identical to SEQ ID NO: 79220
  Description of Artificial Sequence: Synthetic coding sequence

SEQ ID NO: 79251 - DNA, 858 bp, Artificial Sequence; identical to SEQ ID NO: 79213
  Description of Artificial Sequence: Synthetic coding sequence

SEQ ID NO: 79252 - DNA, 858 bp, Artificial Sequence; identical to SEQ ID NO: 79213
  Description of Artificial Sequence: Synthetic coding sequence

SEQ ID NO: 79253 - DNA, 711 bp, Artificial Sequence; identical to SEQ ID NO: 79225
  Description of Artificial Sequence: Synthetic coding sequence

SEQ ID NO: 79254 - DNA, 711 bp, Artificial Sequence; identical to SEQ ID NO: 79225
  Description of Artificial Sequence: Synthetic coding sequence

SEQ ID NO: 79255 - DNA, 2601 bp, Artificial Sequence
  Description of Artificial Sequence: Synthetic coding sequence
atgctgagacccggcgcccagctgctgagaggcctgctgctgagaagctgccccctgcagggcagccccggcagacccagaagcgtgtgcggcagagagggcgaggagaagccccccctgagcgccgagacccagtggaaggacagagccgagaccgtgatcatcggcggcggctgcgtgggcgtgagcctggcctaccacctggccaaggccggcatgaaggacgtggtgctgctggagaagagcgagctgaccgccggcagcacctggcacgccgccggcctgaccacctacttccaccccggcatcaacctgaagaagatccactacgacagcatcaagctgtacgagaagctggaggaggagaccggccaggtggtgggcttccaccagcccggcagcatcagactggccaccacccccgtgagagtggacgagttcaagtaccagatgaccagaaccggctggcacgccaccgagcagtacctgatcgagcccgagaagatccaggagatgttccccctgctgaacatgaacaaggtgctggccggcctgtacaaccccggcgacggccacatcgacccctacagcctgaccatggccctggccgccggcgccagaaagtgcggcgccctgctgaagtaccccgcccccgtgaccagcctgaaggccagaagcgacggcacctgggacgtggagaccccccagggcagcatgagagccaacagaatcgtgaacgccgccggcttctgggccagagaggtgggcaagatgatcggcctggagcaccccctgatccccgtgcagcaccagtacgtggtgaccagcaccatcagcgaggtgaaggccctgaagagagagctgcccgtgctgagagacctggagggcagctactacctgagacaggagagagacggcctgctgttcggcccctacgagagccaggagaagatgaaggtgcaggacagctgggtgaccaacggcgtgccccccggcttcggcaaggagctgttcgagagcgacctggacagaatcatggagcacatcaaggccgccatggagatggtgcccgtgctgaagaaggccgacatcatcaacgtggtgaacggccccatcacctacagccccgacatcctgcccatggtgggcccccaccagggcgtgagaaactactgggtggccatcggcttcggctacggcatcatccacgccggcggcgtgggcaagtacctgagcgactggatcctgcacggcgagccccccttcgacctgatcgagctggaccccaacagatacggcaagtggaccaccacccagtacaccgaggccaaggccagagagagctacggcttcaacaacatcgtgggctaccccaaggaggagagattcgccggcagacccacccagagagtgagcggcctgtaccagagactggagagcaagtgcagcatgggcttccacgccggctgggagcagccccactggttctacaagcccggccaggacacccagtacagacccagcttcagaagaaccaactggttcgagcccgtgggcagcgagtacaagcaggtgatgcagagagtggccgtgaccgacctgagccccttcggcaagttcaacatcaagggccaggacagcatcagactgctggaccacctgttcgccaacgtgatccccaaggtgggcttcaccaacatcagccacatgctgacccccaagggcagagtgtacgccgagctgaccgtgagccaccagagccccggcgagttcctgctgatcaccggcagcggcagcgagctgcacgacctgagatggatcgaggaggaggccgtgaagggcggctacgacgtggagatcaagaacatcaccgacgagctgggcgtgctgggcgtggccggcccccaggccagaaaggtgctgcagaagctgaccagcgaggacctgagcgacgacgtgttcaagttcctgcagaccaagagcctgaaggtgagcaacatccccgtgaccgccatcagaatcagctacaccggcgagctgggctgggagctgtaccacagaagagaggacagcgtggccctgtacgacgccatcatgaacgccggccaggaggagggcatcgacaacttcggcacctacgccatgaacgccctgagactggagaaggccttcagagcctggggcctggagatgaactgcgacaccaaccccctggaggccggcctggagtacttcgtgaagctgaacaagcccgccgacttcatcggcaagcaggccctgaagcagatcaaggccaagggcctgaagagaagactggtgtgcctgaccctggccaccgacgacgtggaccccgagggcaacgagagcatctggtacaacggcaaggtggtgggcaacaccaccagcggcagctacagctacagcatccagaagagcctggccttcgcctacgtgcccgtgcagctgagcgaggtgggccagcaggtggaggtggagctgctgggcaagaactaccccgccgtgatcatccaggagcccctggtgctgaccgagcccaccagaaacagactgcagaagaagggcggcaaggacaagacctag

SEQ ID NO: 79256 - DNA, 1722 bp, Artificial Sequence
  Description of Artificial Sequence: Synthetic coding sequence
atggagagacagagcagaaacagcgacaactggagatggctgtgctggtgcgagagcggcctgagccccggccagagcagagacgagagatgcggccccgccggcgagatcagagcccacggctggatctacctggccagaagattctgggccagagaggtgggcaagatgatcggcctggagcaccccctgatccccgtgcagcaccagtacgtggtgaccagcaccatcagcgaggtgaaggccctgaagagagagctgcccgtgctgagagacctggagggcagctactacctgagacaggagagagacggcctgctgttcggcccctacgagagccaggagaagatgaaggtgcaggacagctgggtgaccaacggcgtgccccccggcttcggcaaggagctgttcgagagcgacctggacagaatcatggagcacatcaaggccgccatggagatggtgcccgtgctgaagaaggccgacatcatcaacgtggtgaacggccccatcacctacagccccgacatcctgcccatggtgggcccccaccagggcgtgagaaactactgggtggccatcggcttcggctacggcatcatccacgccggcggcgtgggcaagtacctgagcgactggatcctgcacggcgagccccccttcgacctgatcgagctggaccccaacagatacggcaagtggaccaccacccagtacaccgaggccaaggccagagagagctacggcttcaacaacatcgtgggctaccccaaggaggagagattcgccggcagacccacccagagagtgagcggcctgtaccagagactggagagcaagtgcagcatgggcttccacgccggctgggagcagccccactggttctacaagcccggccaggacacccagtacagacccagcttcagaagaaccaactggttcgagcccgtgggcagcgagtacaagcaggtgatgcagagagtggccgtgaccgacctgagccccttcggcaagttcaacatcaagggccaggacagcatcagactgctggaccacctgttcgccaacgtgatccccaaggtgggcttcaccaacatcagccacatgctgacccccaagggcagagtgtacgccgagctgaccgtgagccaccagagccccggcgagttcctgctgatcaccggcagcggcagcgagctgcacgacctgagatggatcgaggaggaggccgtgaagggcggctacgacgtggagatcaagaacatcaccgacgagctgggcgtgctgggcgtggccggcccccaggccagaaaggtgctgcagaagctgaccagcgaggacctgagcgacgacgtgttcaagttcctgcagaccaagagcctgaaggtgagcaacatccccgtgaccgccatcagaatcagctacaccggcgagctgggctgggagctgtaccacagaagagaggacagcgtggccctgtacgacgccatcatgaacgccggccaggaggagggcatcgacaacttcggcacctacgccatgaacgccctgagactggagaaggccttcagagcctggggcctggagatgaactgcgacaccaaccccctggaggccggcctggagtacttcgtgaagctgaacaaggaccagaacagctgcttcgcccacttcaaggaggagaacggctgggtgagcagatgggccatcagaccctactag

SEQ ID NO: 79257 - DNA, 1842 bp, Artificial Sequence
  Description of Artificial Sequence: Synthetic coding sequence
tacctgatcgagcccgagaagatccaggagatgttccccctgctgaacatgaacaaggtgctggccggcctgtacaaccccggcgacggccacatcgacccctacagcctgaccatggccctggccgccggcgccagaaagtgcggcgccctgctgaagtaccccgcccccgtgaccagcctgaaggccagaagcgacggcacctgggacgtggagaccccccagggcagcatgagagccaacagaatcgtgaacgccgccggcttctgggccagagaggtgggcaagatgatcggcctggagcaccccctgatccccgtgcagcaccagtacgtggtgaccagcaccatcagcgaggtgaaggccctgaagagagagctgcccgtgctgagagacctggagggcagctactacctgagacaggagagagacggcctgctgttcggcccctacgagagccaggagaagatgaaggtgcaggacagctgggtgaccaacggcgtgccccccggcttcggcaaggagctgttcgagagcgacctggacagaatcatggagcacatcaaggccgccatggagatggtgcccgtgctgaagaaggccgacatcatcaacgtggtgaacggccccatcacctacagccccgacatcctgcccatggtgggcccccaccagggcgtgagaaactactgggtggccatcggcttcggctacggcatcatccacgccggcggcgtgggcaagtacctgagcgactggatcctgcacggcgagccccccttcgacctgatcgagctggaccccaacagatacggcaagtggaccaccacccagtacaccgaggccaaggccagagagagctacggcttcaacaacatcgtgggctaccccaaggaggagagattcgccggcagacccacccagagagtgagcggcctgtaccagagactggagagcaagtgcagcatgggcttccacgccggctgggagcagccccactggttctacaagcccggccaggacacccagtacagacccagcttcagaagaaccaactggttcgagcccgtgggcagcgagtacaagcaggtgatgcagagagtggccgtgaccgacctgagccccttcggcaagttcaacatcaagggccaggacagcatcagactgctggaccacctgttcgccaacgtgatccccaaggtgggcttcaccaacatcagccacatgctgacccccaagggcagagtgtacgccgagctgaccgtgagccaccagagccccggcgagttcctgctgatcaccggcagcggcagcgagctgcacgacctgagatggatcgaggaggaggccgtgaagggcggctacgacgtggagatcaagaacatcaccgacgagctgggcgtgctgggcgtggccggcccccaggccagaaaggtgctgcagaagctgaccagcgaggacctgagcgacgacgtgttcaagttcctgcagaccaagagcctgaaggtgagcaacatccccgtgaccgccatcagaatcagctacaccggcgagctgggctgggagctgtaccacagaagagaggacagcgtggccctgtacgacgccatcatgaacgccggccaggaggagggcatcgacaacttcggcacctacgccatgaacgccctgagactggagaaggccttcagagcctggggcctggagatgaactgcgacaccaaccccctggaggccggcctggagtacttcgtgaagctgaacaaggaccagaacagctgcttcgcccacttcaaggaggagaacggctgggtgagcagatgggccatcagaccctactag

SEQ ID NO: 79258 - DNA, 1875 bp, Artificial Sequence
  Description of Artificial Sequence: Synthetic coding sequence
atgaccagaaccggctggcacgccaccgagcagtacctgatcgagcccgagaagatccaggagatgttccccctgctgaacatgaacaaggtgctggccggcctgtacaaccccggcgacggccacatcgacccctacagcctgaccatggccctggccgccggcgccagaaagtgcggcgccctgctgaagtaccccgcccccgtgaccagcctgaaggccagaagcgacggcacctgggacgtggagaccccccagggcagcatgagagccaacagaatcgtgaacgccgccggcttctgggccagagaggtgggcaagatgatcggcctggagcaccccctgatccccgtgcagcaccagtacgtggtgaccagcaccatcagcgaggtgaaggccctgaagagagagctgcccgtgctgagagacctggagggcagctactacctgagacaggagagagacggcctgctgttcggcccctacgagagccaggagaagatgaaggtgcaggacagctgggtgaccaacggcgtgccccccggcttcggcaaggagctgttcgagagcgacctggacagaatcatggagcacatcaaggccgccatggagatggtgcccgtgctgaagaaggccgacatcatcaacgtggtgaacggccccatcacctacagccccgacatcctgcccatggtgggcccccaccagggcgtgagaaactactgggtggccatcggcttcggctacggcatcatccacgccggcggcgtgggcaagtacctgagcgactggatcctgcacggcgagccccccttcgacctgatcgagctggaccccaacagatacggcaagtggaccaccacccagtacaccgaggccaaggccagagagagctacggcttcaacaacatcgtgggctaccccaaggaggagagattcgccggcagacccacccagagagtgagcggcctgtaccagagactggagagcaagtgcagcatgggcttccacgccggctgggagcagccccactggttctacaagcccggccaggacacccagtacagacccagcttcagaagaaccaactggttcgagcccgtgggcagcgagtacaagcaggtgatgcagagagtggccgtgaccgacctgagccccttcggcaagttcaacatcaagggccaggacagcatcagactgctggaccacctgttcgccaacgtgatccccaaggtgggcttcaccaacatcagccacatgctgacccccaagggcagagtgtacgccgagctgaccgtgagccaccagagccccggcgagttcctgctgatcaccggcagcggcagcgagctgcacgacctgagatggatcgaggaggaggccgtgaagggcggctacgacgtggagatcaagaacatcaccgacgagctgggcgtgctgggcgtggccggcccccaggccagaaaggtgctgcagaagctgaccagcgaggacctgagcgacgacgtgttcaagttcctgcagaccaagagcctgaaggtgagcaacatccccgtgaccgccatcagaatcagctacaccggcgagctgggctgggagctgtaccacagaagagaggacagcgtggccctgtacgacgccatcatgaacgccggccaggaggagggcatcgacaacttcggcacctacgccatgaacgccctgagactggagaaggccttcagagcctggggcctggagatgaactgcgacaccaaccccctggaggccggcctggagtacttcgtgaagctgaacaaggaccagaacagctgcttcgcccacttcaaggaggagaacggctgggtgagcagatgggccatcagaccctactag

SEQ ID NO: 79259 - DNA, 1185 bp, Artificial Sequence
  Description of Artificial Sequence: Synthetic coding sequence
atgtggagctgctggagaaaccagagcagcagactggacctgcccggcacccagtacggcatcatccacgccggcggcgtgggcaagtacctgagcgactggatcctgcacggcgagccccccttcgacctgatcgagctggaccccaacagatacggcaagtggaccaccacccagtacaccgaggccaaggccagagagagctacggcttcaacaacatcgtgggctaccccaaggaggagagattcgccggcagacccacccagagagtgagcggcctgtaccagagactggagagcaagtgcagcatgggcttccacgccggctgggagcagccccactggttctacaagcccggccaggacacccagtacagacccagcttcagaagaaccaactggttcgagcccgtgggcagcgagtacaagcaggtgatgcagagagtggccgtgaccgacctgagccccttcggcaagttcaacatcaagggccaggacagcatcagactgctggaccacctgttcgccaacgtgatccccaaggtgggcttcaccaacatcagccacatgctgacccccaagggcagagtgtacgccgagctgaccgtgagccaccagagccccggcgagttcctgctgatcaccggcagcggcagcgagctgcacgacctgagatggatcgaggaggaggccgtgaagggcggctacgacgtggagatcaagaacatcaccgacgagctgggcgtgctgggcgtggccggcccccaggccagaaaggtgctgcagaagctgaccagcgaggacctgagcgacgacgtgttcaagttcctgcagaccaagagcctgaaggtgagcaacatccccgtgaccgccatcagaatcagctacaccggcgagctgggctgggagctgtaccacagaagagaggacagcgtggccctgtacgacgccatcatgaacgccggccaggaggagggcatcgacaacttcggcacctacgccatgaacgccctgagactggagaaggccttcagagcctggggcctggagatgaactgcgacaccaaccccctggaggccggcctggagtacttcgtgaagctgaacaaggaccagaacagctgcttcgcccacttcaaggaggagaacggctgggtgagcagatgggccatcagaccctactag

SEQ ID NO: 79260 - DNA, 4731 bp, Artificial Sequence
  Description of Artificial Sequence: Synthetic coding sequence
atggccgagagaggcctggagcccagccccgccgccgtggccgccctgccccccgaggtgagagcccagctggccgagctggagctggagctgagcgagggcgacatcacccagaagggctacgagaagaagagaagcaagctgctgagcccctacagcccccagacccaggagaccgacagcgccgtgcagaaggagctgagaaaccagacccccgcccccagcgccgcccagaccagcgcccccagcaagtaccacagaaccagaagcggcggcgccagagacgagagatacagaagcgacatccacaccgaggccgtgcaggccgccctggccaagcacaaggagcagaagatggccctgcccatgcccaccaagagaagaagcaccttcgtgcagagccccgccgacgcctgcaccccccccgacaccagcagcgccagcgaggacgagggcagcctgagaagacaggccgccctgagcgccgccctgcagcagagcctgcagaacgccgagagctggatcaacagaagcatccagggcagcagcaccagcagcagcgccagcagcaccctgagccacggcgaggtgaagggcaccagcggcagcctggccgacgtgttcgccaacaccagaatcgagaacttcagcgccccccccgacgtgaccaccaccaccagcagcagcagcagcagcagcagcatcagacccgccaacatcgacctgccccccagcggcatcgtgaagggcatgcacaagggcagcaacagaagcagcctgatggacaccgccgacggcgtgcccgtgagcagcagagtgagcaccaagatccagcagctgctgaacaccctgaagagacccaagagaccccccctgaaggagttcttcgtggacgacagcgaggagatcgtggaggtgccccagcccgaccccaaccagcccaagcccgagggcagacagatgacccccgtgaagggcgagcccctgggcgtgatctgcaactggccccccgccctggagagcgccctgcagagatggggcaccacccaggccaagtgcagctgcctgaccgccctggacatgaccggcaagcccgtgtacaccctgacctacggcaagctgtggagcagaagcctgaagctggcctacaccctgctgaacaagctgggcaccaagaacgagcccgtgctgaagcccggcgacagagtggccctggtgtaccccaacaacgaccccgtgatgttcatggtggccttctacggctgcctgctggccgaggtgatccccgtgcccatcgaggtgcccctgaccagaaaggacgccggcggccagcagatcggcttcctgctgggcagctgcggcatcgccctggccctgaccagcgaggtgtgcctgaagggcctgcccaagacccagaacggcgagatcgtgcagttcaagggctggcccagactgaagtgggtggtgaccgacagcaagtacctgagcaagccccccaaggactggcagccccacatcagccccgccggcaccgagcccgcctacatcgagtacaagaccagcaaggagggcagcgtgatgggcgtgaccgtgagcagactggccatgctgagccactgccaggccctgagccaggcctgcaactacagcgagggcgagaccatcgtgaacgtgctggacttcaagaaggacgccggcctgtggcacggcatgttcgccaacgtgatgaacaagatgcacaccatcagcgtgccctacagcgtgatgaagacctgccccctgagctgggtgcagagagtgcacgcccacaaggccaaggtggccctggtgaagtgcagagacctgcactgggccatgatggcccacagagaccagagagacgtgagcctgagcagcctgagaatgctgatcgtgaccgacggcgccaacccctggagcgtgagcagctgcgacgccttcctgagcctgttccagagccacggcctgaagcccgaggccatctgcccctgcgccaccagcgccgaggccatgaccgtggccatcagaagacccggcgtgcccggcgcccccctgcccggcagagccatcctgagcatgaacggcctgagctacggcgtgatcagagtgaacaccgaggacaagaacagcgccctgaccgtgcaggacgtgggccacgtgatgcccggcggcatgatgtgcatcgtgaagcccgacggccccccccagctgtgcaagaccgacgagatcggcgagatctgcgtgagcagcagaaccggcggcatgatgtacttcggcctggccggcgtgaccaagaacaccttcgaggtgatccccgtgaacagcgccggcagccccgtgggcgacgtgcccttcatcagaagcggcctgctgggcttcgtgggccccggcagcctggtgttcgtggtgggcaagatggacggcctgctgatggtgagcggcagaagacacaacgccgacgacatcgtggccaccggcctggccgtggagagcatcaagaccgtgtacagaggcagaatcgccgtgttcagcgtgagcgtgttctacgacgagagaatcgtggtggtggccgagcagagacccgacgccagcgaggaggacagcttccagtggatgagcagagtgctgcaggccatcgacagcatccaccaggtgggcgtgtactgcctggccctggtgcccgccaacaccctgcccaagacccccctgggcggcatccacatcagccagaccaagcagctgttcctggagggcagcctgcacccctgcaacatcctgatgtgcccccacacctgcgtgaccaacctgcccaagcccagacagaagcagcccggcgtgggccccgccagcgtgatggtgggcaacctggtggccggcaagagaatcgcccaggccgccggcagagacctgggccagatcgaggagaacgacctggtgagaaagcaccagttcctggccgagatcctgcagtggagagcccaggccacccccgaccacgtgctgttcatgctgctgaacgccaagggcaccaccgtgtgcaccgccagctgcctgcagctgcacaagagagccgagagaatcgccagcgtgctgggcgacaagggccacctgaacgccggcgacaacgtggtgctgctgtacccccccggcatcgagctgatcgccgccttctacggctgcctgtacgccggctgcatccccgtgaccgtgagacccccccacgcccagaacctgaccgccaccctgcccaccgtgagaatgatcgtggacgtgagcaaggccgcctgcatcctgaccagccagaccctgatgagactgctgagaagcagagaggccgccgccgccgtggacgtgaagacctggcccaccatcatcgacaccgacgacctgcccagaaagagactgccccagctgtacaagccccccacccccgagatgctggcctacctggacttcagcgtgagcaccaccggcatgctgaccggcgtgaagatgagccacagcgccgtgaacgccctgtgcagagccatcaagctgcagtgcgagctgtacagcagcagacagatcgccatctgcctggacccctactgcggcctgggcttcgccctgtggtgcctgtgcagcgtgtacagcggccaccagagcgtgctgatcccccccatggagctggagaacaacctgttcctgtggctgagcaccgtgaaccagtacaagatcagagacaccttctgcagctacagcgtgatggagctgtgcaccaagggcctgggcaaccaggtggaggtgctgaagaccagaggcatcaacctgagctgcgtgagaacctgcgtggtggtggccgaggagagacccagagtggccctgcagcagagcttcagcaagctgttcaaggacatcggcctgagccccagagccgtgagcaccaccttcggcagcagagtgaacgtggccatctgcctgcagggcaccagcggccccgaccccaccaccgtgtacgtggacctgaagagcctgagacacgacagagtgagactggtggagagaggcgccccccagagcctgctgctgagcgagagcggcaagatcctgcccggcgtgaaggtggtgatcgtgaaccccgagaccaagggccccgtgggcgacagccacctgggcgagatctgggtgaacagcccccacaccgccagcggctactacaccatctacgacagcgagaccctgcaggccgaccacttcaacaccagactgagcttcggcgacgccgcccagaccctgtgggccagaaccggctacctgggcttcgtgagaagaaccgagctgaccgccgccaccggcgagagacacgacgccctgtacgtggtgggcgccctggacgagaccctggagctgagaggcctgagataccaccccatcgacatcgagaccagcgtgagcagaatccacagaagcatcgccgagtgcgccgtgttcacctggaccaacctgctggtggtggtggtggagctgtgcggcagcgagcaggaggccctggacctggtgcccctggtgaccaacgtggtgctggaggagcactacctgatcgtgggcgtggtggtggtggtggaccccggcgtgatccccatcaacagcagaggcgagaagcagagaatgcacctgagagacagcttcctggccgaccagctggaccccatctacgtggcctacaacatgtag

SEQ ID NO: 79261 - DNA, 1179 bp, Artificial Sequence
  Description of Artificial Sequence: Synthetic coding sequence
atggccgagagaggcctggagcccagccccgccgccgtggccgccctgccccccgaggtgagagcccagctggccgagctggagctggagctgagcgagggcgacatcacccagaagggctacgagaagaagagaagcaagctgctgagcccctacagcccccagacccaggagaccgacagcgccgtgcagaaggagctgagaaaccagacccccgcccccagcgccgcccagaccagcgcccccagcaagtaccacagaaccagaagcggcggcgccagagacgagagatacagaagcgagttcagcctggtgagaatctacagcgaggacatccacaccgaggccgtgcaggccgccctggccaagcacaaggagcagaagatggccctgcccatgcccaccaagagaagaagcaccttcgtgcagagccccgccgacgcctgcaccccccccgacaccagcagcgccagcgaggacgagggcagcctgagaagacaggccgccctgagcgccgccctgcagcagagcctgcagaacgccgagagctggatcaacagaagcatccagggcagcagcaccagcagcagcgccagcagcaccctgagccacggcgaggtgaagggcaccagcggcagcctggccgacgtgttcgccaacaccagaatcgagaacttcagcgccccccccgacgtgaccaccaccaccagcagcagcagcagcagcagcagcatcagacccgccaacatcgacctgccccccagcggcatcgtgaagggcatgcacaagggcagcaacagaagcagcctgatggacaccgccgacggcgtgcccgtgagcagcagagtgagcaccaagatccagcagctgctgaacaccctgaagagacccaagagaccccccctgaaggagttcttcgtggacgacagcgaggagatcgtggaggtgccccagcccgaccccaaccagcccaagcccgagggcagacagatgacccccgtgaagggcgagcccctgggcgtgatctgcaactggccccccgccctggagagcgccctgcagagatggggcaccacccaggccaagtgcagctgcctgaccgccctggacatgaccggcaagcccgtgtacaccctgacctacggcgagagcgccagattccagatcctgctgagctag

SEQ ID NO: 79262 - DNA, 4671 bp, Artificial Sequence
  Description of Artificial Sequence: Synthetic coding sequence
atggccgacagaagcctggagggcatggccctgcccctggaggtgagagccagactggccgagctggagctggagctgagcgagggcgacatcacccagaagggctacgagaagaagagaagcaagctgatcggcgcctacctgccccagccccccagagtggaccaggccctgccccaggagagaagagcccccgtgacccccagcagcgccagcagataccacagaagaagaagcagcggcagcagagacgagagatacagaagcgacgtgcacaccgaggccgtgcaggccgccctggccaagcacaaggagagaaagatggccgtgcccatgcccagcaagagaagaagcctggtggtgcagaccagcatggacgcctacaccccccccgacaccagcagcggcagcgaggacgagggcagcgtgcagggcgacagccagggcacccccaccagcagccagggcagcatcaacatggagcactggatcagccaggccatccacggcagcaccaccagcaccaccagcagcagcagcacccagagcggcggcagcggcgccgcccacagactggccgacgtgatggcccagacccacatcgagaaccacagcgccccccccgacgtgaccacctacaccagcgagcacagcatccaggtggagagaccccagggcagcaccggcagcagaaccgcccccaagtacggcaacgccgagctgatggagaccggcgacggcgtgcccgtgagcagcagagtgagcgccaagatccagcagctggtgaacaccctgaagagacccaagagaccccccctgagagagttcttcgtggacgacttcgaggagctgctggaggtgcagcagcccgaccccaaccagcccaagcccgagggcgcccagatgctggccatgagaggcgagcagctgggcgtggtgaccaactggccccccagcctggaggccgccctgcagagatggggcaccatcagccccaaggccccctgcctgaccaccatggacaccaacggcaagcccctgtacatcctgacctacggcaagctgtggaccagaagcatgaaggtggcctacagcatcctgcacaagctgggcaccaagcaggagcccatggtgagacccggcgacagagtggccctggtgttccccaacaacgaccccgccgccttcatggccgccttctacggctgcctgctggccgaggtggtgcccgtgcccatcgaggtgcccctgaccagaaaggacgccggcagccagcagatcggcttcctgctgggcagctgcggcgtgaccgtggccctgaccagcgacgcctgccacaagggcctgcccaagagccccaccggcgagatcccccagttcaagggctggcccaagctgctgtggttcgtgaccgagagcaagcacctgagcaagccccccagagactggttcccccacatcaaggacgccaacaacgacaccgcctacatcgagtacaagacctgcaaggacggcagcgtgctgggcgtgaccgtgaccagaaccgccctgctgacccactgccaggccctgacccaggcctgcggctacaccgaggccgagaccatcgtgaacgtgctggacttcaagaaggacgtgggcctgtggcacggcatcctgaccagcgtgatgaacatgatgcacgtgatcagcatcccctacagcctgatgaaggtgaaccccctgagctggatccagaaggtgtgccagtacaaggccaaggtggcctgcgtgaagagcagagacatgcactgggccctggtggcccacagagaccagagagacatcaacctgagcagcctgagaatgctgatcgtggccgacggcgccaacccctggagcatcagcagctgcgacgccttcctgaacgtgttccagagcaagggcctgagacaggaggtgatctgcccctgcgccagcagccccgaggccctgaccgtggccatcagaagacccaccgacgacagcaaccagccccccggcagaggcgtgctgagcatgcacggcctgacctacggcgtgatcagagtggacagcgaggagaagctgagcgtgctgaccgtgcaggacgtgggcctggtgatgcccggcgccatcatgtgcagcgtgaagcccgacggcgtgccccagctgtgcagaaccgacgagatcggcgagctgtgcgtgtgcgccgtggccaccggcaccagctactacggcctgagcggcatgaccaagaacaccttcgaggtgttccccatgaccagcagcggcgcccccatcagcgagtaccccttcatcagaaccggcctgctgggcttcgtgggccccggcggcctggtgttcgtggtgggcaagatggacggcctgatggtggtgagcggcagaagacacaacgccgacgacatcgtggccaccgccctggccgtggagcccatgaagttcgtgtacagaggcagaatcgccgtgttcagcgtgaccgtgctgcacgacgagagaatcgtgatcgtggccgagcagagacccgacagcaccgaggaggacagcttccagtggatgagcagagtgctgcaggccatcgacagcatccaccaggtgggcgtgtactgcctggccctggtgcccgccaacaccctgcccaagacccccctgggcggcatccacctgagcgagaccaagcagctgttcctggagggcagcctgcacccctgcaacgtgctgatgtgcccccacacctgcgtgaccaacctgcccaagcccagacagaagcagcccgagatcggccccgccagcgtgatggtgggcaacctggtgagcggcaagagaatcgcccaggccagcggcagagacctgggccagatcgaggacaacgaccaggccagaaagttcctgttcctgagcgaggtgctgcagtggagagcccagaccacccccgaccacatcctgtacaccctgctgaactgcagaggcgccatcgccaacagcctgacctgcgtgcagctgcacaagagagccgagaagatcgccgtgatgctgatggagagaggccacctgcaggacggcgaccacgtggccctggtgtacccccccggcatcgacctgatcgccgccttctacggctgcctgtacgccggctgcgtgcccatcaccgtgagacccccccacccccagaacatcgccaccaccctgcccaccgtgaagatgatcgtggaggtgagcagaagcgcctgcctgatgaccacccagctgatctgcaagctgctgagaagcagagaggccgccgccgccgtggacgtgagaacctggcccctgatcctggacaccgacgacctgcccaagaagagacccgcccagatctgcaagccctgcaaccccgacaccctggcctacctggacttcagcgtgagcaccaccggcatgctggccggcgtgaagatgagccacgccgccaccagcgccttctgcagaagcatcaagctgcagtgcgagctgtaccccagcagagaggtggccatctgcctggacccctactgcggcctgggcttcgtgctgtggtgcctgtgcagcgtgtacagcggccaccagagcatcctgatcccccccagcgagctggagaccaaccccgccctgtggctgctggccgtgagccagtacaaggtgagagacaccttctgcagctacagcgtgatggagctgtgcaccaagggcctgggcagccagaccgagagcctgaaggccagaggcctggacctgagcagagtgagaacctgcgtggtggtggccgaggagagacccagaatcgccctgacccagagcttcagcaagctgttcaaggacctgggcctgcaccccagagccgtgagcaccagcttcggctgcagagtgaacctggccatctgcctgcagggcaccagcggccccgaccccaccaccgtgtacgtggacatgagagccctgagacacgacagagtgagactggtggagagaggcagcccccacagcctgcccctgatggagagcggcaagatcctgcccggcgtgagaatcatcatcgccaaccccgagaccaagggccccctgggcgacagccacctgggcgagatctgggtgcacagcgcccacaacgccagcggctacttcaccatctacggcgacgagagcctgcagagcgaccacttcaacagcagactgagcttcggcgacacccagaccatctgggccagaaccggctacctgggcttcctgagaagaaccgagctgaccgacgccaacggcgagagacacgacgccctgtacgtggtgggcgccctggacgaggccatggagctgagaggcatgagataccaccccatcgacatcgagaccagcgtgatcagagcccacaagagcgtgaccgagtgcgccgtgttcacctggaccaacctgctggtggtggtggtggagctggacggcagcgagcaggaggccctggacctggtgcccctggtgaccaacgtggtgctggaggagcactacctgatcgtgggcgtggtggtggtggtggacatcggcgtgatccccatcaacagcagaggcgagaagcagagaatgcacctgagagacggcttcctggccgaccagctggaccccatctacgtggcctacaacatgtag

SEQ ID NO: 79263 - DNA, 1971 bp, Artificial Sequence
  Description of Artificial Sequence: Synthetic coding sequence
atggccgtgcccatgcccagcaagagaagaagcctggtggtgcagaccagcatggacgcctacaccccccccgacaccagcagcggcagcgaggacgagggcagcgtgcagggcgacagccagggcacccccaccagcagccagggcagcatcaacatggagcactggatcagccaggccatccacggcagcaccaccagcaccaccagcagcagcagcacccagagcggcggcagcggcgccgcccacagactggccgacgtgatggcccagacccacatcgagaaccacagcgccccccccgacgtgaccacctacaccagcgagcacagcatccaggtggagagaccccagggcagcaccggcagcagaaccgcccccaagtacggcaacgccgagctgatggagaccggcgacggcgtgcccgtgagcagcagagtgagcgccaagatccagcagctggtgaacaccctgaagagacccaagagaccccccctgagagagttcttcgtggacgacttcgaggagctgctggaggtgcagcagcccgaccccaaccagcccaagcccgagggcgcccagatgctggccatgagaggcgagcagctgggcgtggtgaccaactggccccccagcctggaggccgccctgcagagatggggcaccatcagccccaaggccccctgcctgaccaccatggacaccaacggcaagcccctgtacatcctgacctacggcaagctgtggaccagaagcatgaaggtggcctacagcatcctgcacaagctgggcaccaagcaggagcccatggtgagacccggcgacagagtggccctggtgttccccaacaacgaccccgccgccttcatggccgccttctacggctgcctgctggccgaggtggtgcccgtgcccatcgaggtgcccctgaccagaaaggacgccggcagccagcagatcggcttcctgctgggcagctgcggcgtgaccgtggccctgaccagcgacgcctgccacaagggcctgcccaagagccccaccggcgagatcccccagttcaagggctggcccaagctgctgtggttcgtgaccgagagcaagcacctgagcaagccccccagagactggttcccccacatcaaggacgccaacaacgacaccgcctacatcgagtacaagacctgcaaggacggcagcgtgctgggcgtgaccgtgaccagaaccgccctgctgacccactgccaggccctgacccaggcctgcggctacaccgaggccgagaccatcgtgaacgtgctggacttcaagaaggacgtgggcctgtggcacggcatcctgaccagcgtgatgaacatgatgcacgtgatcagcatcccctacagcctgatgaaggtgaaccccctgagctggatccagaaggtgtgccagtacaaggccaaggtggcctgcgtgaagagcagagacatgcactgggccctggtggcccacagagaccagagagacatcaacctgagcagcctgagaatgctgatcgtggccgacggcgccaacccctggagcatcagcagctgcgacgccttcctgaacgtgttccagagcaagggcctgagacaggaggtgatctgcccctgcgccagcagccccgaggccctgaccgtggccatcagaagacccaccgacgacagcaaccagccccccggcagaggcgtgctgagcatgcacggcctgacctacggcgtgatcagagtggacagcgaggagaagctgagcgtgctgaccgtgcaggacgtgggcctggtgatgcccggcgccatcatgtgcagcgtgaagcccgacggcgtgccccagctgtgcagaaccgacgagatcggcgagctgtgcgtgtgcgccgtggccaccggcaccagctactacggcctgagcggcatgaccaagaacaccttcgagcacaccagcaacaagggcaagtag

SEQ ID NO: 79264 - DNA, 597 bp, Artificial Sequence
  Description of Artificial Sequence: Synthetic coding sequence
atgagccacgccgccaccagcgccttctgcagaagcatcaagctgcagtgcgagctgtaccccagcagagaggtggccatctgcctggacccctactgcggcctgggcttcgtgctgtggtgcctgtgcagcgtgtacagcggccaccagagcatcctgatcccccccagcgagctggagaccaaccccgccctgtggctgctggccgtgagccagtacaaggtgagagacaccttctgcagctacagcgtgatggagctgtgcaccaagggcctgggcagccagaccgagagcctgaaggccagaggcctggacctgagcagagtgagaacctgcgtggtggtggccgaggagagacccagaatcgccctgacccagagcttcagcaagctgttcaaggacctgggcctgcaccccagagccgtgagcaccagcttcggctgcagagtgaacctggccatctgcctgcagtgctgggactacagacacgagccccccagacccgcccccaagtgcttcaagatggtgtacaaggagggcgtgagaagcgtgggcgaggacaagatcagagagaagagaaccaagacctggagatag

SEQ ID NO: 79265 - DNA, 696 bp, Artificial Sequence
  Description of Artificial Sequence: Synthetic coding sequence
tgagagaccatcgtgaacgtgctggacttcaagaaggacgtgggcctgtggcacggcatcctgaccagcgtgatgaacatgatgcacgtgatcagcatcccctacagcctgatgaaggtgaaccccctgagctggatccagaaggtgtgccagtacaaggccaaggtggcctgcgtgaagagcagagacatgcactgggccctggtggcccacagagaccagagagacatcaacctgagcagcctgagaatgctgatcgtggccgacggcgccaacccctggagcatcagcagctgcgacgccttcctgaacgtgttccagagcaagggcctgagacaggaggtgatctgcccctgcgccagcagccccgaggccctgaccgtggccatcagaagacccaccgacgacagcaaccagccccccggcagaggcgtgctgagcatgcacggcctgacctacggcgtgatcagagtggacagcgaggagaagctgagcgtgctgaccgtgcaggacgtgggcctggtgatgcccggcgccatcatgtgcagcgtgaagcccgacggcgtgccccagctgtgcagaaccgacgagatcggcgagctgtgcgtgtgcgccgtggccaccggcaccagctactacggcctgagcggcatgaccaagaacaccttcgagcacaccagcaacaagggcaagtag

SEQ ID NO: 79266 - DNA, 564 bp, Artificial Sequence
  Description of Artificial Sequence: Synthetic coding sequence
atggccgacagaagcctggagggcatggccctgcccctggaggtgagagccagactggccgagctggagctggagctgagcgagggcgacatcacccagaagggctacgagaagaagagaagcaagctgatcggcgcctacctgccccagccccccaccgccaacggcgccgccgtggtgagatgcagactgcagcacagcgagggcgcccccagaagaaccttcagaagcgcccacatcggcgtgtgcgacgtgagagaggccgccgccagagagagagtggccagcaccgccggcaacagacccctgttctacttcagattcggcgtggaccaggccctgccccaggagagaagagcccccgtgacccccagcagcgccagcagataccacagaagaagaagcagcggcagcagagacgagagatacagaagcgacgtgcacaccgaggccgtgcaggccgccctggccaagcacaaggagagaaagatggccgtgcccatgcccagcaagagaagaagcctggtggtgcagaccagcatggacgcctacacccccccctag

SEQ ID NO: 79267 - DNA, 468 bp, Artificial Sequence
  Description of Artificial Sequence: Synthetic coding sequence
tgagtgtacagcggccaccagagcatcctgatcccccccagcgagctggagaccaaccccgccctgtggctgctggccgtgagccagtacaaggtgagagacaccttctgcagctacagcgtgatggagctgtgcaccaagggcctgggcagccagaccgagagcctgaaggccagaggcctggacctgagcagagtgagaacctgcgtggtggtggccgaggagagacccagaatcgccctgacccagagcttcagcaagctgttcaaggacctgggcctgcaccccagagccgtgagcaccagcttcggctgcagagtgaacctggccatctgcctgcagtgctgggactacagacacgagccccccagacccgcccccaagtgcttcaagatggtgtacaaggagggcgtgagaagcgtgggcgaggacaagatcagagagaagagaaccaagacctggagatag

SEQ ID NO: 79268 - DNA, 1446 bp, Artificial Sequence
  Description of Artificial Sequence: Synthetic coding sequence
atctgggtgagcagaagcgcctgcctgatgaccacccagctgatctgcaagctgctgagaagcagagaggccgccgccgccgtggacgtgagaacctggcccctgatcctggacaccgacgacctgcccaagaagagacccgcccagatctgcaagccctgcaaccccgacaccctggcctacctggacttcagcgtgagcaccaccggcatgctggccggcgtgaagatgagccacgccgccaccagcgccttctgcagaagcatcaagctgcagtgcgagctgtaccccagcagagaggtggccatctgcctggacccctactgcggcctgggcttcgtgctgtggtgcctgtgcagcgtgtacagcggccaccagagcatcctgatcccccccagcgagctggagaccaaccccgccctgtggctgctggccgtgagccagtacaaggtgagagacaccttctgcagctacagcgtgatggagctgtgcaccaagggcctgggcagccagaccgagagcctgaaggccagaggcctggacctgagcagagtgagaacctgcgtggtggtggccgaggagagacccagaatcgccctgacccagagcttcagcaagctgttcaaggacctgggcctgcaccccagagccgtgagcaccagcttcggctgcagagtgaacctggccatctgcctgcagggcaccagcggccccgaccccaccaccgtgtacgtggacatgagagccctgagacacgacagagtgagactggtggagagaggcagcccccacagcctgcccctgatggagagcggcaagatcctgcccggcgtgagaatcatcatcgccaaccccgagaccaagggccccctgggcgacagccacctgggcgagatctgggtgcacagcgcccacaacgccagcggctacttcaccatctacggcgacgagagcctgcagagcgaccacttcaacagcagactgagcttcggcgacacccagaccatctgggccagaaccggctacctgggcttcctgagaagaaccgagctgaccgacgccaacggcgagagacacgacgccctgtacgtggtgggcgccctggacgaggccatggagctgagaggcatgagataccaccccatcgacatcgagaccagcgtgatcagagcccacaagagcgtgaccgagtgcgccgtgttcacctggaccaacctgctggtggtggtggtggagctggacggcagcgagcaggaggccctggacctggtgcccctggtgaccaacgtggtgctggaggagcactacctgatcgtgggcgtggtggtggtggtggacatcggcgtgatccccatcaacagcagaggcgagaagcagagaatgcacctgagagacggcttcctggccgaccagctggaccccatctacgtggcctacaacatgtag

SEQ ID NO: 79269 - DNA, 1116 bp, Artificial Sequence
  Description of Artificial Sequence: Synthetic coding sequence
atgcacggcctgacctacggcgtgatcagagtggacagcgaggagaagctgagcgtgctgaccgtgcaggacgtgggcctggtgatgcccggcgccatcatgtgcagcgtgaagcccgacggcgtgccccagctgtgcagaaccgacgagatcggcgagctgtgcgtgtgcgccgtggccaccggcaccagctactacggcctgagcggcatgaccaagaacaccttcgaggtgttccccatgaccagcagcggcgcccccatcagcgagtaccccttcatcagaaccggcctgctgggcttcgtgggccccggcggcctggtgttcgtggtgggcaagatggacggcctgatggtggtgagcggcagaagacacaacgccgacgacatcgtggccaccgccctggccgtggagcccatgaagttcgtgtacagaggcagaatcgccgtgttcagcgtgaccgtgctgcacgacgagagaatcgtgatcgtggccgagcagagacccgacagcaccgaggaggacagcttccagtggatgagcagagtgctgcaggccatcgacagcatccaccaggtgggcgtgtactgcctggccctggtgcccgccaacaccctgcccaagacccccctgggcggcatccacctgagcgagaccaagcagctgttcctggagggcagcctgcacccctgcaacgtgctgatgtgcccccacacctgcgtgaccaacctgcccaagcccagacagaagcagcccgagatcggccccgccagcgtgatggtgggcaacctggtgagcggcaagagaatcgcccaggccagcggcagagacctgggccagatcgaggacaacgaccaggccagaaagttcctgttcctgagcgaggtgctgcagtggagagcccagaccacccccgaccacatcctgtacaccctgctgaactgcagagtgagaagaggcgccggcctgccctggctgctggccagcagaggcctggcctggttcctgggcgccctgctgctgctgagcctgaaccccttcgccagcgtgctgtgggagttcttcctgtgcttcgccatcctgaccgagaccttcgtgcccagagactgcttctag

SEQ ID NO: 79270 - DNA, 1236 bp, Artificial Sequence
  Description of Artificial Sequence: Synthetic coding sequence
atgtggagcggctggtggctgtggcccctggtggccgtgtgcaccgccgacttcttcagagacgaggccgagagaatcatgagagacagccccgtgatcgacggccacaacgacctgccctggcagctgctggacatgttcaacaacagactgcaggacgagagagccaacctgaccaccctggccggcacccacaccaacatccccaagctgagagccggcttcgtgggcggccagttctggagcgtgtacaccccctgcgacacccagaacaaggacgccgtgagaagaaccctggagcagatggacgtggtgcacagaatgtgcagaatgtaccccgagaccttcctgtacgtgaccagcagcgccggcatcagacaggccttcagagagggcaaggtggccagcctgatcggcgtggagggcggccacagcatcgacagcagcctgggcgtgctgagagccctgtaccagctgggcatgagatacctgaccctgacccacagctgcaacaccccctgggccgacaactggctggtggacaccggcgacagcgagccccagagccagggcctgagccccttcggccagagagtggtgaaggagctgaacagactgggcgtgctgatcgacctggcccacgtgagcgtggccaccatgaaggccaccctgcagctgagcagagcccccgtgatcttcagccacagcagcgcctacagcgtgtgcgccagcagaagaaacgtgcccgacgacgtgctgagactggtgaagcagaccgacagcctggtgatggtgaacttctacaacaactacatcagctgcaccaacaaggccaacctgagccaggtggccgaccacctggaccacatcaaggaggtggccggcgccagagccgtgggcttcggcggcgacttcgacggcgtgcccagagtgcccgagggcctggaggacgtgagcaagtaccccgacctgatcgccgagctgctgagaagaaactggaccgaggccgaggtgaagggcgccctggccgacaacctgctgagagtgttcgaggccgtggagcaggccagcaacctgacccaggcccccgaggaggagcccatccccctggaccagctgggcggcagctgcagaacccactacggctacagcagcggcgccagcagcctgcacagacactggggcctgctgctggccagcctggcccccctggtgctgtgcctgagcctgctgtag

SEQ ID NO: 79271 - DNA, 1236 bp, Artificial Sequence; identical to SEQ ID NO: 79270
  Description of Artificial Sequence: Synthetic coding sequence

SEQ ID NO: 79272 - DNA, 1236 bp, Artificial Sequence; identical to SEQ ID NO: 79270
  Description of Artificial Sequence: Synthetic coding sequence

SEQ ID NO: 79273 - DNA, 381 bp, Artificial Sequence
  Description of Artificial Sequence: Synthetic coding sequence
atgcagcccagcggcctggagggccccggcaccttcggcagatggcccctgctgagcctgctgctgctgctgctgctgctgcagcccgtgacctgcgcctacaccacccccggcccccccagagccctgaccaccctgggcgcccccagagcccacaccatgcccggcacctacgcccccagcaccaccctgagcagccccagcacccagggcctgcaggagcaggccagagccctgatgagagacttccccctggtggacggcagcggccagcccatgtgccacgccagacccagaaccggcatgccctgcgccagcccctggagcagactgaccagctacgccgcctgcgtgccccccatcctgagctggagcctgtag

SEQ ID NO: 79274 - DNA, 1200 bp, Artificial Sequence
  Description of Artificial Sequence: Synthetic coding sequence
atgcagcccagcggcctggagggccccggcaccttcggcagatggcccctgctgagcctgctgctgctgctgctgctgctgcagcccgtgacctgcgcctacaccacccccggcccccccagagccctgttctggagcgcctacgtgccctgccagacccaggacagagacgccctgagactgaccctggagcagatcgacctgatcagaagaatgtgcgccagctacagcgagctggagctggtgaccagcgccaaggccctgaacgacacccagaagctggcctgcctgatcggcgtggagggcggccacagcctggacaacagcctgagcatcctgcccaccttctacatgctgggcgtgagatacctgaccctgacccacacctgcaacaccccctgggccgagagcagcgccaagggcgtgcacagcttctacaacaacatcagcggcctgaccgacttcggcgagaaggtggtggccgagatgaacagactgggcatgatggtggacctgagccacgtgagcgacgccgtggccagaagagccctggaggtgagccaggcccccgtgatcttcagccacagcgccgccagaggcgtgtgcaacagcgccagaaacgtgcccgacgacatcctgcagctgctgaagaagaacggcggcgtggtgatggtgagcctgagcatgggcgtgatccagtgcaaccccagcgccaacgtgagcaccgtggccgaccacttcgaccacatcaaggccgtgatcggcagcaagttcatcggcatcggcggcgactacgacggcgccggcaagttcccccagggcctggaggacgtgagcacctaccccgtgctgatcgaggagctgctgagcagaggctggagcgaggaggagctgcagggcgtgctgagaggcaacctgctgagagtgttcagacaggtggagaaggtgcaggaggagaacaagtggcagagccccctggaggacaagttccccgacgagcagctgagcagcagctgccacagcgacctgagcagactgagacagagacagagcctgaccagcggccaggagctgaccgagatccccatccactggaccgccaagctgcccgccaagtggagcgtgagcgagagcagcccccacatggcccccgtgctggccgtggtggccaccttccccgtgctgatcctgtggctgtag

SEQ ID NO: 79275 - DNA, 1461 bp, Artificial Sequence
  Description of Artificial Sequence: Synthetic coding sequence
atgcagcccagcggcctggagggccccggcaccttcggcagatggcccctgctgagcctgctgctgctgctgctgctgctgcagcccgtgacctgcgcctacaccacccccggcccccccagagccctgaccaccctgggcgcccccagagcccacaccatgcccggcacctacgcccccagcaccaccctgagcagccccagcacccagggcctgcaggagcaggccagagccctgatgagagacttccccctggtggacggccacaacgacctgcccctggtgctgagacaggtgtaccagaagggcctgcaggacgtgaacctgagaaacttcagctacggccagaccagcctggacagactgagagacggcctggtgggcgcccagttctggagcgcctacgtgccctgccagacccaggacagagacgccctgagactgaccctggagcagatcgacctgatcagaagaatgtgcgccagctacagcgagctggagctggtgaccagcgccaaggccctgaacgacacccagaagctggcctgcctgatcggcgtggagggcggccacagcctggacaacagcctgagcatcctgcccaccttctacatgctgggcgtgagatacctgaccctgacccacacctgcaacaccccctgggccgagagcagcgccaagggcgtgcacagcttctacaacaacatcagcggcctgaccgacttcggcgagaaggtggtggccgagatgaacagactgggcatgatggtggacctgagccacgtgagcgacgccgtggccagaagagccctggaggtgagccaggcccccgtgatcttcagccacagcgccgccagaggcgtgtgcaacagcgccagaaacgtgcccgacgacatcctgcagctgctgaagaagaacggcggcgtggtgatggtgagcctgagcatgggcgtgatccagtgcaaccccagcgccaacgtgagcaccgtggccgaccacttcgaccacatcaaggccgtgatcggcagcaagttcatcggcatcggcggcgactacgacggcgccggcaagttcccccagggcctggaggacgtgagcacctaccccgtgctgatcgaggagctgctgagcagaggctggagcgaggaggagctgcagggcgtgctgagaggcaacctgctgagagtgttcagacaggtggagaaggtgcaggaggagaacaagtggcagagccccctggaggacaagttccccgacgagcagctgagcagcagctgccacagcgacctgagcagactgagacagagacagagcctgaccagcggccaggagctgaccgagatccccatccactggaccgccaagctgcccgccaagtggagcgtgagcgagagcagcccccacatggcccccgtgctggccgtggtggccaccttccccgtgctgatcctgtggctgtag

SEQ ID NO: 79276 - DNA, 1461 bp, Artificial Sequence; identical to SEQ ID NO: 79275
  Description of Artificial Sequence: Synthetic coding sequence

SEQ ID NO: 79277 - DNA, 1542 bp, Artificial Sequence
  Description of Artificial Sequence: Synthetic coding sequence
atgatcagaacccccctgagcgccagcgcccacagactgctgctgcccggcagcagaggcagaccccccagaaacatgcagcccaccggcagagagggcagcagagccctgagcagaagatacctgagaagactgctgctgctgctgctgctgctgctgctgagacagcccgtgaccagagccgagaccacccccggcgcccccagagccctgagcaccctgggcagccccagcctgttcaccacccccggcgtgcccagcgccctgaccacccccggcctgaccacccccggcacccccaagaccctggacctgagaggcagagcccaggccctgatgagaagcttccccctggtggacggccacaacgacctgccccaggtgctgagacagagatacaagaacgtgctgcaggacgtgaacctgagaaacttcagccacggccagaccagcctggacagactgagagacggcctggtgggcgcccagttctggagcgccagcgtgagctgccagagccaggaccagaccgccgtgagactggccctggagcagatcgacctgatccacagaatgtgcgccagctacagcgagctggagctggtgaccagcgccgagggcctgaacagcagccagaagctggcctgcctgatcggcgtggagggcggccacagcctggacagcagcctgagcgtgctgagaagcttctacgtgctgggcgtgagatacctgaccctgaccttcacctgcagcaccccctgggccgagagcagcaccaagttcagacaccacatgtacaccaacgtgagcggcctgaccagcttcggcgagaaggtggtggaggagctgaacagactgggcatgatgatcgacctgagctacgccagcgacaccctgatcagaagagtgctggaggtgagccaggcccccgtgatcttcagccacagcgccgccagagccgtgtgcgacaacctgctgaacgtgcccgacgacatcctgcagctgctgaagaagaacggcggcatcgtgatggtgaccctgagcatgggcgtgctgcagtgcaacctgctggccaacgtgagcaccgtggccgaccacttcgaccacatcagagccgtgatcggcagcgagttcatcggcatcggcggcaactacgacggcaccggcagattcccccagggcctggaggacgtgagcacctaccccgtgctgatcgaggagctgctgagcagaagctggagcgaggaggagctgcagggcgtgctgagaggcaacctgctgagagtgttcagacaggtggagaaggtgagagaggagagcagagcccagagccccgtggaggccgagttcccctacggccagctgagcaccagctgccacagccacctggtgccccagaacggccaccaggccacccacctggaggtgaccaagcagcccaccaacagagtgccctggagaagcagcaacgccagcccctacctggtgcccggcctggtggccgccgccaccatccccaccttcacccagtggctgtgctag

SEQ ID NO: 79278 - DNA, 2370 bp, Artificial Sequence
  Description of Artificial Sequence: Synthetic coding sequence
atgagaaaggtggagagcagaggcgagggcggcagagaggagctgggcagcaacagccccccccagagaaactggaagggcatcgccatcgccctgctggtgatcctggtggtgtgcagcctgatcaccatgagcgtgatcctgctgacccccgacgagctgaccaacagcagcgagaccagactgagcctggaggacctgttcagaaaggacttcgtgctgcacgaccccgaggccagatggatcaacgacaccgacgtggtgtacaagagcgagaacggccacgtgatcaagctgaacatcgagaccaacgccaccaccctgctgctggagaacaccaccttcgtgaccttcaaggccagcagacacagcgtgagccccgacctgaagtacgtgctgctggcctacgacgtgaagcagatcttccactacagctacaccgccagctacgtgatctacaacatccacaccagagaggtgtgggagctgaacccccccgaggtggaggacagcgtgctgcagtacgccgcctggggcgtgcagggccagcagctgatctacatcttcgagaacaacatctactaccagcccgacatcaagagcagcagcctgagactgaccagcagcggcaaggaggagatcatcttcaacggcatcgccgactggctgtacgaggaggagctgctgcacagccacatcgcccactggtggagccccgacggcgagagactggccttcctgatgatcaacgacagcctggtgcccaccatggtgatccccagattcaccggcgccctgtaccccaagggcaagcagtacccctaccccaaggccggccaggtgaaccccaccatcaagctgtacgtggtgaacctgtacggccccacccacaccctggagctgatgccccccgacagcttcaagagcagagagtactacatcaccatggtgaagtgggtgagcaacaccaagaccgtggtgagatggctgaacagagcccagaacatcagcatcctgaccgtgtgcgagaccaccaccggcgcctgcagcaagaagtacgagatgaccagcgacacctggctgagccagcagaacgaggagcccgtgttcagcagagacggcagcaagttcttcatgaccgtgcccgtgaagcagggcggcagaggcgagttccaccacgtggccatgttcctgatccagagcaagagcgagcagatcaccgtgagacacctgaccagcggcaactgggaggtgatcaagatcctggcctacgacgagaccacccagaagatctacttcctgagcaccgagagcagccccagaggcagacagctgtacagcgccagcaccgagggcctgctgaacagacagtgcatcagctgcaacttcatgaaggagcagtgcacctacttcgacgccagcttcagccccatgaaccagcacttcctgctgttctgcgagggccccagagtgcccgtggtgagcctgcacagcaccgacaaccccgccaagtacttcatcctggagagcaacagcatgctgaaggaggccatcctgaagaagaagatcggcaagcccgagatcaagatcctgcacatcgacgactacgagctgcccctgcagctgagcctgcccaaggacttcatggacagaaaccagtacgccctgctgctgatcatggacgaggagcccggcggccagctggtgaccgacaagttccacatcgactgggacagcgtgctgatcgacatggacaacgtgatcgtggccagattcgacggcagaggcagcggcttccagggcctgaagatcctgcaggagatccacagaagactgggcagcgtggaggtgaaggaccagatcaccgccgtgaagttcctgctgaagctgccctacatcgacagcaagagactgagcatcttcggcaagggctacggcggctacatcgccagcatgatcctgaagagcgacgagaagctgttcaagtgcggcagcgtggtggcccccatcaccgacctgaagctgtacgccagcgccttcagcgagagatacctgggcatgcccagcaaggaggagagcacctaccaggccgccagcgtgctgcacaacgtgcacggcctgaaggaggagaacatcctgatcatccacggcaccgccgacaccaaggtgcacttccagcacagcgccgagctgatcaagcacctgatcaaggccggcgtgaactacaccatgcaggtgtaccccgacgagggccacaacgtgagcgagaagagcaagtaccacctgtacagcaccatcctgaagttcttcagcgactgcctgaaggaggagatcagcgtgctgccccaggagcccgaggaggacgagtag

SEQ ID NO: 79279 - DNA, 2403 bp, Artificial Sequence
  Description of Artificial Sequence: Synthetic coding sequence
atgaccgccgccaagcaggagccccagcccacccccggcgccagagccagccaggcccagcccgccgaccaggagctgggcagcaacagccccccccagagaaactggaagggcatcgccatcgccctgctggtgatcctggtggtgtgcagcctgatcaccatgagcgtgatcctgctgacccccgacgagctgaccaacagcagcgagaccagactgagcctggaggacctgttcagaaaggacttcgtgctgcacgaccccgaggccagatggatcaacgacaccgacgtggtgtacaagagcgagaacggccacgtgatcaagctgaacatcgagaccaacgccaccaccctgctgctggagaacaccaccttcgtgaccttcaaggccagcagacacagcgtgagccccgacctgaagtacgtgctgctggcctacgacgtgaagcagatcttccactacagctacaccgccagctacgtgatctacaacatccacaccagagaggtgtgggagctgaacccccccgaggtggaggacagcgtgctgcagtacgccgcctggggcgtgcagggccagcagctgatctacatcttcgagaacaacatctactaccagcccgacatcaagagcagcagcctgagactgaccagcagcggcaaggaggagatcatcttcaacggcatcgccgactggctgtacgaggaggagctgctgcacagccacatcgcccactggtggagccccgacggcgagagactggccttcctgatgatcaacgacagcctggtgcccaccatggtgatccccagattcaccggcgccctgtaccccaagggcaagcagtacccctaccccaaggccggccaggtgaaccccaccatcaagctgtacgtggtgaacctgtacggccccacccacaccctggagctgatgccccccgacagcttcaagagcagagagtactacatcaccatggtgaagtgggtgagcaacaccaagaccgtggtgagatggctgaacagagcccagaacatcagcatcctgaccgtgtgcgagaccaccaccggcgcctgcagcaagaagtacgagatgaccagcgacacctggctgagccagcagaacgaggagcccgtgttcagcagagacggcagcaagttcttcatgaccgtgcccgtgaagcagggcggcagaggcgagttccaccacgtggccatgttcctgatccagagcaagagcgagcagatcaccgtgagacacctgaccagcggcaactgggaggtgatcaagatcctggcctacgacgagaccacccagaagatctacttcctgagcaccgagagcagccccagaggcagacagctgtacagcgccagcaccgagggcctgctgaacagacagtgcatcagctgcaacttcatgaaggagcagtgcacctacttcgacgccagcttcagccccatgaaccagcacttcctgctgttctgcgagggccccagagtgcccgtggtgagcctgcacagcaccgacaaccccgccaagtacttcatcctggagagcaacagcatgctgaaggaggccatcctgaagaagaagatcggcaagcccgagatcaagatcctgcacatcgacgactacgagctgcccctgcagctgagcctgcccaaggacttcatggacagaaaccagtacgccctgctgctgatcatggacgaggagcccggcggccagctggtgaccgacaagttccacatcgactgggacagcgtgctgatcgacatggacaacgtgatcgtggccagattcgacggcagaggcagcggcttccagggcctgaagatcctgcaggagatccacagaagactgggcagcgtggaggtgaaggaccagatcaccgccgtgaagttcctgctgaagctgccctacatcgacagcaagagactgagcatcttcggcaagggctacggcggctacatcgccagcatgatcctgaagagcgacgagaagctgttcaagtgcggcagcgtggtggcccccatcaccgacctgaagctgtacgccagcgccttcagcgagagatacctgggcatgcccagcaaggaggagagcacctaccaggccgccagcgtgctgcacaacgtgcacggcctgaaggaggagaacatcctgatcatccacggcaccgccgacaccaaggtgcacttccagcacagcgccgagctgatcaagcacctgatcaaggccggcgtgaactacaccatgcaggtgtaccccgacgagggccacaacgtgagcgagaagagcaagtaccacctgtacagcaccatcctgaagttcttcagcgactgcctgaaggaggagatcagcgtgctgccccaggagcccgaggaggacgagtag

SEQ ID NO: 79280 - DNA, 2391 bp, Artificial Sequence
  Description of Artificial Sequence: Synthetic coding sequence
atgaaccagaccgccagcgtgagccaccacatcaagtgccagcccagcaagaccatcaaggagctgggcagcaacagccccccccagagaaactggaagggcatcgccatcgccctgctggtgatcctggtggtgtgcagcctgatcaccatgagcgtgatcctgctgacccccgacgagctgaccaacagcagcgagaccagactgagcctggaggacctgttcagaaaggacttcgtgctgcacgaccccgaggccagatggatcaacgacaccgacgtggtgtacaagagcgagaacggccacgtgatcaagctgaacatcgagaccaacgccaccaccctgctgctggagaacaccaccttcgtgaccttcaaggccagcagacacagcgtgagccccgacctgaagtacgtgctgctggcctacgacgtgaagcagatcttccactacagctacaccgccagctacgtgatctacaacatccacaccagagaggtgtgggagctgaacccccccgaggtggaggacagcgtgctgcagtacgccgcctggggcgtgcagggccagcagctgatctacatcttcgagaacaacatctactaccagcccgacatcaagagcagcagcctgagactgaccagcagcggcaaggaggagatcatcttcaacggcatcgccgactggctgtacgaggaggagctgctgcacagccacatcgcccactggtggagccccgacggcgagagactggccttcctgatgatcaacgacagcctggtgcccaccatggtgatccccagattcaccggcgccctgtaccccaagggcaagcagtacccctaccccaaggccggccaggtgaaccccaccatcaagctgtacgtggtgaacctgtacggccccacccacaccctggagctgatgccccccgacagcttcaagagcagagagtactacatcaccatggtgaagtgggtgagcaacaccaagaccgtggtgagatggctgaacagagcccagaacatcagcatcctgaccgtgtgcgagaccaccaccggcgcctgcagcaagaagtacgagatgaccagcgacacctggctgagccagcagaacgaggagcccgtgttcagcagagacggcagcaagttcttcatgaccgtgcccgtgaagcagggcggcagaggcgagttccaccacgtggccatgttcctgatccagagcaagagcgagcagatcaccgtgagacacctgaccagcggcaactgggaggtgatcaagatcctggcctacgacgagaccacccagaagatctacttcctgagcaccgagagcagccccagaggcagacagctgtacagcgccagcaccgagggcctgctgaacagacagtgcatcagctgcaacttcatgaaggagcagtgcacctacttcgacgccagcttcagccccatgaaccagcacttcctgctgttctgcgagggccccagagtgcccgtggtgagcctgcacagcaccgacaaccccgccaagtacttcatcctggagagcaacagcatgctgaaggaggccatcctgaagaagaagatcggcaagcccgagatcaagatcctgcacatcgacgactacgagctgcccctgcagctgagcctgcccaaggacttcatggacagaaaccagtacgccctgctgctgatcatggacgaggagcccggcggccagctggtgaccgacaagttccacatcgactgggacagcgtgctgatcgacatggacaacgtgatcgtggccagattcgacggcagaggcagcggcttccagggcctgaagatcctgcaggagatccacagaagactgggcagcgtggaggtgaaggaccagatcaccgccgtgaagttcctgctgaagctgccctacatcgacagcaagagactgagcatcttcggcaagggctacggcggctacatcgccagcatgatcctgaagagcgacgagaagctgttcaagtgcggcagcgtggtggcccccatcaccgacctgaagctgtacgccagcgccttcagcgagagatacctgggcatgcccagcaaggaggagagcacctaccaggccgccagcgtgctgcacaacgtgcacggcctgaaggaggagaacatcctgatcatccacggcaccgccgacaccaaggtgcacttccagcacagcgccgagctgatcaagcacctgatcaaggccggcgtgaactacaccatgcaggtgtaccccgacgagggccacaacgtgagcgagaagagcaagtaccacctgtacagcaccatcctgaagttcttcagcgactgcctgaaggaggagatcagcgtgctgccccaggagcccgaggaggacgagtag

SEQ ID NO: 79281 - DNA, 294 bp, Artificial Sequence
  Description of Artificial Sequence: Synthetic coding sequence
atgagcgtgatcctgctgacccccgacgagctgaccaacagcagcgagaccagactgagcctggaggacctgttcagaaaggacttcgtgctgcacgaccccgaggccagatggatcaacgacaccgacgtggtgtacaagagcgagaacggccacgtgatcaagctgaacatcgagaccaacgccaccaccctgctgctggagaacaccaccttcgtgaccttcaaggccagcagacacagcgtgagccccgacctgaagtacgtgctgctggcctacgacgtgaagcagtag

SEQ ID NO: 79282 - DNA, 1803 bp, Artificial Sequence
  Description of Artificial Sequence: Synthetic coding sequence
ctgagcatcctgatcctgaccagcaacgagctgaccaacagcagcgagaccagactgagcctggaggacctgttcagaaaggacttcgtgctgcacgaccccgaggccagatggatcaacgacaccgacgtggtgtacaagagcgagaacggccacgtgatcaagctgaacatcgagaccaacgccaccaccctgctgctggagaacaccaccttcgtgaccttcaaggccagcagacacagcgtgagccccgacctgaagtacgtgctgctggcctacgacgtgaagcagatcttccactacagctacaccgccagctacgtgatctacaacatccacaccagagaggtgtgggagctgaacccccccgaggtggaggacagcgtgctgcagtacgccgcctggggcgtgcagggccagcagctgatctacatcttcgagaacaacatctactaccagcccgacatcaagagcagcagcctgagactgaccagcagcggcaaggaggagatcatcttcaacggcatcgccgactggctgtacgaggaggagctgctgcacagccacatcgcccactggtggagccccgacggcgagagactggccttcctgatgatcaacgacagcctggtgcccaccatggtgatccccagattcaccggcgccctgtaccccaagggcaagcagtacccctaccccaaggccggccaggtgaaccccaccatcaagctgtacgtggtgaacctgtacggccccacccacaccctggagctgatgccccccgacagcttcaagagcagagagtactacatcaccatggtgaagtgggtgagcaacaccaagaccgtggtgagatggctgaacagagcccagaacatcagcatcctgaccgtgtgcgagaccaccaccggcgcctgcagcaagaagtacgagatgaccagcgacacctggctgagccagcagaacgaggagcccgtgttcagcagagacggcagcaagttcttcatgaccgtgcccgtgaagcagggcggcagaggcgagttccaccacgtggccatgttcctgatccagagcaagagcgagcagatcaccgtgagacacctgaccagcggcaactgggaggtgatcaagatcctggcctacgacgagaccacccagaagatctacttcctgagcaccgagagcagccccagaggcagacagctgtacagcgccagcaccgagggcctgctgaacagacagtgcatcagctgcaacttcatgaaggagcagtgcacctacttcgacgccagcttcagccccatgaaccagcacttcctgctgttctgcgagggccccagagtgcccgtggtgagcctgcacagcaccgacaaccccgccaagtacttcatcctggagagcaacagcatgctgaaggaggccatcctgaagaagaagatcggcaagcccgagatcaagatcctgcacatcgacgactacgagctgcccctgcagctgagcctgcccaaggacttcatggacagaaaccagtacgccctgctgctgatcatggacgaggagcccggcggccagctggtgaccgacaagttccacatcgactgggacagcgtgctgatcgacatggacaacgtgatcgtggccagattcgacggcagaggcagcggcttccagggcctgaagatcctgcaggagatccacagaagactgggcagcgtggaggtgaaggaccagatcaccgccgtgaagttcctgctgaagctgccctacatcgacagcaagagactgagcatcttcggcaagtag

SEQ ID NO: 79283 - DNA, 2241 bp, Artificial Sequence
  Description of Artificial Sequence: Synthetic coding sequence
atgagcgtgatcctgctgacccccgacgagctgaccaacagcagcgagaccagactgagcctggaggacctgttcagaaaggacttcgtgctgcacgaccccgaggccagatggatcaacgacaccgacgtggtgtacaagagcgagaacggccacgtgatcaagctgaacatcgagaccaacgccaccaccctgctgctggagaacaccaccttcgtgaccttcaaggccagcagacacagcgtgagccccgacctgaagtacgtgctgctggcctacgacgtgaagcagatcttccactacagctacaccgccagctacgtgatctacaacatccacaccagagaggtgtgggagctgaacccccccgaggtggaggacagcgtgctgcagtacgccgcctggggcgtgcagggccagcagctgatctacatcttcgagaacaacatctactaccagcccgacatcaagagcagcagcctgagactgaccagcagcggcaaggaggagatcatcttcaacggcatcgccgactggctgtacgaggaggagctgctgcacagccacatcgcccactggtggagccccgacggcgagagactggccttcctgatgatcaacgacagcctggtgcccaccatggtgatccccagattcaccggcgccctgtaccccaagggcaagcagtacccctaccccaaggccggccaggtgaaccccaccatcaagctgtacgtggtgaacctgtacggccccacccacaccctggagctgatgccccccgacagcttcaagagcagagagtactacatcaccatggtgaagtgggtgagcaacaccaagaccgtggtgagatggctgaacagagcccagaacatcagcatcctgaccgtgtgcgagaccaccaccggcgcctgcagcaagaagtacgagatgaccagcgacacctggctgagccagcagaacgaggagcccgtgttcagcagagacggcagcaagttcttcatgaccgtgcccgtgaagcagggcggcagaggcgagttccaccacgtggccatgttcctgatccagagcaagagcgagcagatcaccgtgagacacctgaccagcggcaactgggaggtgatcaagatcctggcctacgacgagaccacccagaagatctacttcctgagcaccgagagcagccccagaggcagacagctgtacagcgccagcaccgagggcctgctgaacagacagtgcatcagctgcaacttcatgaaggagcagtgcacctacttcgacgccagcttcagccccatgaaccagcacttcctgctgttctgcgagggccccagagtgcccgtggtgagcctgcacagcaccgacaaccccgccaagtacttcatcctggagagcaacagcatgctgaaggaggccatcctgaagaagaagatcggcaagcccgagatcaagatcctgcacatcgacgactacgagctgcccctgcagctgagcctgcccaaggacttcatggacagaaaccagtacgccctgctgctgatcatggacgaggagcccggcggccagctggtgaccgacaagttccacatcgactgggacagcgtgctgatcgacatggacaacgtgatcgtggccagattcgacggcagaggcagcggcttccagggcctgaagatcctgcaggagatccacagaagactgggcagcgtggaggtgaaggaccagatcaccgccgtgaagttcctgctgaagctgccctacatcgacagcaagagactgagcatcttcggcaagggctacggcggctacatcgccagcatgatcctgaagagcgacgagaagctgttcaagtgcggcagcgtggtggcccccatcaccgacctgaagctgtacgccagcgccttcagcgagagatacctgggcatgcccagcaaggaggagagcacctaccaggccgccagcgtgctgcacaacgtgcacggcctgaaggaggagaacatcctgatcatccacggcaccgccgacaccaaggtgcacttccagcacagcgccgagctgatcaagcacctgatcaaggccggcgtgaactacaccatgcaggtgtaccccgacgagggccacaacgtgagcgagaagagcaagtaccacctgtacagcaccatcctgaagttcttcagcgactgcctgaaggaggagatcagcgtgctgccccaggagcccgaggaggacgagtag

SEQ ID NO: 79284 - DNA, 954 bp, Artificial Sequence
  Description of Artificial Sequence: Synthetic coding sequence
atggccgacacccagtacatcctgcccaacgacatcggcgtgagcagcctggactgcagagaggccttcagactgctgagccccaccgagagactgtacgcctaccacctgagcagagccgcctggtacggcggcctggccgtgctgctgcagaccagccccgaggccccctacatctacgccctgctgagcagactgttcagagcccaggaccccgaccagctgagacagcacgccctggccgagggcctgaccgaggaggagtaccaggccttcctggtgtacgccgccggcgtgtacagcaacatgggcaactacaagagcttcggcgacaccaagttcgtgcccaacctgcccaaggagaagctggagagagtgatcctgggcagcgaggccgcccagcagcaccccgaggaggtgagaggcctgtggcagacctgcggcgagctgatgttcagcctggagcccagactgagacacctgggcctgggcaaggagggcatcaccacctacttcagcggcaactgcaccatggaggacgccagagtgagactggacagaagcaagatcagaagcgtgggcaagcccgccctggagagattcctgagaagactgcaggtgctgaagagcaccggcgacgtggccggcggcagagccctgtacgagggctacgccaccgtgaccgacgccccccccgagtgcttcctgaccctgagagacaccgtgctgctgagaaaggagagcagaaagctgatcgtgcagcccaacaccagactggagggcagcgacgtgcagctgctggagtacgaggccagcgccgccggcctgatcagaagcttcagcgagagattccccgaggacggccccgagctggaggagatcctgacccagctggccaccgccgacgccagattctggaagggccccagcgaggcccccagcggccaggcctag

SEQ ID NO: 79285 - DNA, 2214 bp, Artificial Sequence
  Description of Artificial Sequence: Synthetic coding sequence
atggccgacacccagtacatcctgcccaacgacatcggcgtgagcagcctggactgcagagaggccttcagactgctgagccccaccgagagactgtacgcctaccacctgagcagagccgcctggtacggcggcctggccgtgctgctgcagaccagccccgaggccccctacatctacgccctgctgagcagactgttcagagcccaggaccccgaccagctgagacagcacgccctggccgagggcctgaccgaggaggagtaccaggccttcctggtgtacgccgccggcgtgtacagcaacatgggcaactacaagagcttcggcgacaccaagttcgtgcccaacctgcccaaggagaagctggagagagtgatcctgggcagcgaggccgcccagcagcaccccgaggaggtgagaggcctgtggcagacctgcggcgagctgatgttcagcctggagcccagactgagacacctgggcctgggcaaggagggcatcaccacctacttcagcggcaactgcaccatggaggacgccaagctggcccaggacttcctggacagccagaacctgagcgcctacaacaccagactgttcaaggaggtggacggcgagggcaagccctactacgaggtgagactggccagcgtgctgggcagcgagcccagcctggacagcgaggtgaccagcaagctgaagagctacgagttcagaggcagccccttccaggtgaccagaggcgactacgcccccatcctgcagaaggtggtggagcagctggagaaggccaaggcctacgccgccaacagccaccagggccagatgctggcccagtacatcgagagcttcacccagggcagcatcgaggcccacaagagaggcagcagattctggatccaggacaagggccccatcgtggagagctacatcggcttcatcgagagctacagagaccccttcggcagcagaggcgagttcgagggcttcgtggccgtggtgaacaaggccatgagcgccaagttcgagagactggtggccagcgccgagcagctgctgaaggagctgccctggccccccaccttcgagaaggacaagttcctgacccccgacttcaccagcctggacgtgctgaccttcgccggcagcggcatccccgccggcatcaacatccccaactacgacgacctgagacagaccgagggcttcaagaacgtgagcctgggcaacgtgctggccgtggcctacgccacccagagagagaagctgaccttcctggaggaggacgacaaggacctgtacatcctgtggaagggccccagcttcgacgtgcaggtgggcctgcacgagctgctgggccacggcagcggcaagctgttcgtgcaggacgagaagggcgccttcaacttcgaccaggagaccgtgatcaaccccgagaccggcgagcagatccagagctggtacagaagcggcgagacctgggacagcaagttcagcaccatcgccagcagctacgaggagtgcagagccgagagcgtgggcctgtacctgtgcctgcacccccaggtgctggagatcttcggcttcgagggcgccgacgccgaggacgtgatctacgtgaactggctgaacatggtgagagccggcctgctggccctggagttctacacccccgaggccttcaactggagacaggcccacatgcaggccagattcgtgatcctgagagtgctgctggaggccggcgagggcctggtgaccatcacccccaccaccggcagcgacggcagacccgacgccagagtgagactggacagaagcaagatcagaagcgtgggcaagcccgccctggagagattcctgagaagactgcaggtgctgaagagcaccggcgacgtggccggcggcagagccctgtacgagggctacgccaccgtgaccgacgccccccccgagtgcttcctgaccctgagagacaccgtgctgctgagaaaggagagcagaaagctgatcgtgcagcccaacaccagactggagggcagcgacgtgcagctgctggagtacgaggccagcgccgccggcctgatcagaagcttcagcgagagattccccgaggacggccccgagctggaggagatcctgacccagctggccaccgccgacgccagattctggaagggccccagcgaggcccccagcggccaggcctag

SEQ ID NO: 79286 - DNA, 2214 bp, Artificial Sequence; identical to SEQ ID NO: 79285
  Description of Artificial Sequence: Synthetic coding sequence

SEQ ID NO: 79287 - DNA, 273 bp, Artificial Sequence
  Description of Artificial Sequence: Synthetic coding sequence
atggccgacacccagtacatcctgcccaacgacatcggcgtgagcagcctggactgcagagaggccttcagactgctgagccccaccgagagactgtacgcctaccacctgagcagagccgcctggtacggcggcctggccgtgctgctgcagaccagccccgaggccccctacatctacgccctgctgagcagactgttcagagcccaggaccccgaccagctgagacagcacgccctggccgagggcctgaccgaggaggagtaccagtag

SEQ ID NO: 79288 - DNA, 606 bp, Artificial Sequence
  Description of Artificial Sequence: Synthetic coding sequence
atggccgacacccagtacatcctgcccaacgacatcggcgtgagcagcctggactgcagagaggccttcagactgctgagccccaccgagagactgtacgcctaccacctgagcagagccgcctggtacggcggcctggccgtgctgctgcagaccagccccgaggccccctacatctacgccctgctgagcagactgttcagagcccaggaccccgaccagctgagacagcacgccctggccgagggcctgaccgaggaggagtaccaggccttcctggtgtacgccgccggcgtgtacagcaacatgggcaactacaagagcttcggcgacaccaagttcgtgcccaacctgcccaaggagaagctggagagagtgatcctgggcagcgaggccgcccagcagcaccccgaggaggtgagaggcctgtggcagacctgcggcgagctgatgttcagcctggagcccagactgagacacctgggcctgggcaaggagggcatcaccacctacttcagcggcaactgcaccatggaggacgccaagctggcccaggacttcctggacagccagaacctgagcgcctacaacaccagactgttctag

SEQ ID NO: 79289 - DNA, 2274 bp, Artificial Sequence
  Description of Artificial Sequence: Synthetic coding sequence
atgggcgagcccgaggccggcagcgagttcgccaacggcgccgccgccgccgccggccccatggccgacacccagtacatcctgcccaacgacatcggcgtgagcagcctggactgcagagaggccttcagactgctgagccccaccgagagactgtacgcctaccacctgagcagagccgcctggtacggcggcctggccgtgctgctgcagaccagccccgaggccccctacatctacgccctgctgagcagactgttcagagcccaggaccccgaccagctgagacagcacgccctggccgagggcctgaccgaggaggagtaccaggccttcctggtgtacgccgccggcgtgtacagcaacatgggcaactacaagagcttcggcgacaccaagttcgtgcccaacctgcccaaggagaagctggagagagtgatcctgggcagcgaggccgcccagcagcaccccgaggaggtgagaggcctgtggcagacctgcggcgagctgatgttcagcctggagcccagactgagacacctgggcctgggcaaggagggcatcaccacctacttcagcggcaactgcaccatggaggacgccaagctggcccaggacttcctggacagccagaacctgagcgcctacaacaccagactgttcaaggaggtggacggcgagggcaagccctactacgaggtgagactggccagcgtgctgggcagcgagcccagcctggacagcgaggtgaccagcaagctgaagagctacgagttcagaggcagccccttccaggtgaccagaggcgactacgcccccatcctgcagaaggtggtggagcagctggagaaggccaaggcctacgccgccaacagccaccagggccagatgctggcccagtacatcgagagcttcacccagggcagcatcgaggcccacaagagaggcagcagattctggatccaggacaagggccccatcgtggagagctacatcggcttcatcgagagctacagagaccccttcggcagcagaggcgagttcgagggcttcgtggccgtggtgaacaaggccatgagcgccaagttcgagagactggtggccagcgccgagcagctgctgaaggagctgccctggccccccaccttcgagaaggacaagttcctgacccccgacttcaccagcctggacgtgctgaccttcgccggcagcggcatccccgccggcatcaacatccccaactacgacgacctgagacagaccgagggcttcaagaacgtgagcctgggcaacgtgctggccgtggcctacgccacccagagagagaagctgaccttcctggaggaggacgacaaggacctgtacatcctgtggaagggccccagcttcgacgtgcaggtgggcctgcacgagctgctgggccacggcagcggcaagctgttcgtgcaggacgagaagggcgccttcaacttcgaccaggagaccgtgatcaaccccgagaccggcgagcagatccagagctggtacagaagcggcgagacctgggacagcaagttcagcaccatcgccagcagctacgaggagtgcagagccgagagcgtgggcctgtacctgtgcctgcacccccaggtgctggagatcttcggcttcgagggcgccgacgccgaggacgtgatctacgtgaactggctgaacatggtgagagccggcctgctggccctggagttctacacccccgaggccttcaactggagacaggcccacatgcaggccagattcgtgatcctgagagtgctgctggaggccggcgagggcctggtgaccatcacccccaccaccggcagcgacggcagacccgacgccagagtgagactggacagaagcaagatcagaagcgtgggcaagcccgccctggagagattcctgagaagactgcaggtgctgaagagcaccggcgacgtggccggcggcagagccctgtacgagggctacgccaccgtgaccgacgccccccccgagtgcttcctgaccctgagagacaccgtgctgctgagaaaggagagcagaaagctgatcgtgcagcccaacaccagactggagggcagcgacgtgcagctgctggagtacgaggccagcgccgccggcctgatcagaagcttcagcgagagattccccgaggacggccccgagctggaggagatcctgacccagctggccaccgccgacgccagattctggaagggccccagcgaggcccccagcggccaggcctag

SEQ ID NO: 79290 - DNA, 2271 bp, Artificial Sequence
  Description of Artificial Sequence: Synthetic coding sequence
atgggcgagcccgaggccggcagcgagttcgccaacggcgccgccgccgccggccccatggccgacacccagtacatcctgcccaacgacatcggcgtgagcagcctggactgcagagaggccttcagactgctgagccccaccgagagactgtacgcctaccacctgagcagagccgcctggtacggcggcctggccgtgctgctgcagaccagccccgaggccccctacatctacgccctgctgagcagactgttcagagcccaggaccccgaccagctgagacagcacgccctggccgagggcctgaccgaggaggagtaccaggccttcctggtgtacgccgccggcgtgtacagcaacatgggcaactacaagagcttcggcgacaccaagttcgtgcccaacctgcccaaggagaagctggagagagtgatcctgggcagcgaggccgcccagcagcaccccgaggaggtgagaggcctgtggcagacctgcggcgagctgatgttcagcctggagcccagactgagacacctgggcctgggcaaggagggcatcaccacctacttcagcggcaactgcaccatggaggacgccaagctggcccaggacttcctggacagccagaacctgagcgcctacaacaccagactgttcaaggaggtggacggcgagggcaagccctactacgaggtgagactggccagcgtgctgggcagcgagcccagcctggacagcgaggtgaccagcaagctgaagagctacgagttcagaggcagccccttccaggtgaccagaggcgactacgcccccatcctgcagaaggtggtggagcagctggagaaggccaaggcctacgccgccaacagccaccagggccagatgctggcccagtacatcgagagcttcacccagggcagcatcgaggcccacaagagaggcagcagattctggatccaggacaagggccccatcgtggagagctacatcggcttcatcgagagctacagagaccccttcggcagcagaggcgagttcgagggcttcgtggccgtggtgaacaaggccatgagcgccaagttcgagagactggtggccagcgccgagcagctgctgaaggagctgccctggccccccaccttcgagaaggacaagttcctgacccccgacttcaccagcctggacgtgctgaccttcgccggcagcggcatccccgccggcatcaacatccccaactacgacgacctgagacagaccgagggcttcaagaacgtgagcctgggcaacgtgctggccgtggcctacgccacccagagagagaagctgaccttcctggaggaggacgacaaggacctgtacatcctgtggaagggccccagcttcgacgtgcaggtgggcctgcacgagctgctgggccacggcagcggcaagctgttcgtgcaggacgagaagggcgccttcaacttcgaccaggagaccgtgatcaaccccgagaccggcgagcagatccagagctggtacagaagcggcgagacctgggacagcaagttcagcaccatcgccagcagctacgaggagtgcagagccgagagcgtgggcctgtacctgtgcctgcacccccaggtgctggagatcttcggcttcgagggcgccgacgccgaggacgtgatctacgtgaactggctgaacatggtgagagccggcctgctggccctggagttctacacccccgaggccttcaactggagacaggcccacatgcaggccagattcgtgatcctgagagtgctgctggaggccggcgagggcctggtgaccatcacccccaccaccggcagcgacggcagacccgacgccagagtgagactggacagaagcaagatcagaagcgtgggcaagcccgccctggagagattcctgagaagactgcaggtgctgaagagcaccggcgacgtggccggcggcagagccctgtacgagggctacgccaccgtgaccgacgccccccccgagtgcttcctgaccctgagagacaccgtgctgctgagaaaggagagcagaaagctgatcgtgcagcccaacaccagactggagggcagcgacgtgcagctgctggagtacgaggccagcgccgccggcctgatcagaagcttcagcgagagattccccgaggacggccccgagctggaggagatcctgacccagctggccaccgccgacgccagattctggaagggccccagcgaggcccccagcggccaggcctag

SEQ ID NO: 79291 - DNA, 2214 bp, Artificial Sequence; identical to SEQ ID NO: 79285
  Description of Artificial Sequence: Synthetic coding sequence

SEQ ID NO: 79292 - DNA, 1908 bp, Artificial Sequence
  Description of Artificial Sequence: Synthetic coding sequence
atgggcaactacaagagcttcggcgacaccaagttcgtgcccaacctgcccaaggagaagctggagagagtgatcctgggcagcgaggccgcccagcagcaccccgaggaggtgagaggcctgtggcagacctgcggcgagctgatgttcagcctggagcccagactgagacacctgggcctgggcaaggagggcatcaccacctacttcagcggcaactgcaccatggaggacgccaagctggcccaggacttcctggacagccagaacctgagcgcctacaacaccagactgttcaaggaggtggacggcgagggcaagccctactacgaggtgagactggccagcgtgctgggcagcgagcccagcctggacagcgaggtgaccagcaagctgaagagctacgagttcagaggcagccccttccaggtgaccagaggcgactacgcccccatcctgcagaaggtggtggagcagctggagaaggccaaggcctacgccgccaacagccaccagggccagatgctggcccagtacatcgagagcttcacccagggcagcatcgaggcccacaagagaggcagcagattctggatccaggacaagggccccatcgtggagagctacatcggcttcatcgagagctacagagaccccttcggcagcagaggcgagttcgagggcttcgtggccgtggtgaacaaggccatgagcgccaagttcgagagactggtggccagcgccgagcagctgctgaaggagctgccctggccccccaccttcgagaaggacaagttcctgacccccgacttcaccagcctggacgtgctgaccttcgccggcagcggcatccccgccggcatcaacatccccaactacgacgacctgagacagaccgagggcttcaagaacgtgagcctgggcaacgtgctggccgtggcctacgccacccagagagagaagctgaccttcctggaggaggacgacaaggacctgtacatcctgtggaagggccccagcttcgacgtgcaggtgggcctgcacgagctgctgggccacggcagcggcaagctgttcgtgcaggacgagaagggcgccttcaacttcgaccaggagaccgtgatcaaccccgagaccggcgagcagatccagagctggtacagaagcggcgagacctgggacagcaagttcagcaccatcgccagcagctacgaggagtgcagagccgagagcgtgggcctgtacctgtgcctgcacccccaggtgctggagatcttcggcttcgagggcgccgacgccgaggacgtgatctacgtgaactggctgaacatggtgagagccggcctgctggccctggagttctacacccccgaggccttcaactggagacaggcccacatgcaggccagattcgtgatcctgagagtgctgctggaggccggcgagggcctggtgaccatcacccccaccaccggcagcgacggcagacccgacgccagagtgagactggacagaagcaagatcagaagcgtgggcaagcccgccctggagagattcctgagaagactgcaggtgctgaagagcaccggcgacgtggccggcggcagagccctgtacgagggctacgccaccgtgaccgacgccccccccgagtgcttcctgaccctgagagacaccgtgctgctgagaaaggagagcagaaagctgatcgtgcagcccaacaccagactggagggcagcgacgtgcagctgctggagtacgaggccagcgccgccggcctgatcagaagcttcagcgagagattccccgaggacggccccgagctggaggagatcctgacccagctggccaccgccgacgccagattctggaagggccccagcgaggcccccagcggccaggcctag

SEQ ID NO: 79293 - DNA, 2412 bp, Artificial Sequence
  Description of Artificial Sequence: Synthetic coding sequence
atgaccaccgccaaggagcccagcgccagcggcaagagcgtgcagcagcaggagcaggagctggtgggcagcaaccccccccagagaaactggaagggcatcgccatcgccctgctggtgatcctggtgatctgcagcctgatcgtgaccagcgtgatcctgctgacccccgccgaggacaacagcctgagccagaagaagaaggtgaccgtggaggacctgttcagcgaggacttcaagatccacgaccccgaggccaagtggatcagcgacaccgagttcatctacagagagcagaagggcaccgtgagactgtggaacgtggagaccaacaccagcaccgtgctgatcgagggcaagaagatcgagagcctgagagccatcagatacgagatcagccccgacagagagtacgccctgttcagctacaacgtggagcccatctaccagcacagctacaccggctactacgtgctgagcaagatcccccacggcgacccccagagcctggacccccccgaggtgagcaacgccaagctgcagtacgccggctggggccccaagggccagcagctgatcttcatcttcgagaacaacatctactactgcgcccacgtgggcaagcaggccatcagagtggtgagcaccggcaaggagggcgtgatctacaacggcctgagcgactggctgtacgaggaggagatcctgaagacccacatcgcccactggtggagccccgacggcaccagactggcctacgccgccatcaacgacagcagagtgcccatcatggagctgcccacctacaccggcagcatctaccccaccgtgaagccctaccactaccccaaggccggcagcgagaaccccagcatcagcctgcacgtgatcggcctgaacggccccacccacgacctggagatgatgccccccgacgaccccagaatgagagagtactacatcaccatggtgaagtgggccaccagcaccaaggtggccgtgacctggctgaacagagcccagaacgtgagcatcctgaccctgtgcgacgccaccaccggcgtgtgcaccaagaagcacgaggacgagagcgaggcctggctgcacagacagaacgaggagcccgtgttcagcaaggacggcagaaagttcttcttcatcagagccatcccccagggcggcagaggcaagttctaccacatcaccgtgagcagcagccagcccaacagcagcaacgacaacatccagagcatcaccagcggcgactgggacgtgaccaagatcctggcctacgacgagaagggcaacaagatctacttcctgagcaccgaggacctgcccagaagaagacagctgtacagcgccaacaccgtgggcaacttcaacagacagtgcctgagctgcgacctggtggagaactgcacctacttcagcgccagcttcagccacagcatggacttcttcctgctgaagtgcgagggccccggcgtgcccatggtgaccgtgcacaacaccaccgacaagaagaagatgttcgacctggagaccaacgagcacgtgaagaaggccatcaacgacagacagatgcccaaggtggagtacagagacatcgagatcgacgactacaacctgcccatgcagatcctgaagcccgccaccttcaccgacaccacccactaccccctgctgctggtggtggacggcacccccggcagccagagcgtggccgagaagttcgaggtgagctgggagaccgtgatggtgagcagccacggcgccgtggtggtgaagtgcgacggcagaggcagcggcttccagggcaccaagctgctgcacgaggtgagaagaagactgggcctgctggaggagaaggaccagatggaggccgtgagaaccatgctgaaggagcagtacatcgacagaaccagagtggccgtgttcggcaaggactacggcggctacctgagcacctacatcctgcccgccaagggcgagaaccagggccagaccttcacctgcggcagcgccctgagccccatcaccgacttcaagctgtacgccagcgccttcagcgagagatacctgggcctgcacggcctggacaacagagcctacgagatgaccaaggtggcccacagagtgagcgccctggaggagcagcagttcctgatcatccaccccaccgccgacgagaagatccacttccagcacaccgccgagctgatcacccagctgatcagaggcaaggccaactacagcctgcagatctaccccgacgagagccactacttcaccagcagcagcctgaagcagcacctgtacagaagcatcatcaacttcttcgtggagtgcttcagaatccaggacaagctgctgaccgtgaccgccaaggaggacgaggaggaggactag

SEQ ID NO: 79294 - DNA, 2598 bp, Artificial Sequence
  Description of Artificial Sequence: Synthetic coding sequence
atggccagcctgtaccagagattcaccggcaagatcaacaccagcagaagcttccccgccccccccgaggccagccacctgctgggcggccagggccccgaggaggacggcggcgccggcgccaagcccctgggccccagagcccaggccgccgcccccagagagagaggcggcggcggcggcggcgccggcggcagacccagattccagtaccaggccagaagcgacggcgacgaggaggacgagctggtgggcagcaaccccccccagagaaactggaagggcatcgccatcgccctgctggtgatcctggtgatctgcagcctgatcgtgaccagcgtgatcctgctgacccccgccgaggacaacagcctgagccagaagaagaaggtgaccgtggaggacctgttcagcgaggacttcaagatccacgaccccgaggccaagtggatcagcgacaccgagttcatctacagagagcagaagggcaccgtgagactgtggaacgtggagaccaacaccagcaccgtgctgatcgagggcaagaagatcgagagcctgagagccatcagatacgagatcagccccgacagagagtacgccctgttcagctacaacgtggagcccatctaccagcacagctacaccggctactacgtgctgagcaagatcccccacggcgacccccagagcctggacccccccgaggtgagcaacgccaagctgcagtacgccggctggggccccaagggccagcagctgatcttcatcttcgagaacaacatctactactgcgcccacgtgggcaagcaggccatcagagtggtgagcaccggcaaggagggcgtgatctacaacggcctgagcgactggctgtacgaggaggagatcctgaagacccacatcgcccactggtggagccccgacggcaccagactggcctacgccgccatcaacgacagcagagtgcccatcatggagctgcccacctacaccggcagcatctaccccaccgtgaagccctaccactaccccaaggccggcagcgagaaccccagcatcagcctgcacgtgatcggcctgaacggccccacccacgacctggagatgatgccccccgacgaccccagaatgagagagtactacatcaccatggtgaagtgggccaccagcaccaaggtggccgtgacctggctgaacagagcccagaacgtgagcatcctgaccctgtgcgacgccaccaccggcgtgtgcaccaagaagcacgaggacgagagcgaggcctggctgcacagacagaacgaggagcccgtgttcagcaaggacggcagaaagttcttcttcatcagagccatcccccagggcggcagaggcaagttctaccacatcaccgtgagcagcagccagcccaacagcagcaacgacaacatccagagcatcaccagcggcgactgggacgtgaccaagatcctggcctacgacgagaagggcaacaagatctacttcctgagcaccgaggacctgcccagaagaagacagctgtacagcgccaacaccgtgggcaacttcaacagacagtgcctgagctgcgacctggtggagaactgcacctacttcagcgccagcttcagccacagcatggacttcttcctgctgaagtgcgagggccccggcgtgcccatggtgaccgtgcacaacaccaccgacaagaagaagatgttcgacctggagaccaacgagcacgtgaagaaggccatcaacgacagacagatgcccaaggtggagtacagagacatcgagatcgacgactacaacctgcccatgcagatcctgaagcccgccaccttcaccgacaccacccactaccccctgctgctggtggtggacggcacccccggcagccagagcgtggccgagaagttcgaggtgagctgggagaccgtgatggtgagcagccacggcgccgtggtggtgaagtgcgacggcagaggcagcggcttccagggcaccaagctgctgcacgaggtgagaagaagactgggcctgctggaggagaaggaccagatggaggccgtgagaaccatgctgaaggagcagtacatcgacagaaccagagtggccgtgttcggcaaggactacggcggctacctgagcacctacatcctgcccgccaagggcgagaaccagggccagaccttcacctgcggcagcgccctgagccccatcaccgacttcaagctgtacgccagcgccttcagcgagagatacctgggcctgcacggcctggacaacagagcctacgagatgaccaaggtggcccacagagtgagcgccctggaggagcagcagttcctgatcatccaccccaccgccgacgagaagatccacttccagcacaccgccgagctgatcacccagctgatcagaggcaaggccaactacagcctgcagatctaccccgacgagagccactacttcaccagcagcagcctgaagcagcacctgtacagaagcatcatcaacttcttcgtggagtgcttcagaatccaggacaagctgctgaccgtgaccgccaaggaggacgaggaggaggactag

SEQ ID NO: 79295 - DNA, 2406 bp, Artificial Sequence
  Description of Artificial Sequence: Synthetic coding sequence
atgaaggagaaggccatgatcaagaccgccaagatgcagggcaacgtgatggagctggtgggcagcaaccccccccagagaaactggaagggcatcgccatcgccctgctggtgatcctggtgatctgcagcctgatcgtgaccagcgtgatcctgctgacccccgccgaggacaacagcctgagccagaagaagaaggtgaccgtggaggacctgttcagcgaggacttcaagatccacgaccccgaggccaagtggatcagcgacaccgagttcatctacagagagcagaagggcaccgtgagactgtggaacgtggagaccaacaccagcaccgtgctgatcgagggcaagaagatcgagagcctgagagccatcagatacgagatcagccccgacagagagtacgccctgttcagctacaacgtggagcccatctaccagcacagctacaccggctactacgtgctgagcaagatcccccacggcgacccccagagcctggacccccccgaggtgagcaacgccaagctgcagtacgccggctggggccccaagggccagcagctgatcttcatcttcgagaacaacatctactactgcgcccacgtgggcaagcaggccatcagagtggtgagcaccggcaaggagggcgtgatctacaacggcctgagcgactggctgtacgaggaggagatcctgaagacccacatcgcccactggtggagccccgacggcaccagactggcctacgccgccatcaacgacagcagagtgcccatcatggagctgcccacctacaccggcagcatctaccccaccgtgaagccctaccactaccccaaggccggcagcgagaaccccagcatcagcctgcacgtgatcggcctgaacggccccacccacgacctggagatgatgccccccgacgaccccagaatgagagagtactacatcaccatggtgaagtgggccaccagcaccaaggtggccgtgacctggctgaacagagcccagaacgtgagcatcctgaccctgtgcgacgccaccaccggcgtgtgcaccaagaagcacgaggacgagagcgaggcctggctgcacagacagaacgaggagcccgtgttcagcaaggacggcagaaagttcttcttcatcagagccatcccccagggcggcagaggcaagttctaccacatcaccgtgagcagcagccagcccaacagcagcaacgacaacatccagagcatcaccagcggcgactgggacgtgaccaagatcctggcctacgacgagaagggcaacaagatctacttcctgagcaccgaggacctgcccagaagaagacagctgtacagcgccaacaccgtgggcaacttcaacagacagtgcctgagctgcgacctggtggagaactgcacctacttcagcgccagcttcagccacagcatggacttcttcctgctgaagtgcgagggccccggcgtgcccatggtgaccgtgcacaacaccaccgacaagaagaagatgttcgacctggagaccaacgagcacgtgaagaaggccatcaacgacagacagatgcccaaggtggagtacagagacatcgagatcgacgactacaacctgcccatgcagatcctgaagcccgccaccttcaccgacaccacccactaccccctgctgctggtggtggacggcacccccggcagccagagcgtggccgagaagttcgaggtgagctgggagaccgtgatggtgagcagccacggcgccgtggtggtgaagtgcgacggcagaggcagcggcttccagggcaccaagctgctgcacgaggtgagaagaagactgggcctgctggaggagaaggaccagatggaggccgtgagaaccatgctgaaggagcagtacatcgacagaaccagagtggccgtgttcggcaaggactacggcggctacctgagcacctacatcctgcccgccaagggcgagaaccagggccagaccttcacctgcggcagcgccctgagccccatcaccgacttcaagctgtacgccagcgccttcagcgagagatacctgggcctgcacggcctggacaacagagcctacgagatgaccaaggtggcccacagagtgagcgccctggaggagcagcagttcctgatcatccaccccaccgccgacgagaagatccacttccagcacaccgccgagctgatcacccagctgatcagaggcaaggccaactacagcctgcagatctaccccgacgagagccactacttcaccagcagcagcctgaagcagcacctgtacagaagcatcatcaacttcttcgtggagtgcttcagaatccaggacaagctgctgaccgtgaccgccaaggaggacgaggaggaggactag

SEQ ID NO: 79296 - DNA, 2277 bp, Artificial Sequence
  Description of Artificial Sequence: Synthetic coding sequence
atgaccaccgccaaggagcccagcgccagcggcaagagcgtgcagcagcaggagcaggagctggtgggcagcaaccccccccagagaaactggaagggcatcgccatcgccctgctggtgatcctggtgatctgcagcctgatcgtgaccagcgtgatcctgctgacccccgccgaggacaacagcctgagccagaagaagaaggtgaccgtggaggacctgttcagcgaggacttcaagatccacgaccccgaggccaagtggatcagcgacaccgagttcatctacagagagcagaagggcaccgtgagactgtggaacgtggagaccaacaccagcaccgtgctgatcgagggcaagaagatcgagagcctgagagccatcagatacgagatcagccccgacagagagtacgccctgttcagctacaacgtggagcccatcttcatcttcgagaacaacatctactactgcgcccacgtgggcaagcaggccatcagagtggtgagcaccggcaaggagggcgtgatctacaacggcctgagcgactggctgtacgaggaggagatcctgaagacccacatcgcccactggtggagccccgacggcaccagactggcctacgccgccatcaacgacagcagagtgcccatcatggagctgcccacctacaccggcagcatctaccccaccgtgaagccctaccactaccccaaggccggcagcgagaaccccagcatcagcctgcacgtgatcggcctgaacggccccacccacgacctggagatgatgccccccgacgaccccagaatgagagagtactacatcaccatggtgaagtgggccaccagcaccaaggtggccgtgacctggctgaacagagcccagaacgtgagcatcctgaccctgtgcgacgccaccaccggcgtgtgcaccaagaagcacgaggacgagagcgaggcctggctgcacagacagaacgaggagcccgtgttcagcaaggacggcagaaagttcttcttcatcagagccatcccccagggcggcagaggcaagttctaccacatcaccgtgagcagcagccagcccaacagcagcaacgacaacatccagagcatcaccagcggcgactgggacgtgaccaagatcctggcctacgacgagaagggcaacaagatctacttcctgagcaccgaggacctgcccagaagaagacagctgtacagcgccaacaccgtgggcaacttcaacagacagtgcctgagctgcgacctggtggagaactgcacctacttcagcgccagcttcagccacagcatggacttcttcctgctgaagtgcgagggccccggcgtgcccatggtgaccgtgcacaacaccaccgacaagaagaagatgttcgacctggagaccaacgagcacgtgaagaaggccatcaacgacagacagatgcccaaggtggagtacagagacatcgagatcgacgactacaacctgcccatgcagatcctgaagcccgccaccttcaccgacaccacccactaccccctgctgctggtggtggacggcacccccggcagccagagcgtggccgagaagttcgaggtgagctgggagaccgtgatggtgagcagccacggcgccgtggtggtgaagtgcgacggcagaggcagcggcttccagggcaccaagctgctgcacgaggtgagaagaagactgggcctgctggaggagaaggaccagatggaggccgtgagaaccatgctgaaggagcagtacatcgacagaaccagagtggccgtgttcggcaaggactacggcggctacctgagcacctacatcctgcccgccaagggcgagaaccagggccagaccttcacctgcggcagcgccctgagccccatcaccgacttcaagctgtacgccagcgccttcagcgagagatacctgggcctgcacggcctggacaacagagcctacgagatgaccaaggtggcccacagagtgagcgccctggaggagcagcagttcctgatcatccaccccaccgccgacgagaagatccacttccagcacaccgccgagctgatcacccagctgatcagaggcaaggccaactacagcctgcagatctaccccgacgagagccactacttcaccagcagcagcctgaagcagcacctgtacagaagcatcatcaacttcttcgtggagtgcttcagaatccaggacaagctgctgaccgtgaccgccaaggaggacgaggaggaggactag

SEQ ID NO: 79297 - DNA, 2649 bp, Artificial Sequence
  Description of Artificial Sequence: Synthetic coding sequence
atggccgccgccatggagaccgagcagctgggcgtggagatcttcgagaccgccgactgcgaggagaacatcgagagccaggacagacccaagctggagcccttctacgtggagagatacagctggagccagctgaagaagctgctggccgacaccagaaagtaccacggctacatgatggccaaggccccccacgacttcatgttcgtgaagagaaacgaccccgacggcccccacagcgacagaatctactacctggccatgagcggcgagaacagagagaacaccctgttctacagcgagatccccaagaccatcaacagagccgccgtgctgatgctgagctggaagcccctgctggacctgttccaggccaccctggactacggcatgtacagcagagaggaggagctgctgagagagagaaagagaatcggcaccgtgggcatcgccagctacgactaccaccagggcagcggcaccttcctgttccaggccggcagcggcatctaccacgtgaaggacggcggcccccagggcttcacccagcagcccctgagacccaacctggtggagaccagctgccccaacatcagaatggaccccaagctgtgccccgccgaccccgactggatcgccttcatccacagcaacgacatctggatcagcaacatcgtgaccagagaggagagaagactgacctacgtgcacaacgagctggccaacatggaggaggacgccagaagcgccggcgtggccaccttcgtgctgcaggaggagttcgacagatacagcggctactggtggtgccccaaggccgagaccacccccagcggcggcaagatcctgagaatcctgtacgaggagaacgacgagagcgaggtggagatcatccacgtgaccagccccatgctggagaccagaagagccgacagcttcagataccccaagaccggcaccgccaaccccaaggtgaccttcaagatgagcgagatcatgatcgacgccgagggcagaatcatcgacgtgatcgacaaggagctgatccagcccttcgagatcctgttcgagggcgtggagtacatcgccagagccggctggacccccgagggcaagtacgcctggagcatcctgctggacagaagccagaccagactgcagatcgtgctgatcagccccgagctgttcatccccgtggaggacgacgtgatggagagacagagactgatcgagagcgtgcccgacagcgtgacccccctgatcatctacgaggagaccaccgacatctggatcaacatccacgacatcttccacgtgttcccccagagccacgaggaggagatcgagttcatcttcgccagcgagtgcaagaccggcttcagacacctgtacaagatcaccagcatcctgaaggagagcaagtacaagagaagcagcggcggcctgcccgcccccagcgacttcaagtgccccatcaaggaggagatcgccatcaccagcggcgagtgggaggtgctgggcagacacggcagcaacatccaggtggacgaggtgagaagactggtgtacttcgagggcaccaaggacagccccctggagcaccacctgtacgtggtgagctacgtgaaccccggcgaggtgaccagactgaccgacagaggctacagccacagctgctgcatcagccagcactgcgacttcttcatcagcaagtacagcaaccagaagaacccccactgcgtgagcctgtacaagctgagcagccccgaggacgaccccacctgcaagaccaaggagttctgggccaccatcctggacagcgccggccccctgcccgactacaccccccccgagatcttcagcttcgagagcaccaccggcttcaccctgtacggcatgctgtacaagccccacgacctgcagcccggcaagaagtaccccaccgtgctgttcatctacggcggcccccaggtgcagctggtgaacaacagattcaagggcgtgaagtacttcagactgaacaccctggccagcctgggctacgtggtggtggtgatcgacaacagaggcagctgccacagaggcctgaagttcgagggcgccttcaagtacaagatgggccagatcgagatcgacgaccaggtggagggcctgcagtacctggccagcagatacgacttcatcgacctggacagagtgggcatccacggctggagctacggcggctacctgagcctgatggccctgatgcagagaagcgacatcttcagagtggccatcgccggcgcccccgtgaccctgtggatcttctacgacaccggctacaccgagagatacatgggccaccccgaccagaacgagcagggctactacctgggcagcgtggccatgcaggccgagaagttccccagcgagcccaacagactgctgctgctgcacggcttcctggacgagaacgtgcacttcgcccacaccagcatcctgctgagcttcctggtgagagccggcaagccctacgacctgcagatctacccccaggagagacacagcatcagagtgcccgagagcggcgagcactacgagctgcacctgctgcactacctgcaggagaacctgggcagcagaatcgccgccctgaaggtgatctag

SEQ ID NO: 79298 - DNA, 2550 bp, Artificial Sequence
  Description of Artificial Sequence: Synthetic coding sequence
atgtggaagagaagcgagcagatgaagatcaagagcggcaagtgcaacatggccgccgccatggagaccgagcagctgggcgtggagatcttcgagaccgccgactgcgaggagaacatcgagagccaggacagacccaagctggagcccttctacgtggagagatacagctggagccagctgaagaagctgctggccgacaccagaaagtaccacggctacatgatggccaaggccccccacgacttcatgttcgtgaagagaaacgaccccgacggcccccacagcgacagaatctactacctggccatgagcggcgagaacagagagaacaccctgttctacagcgagatccccaagaccatcaacagagccgccgtgctgatgctgagctggaagcccctgctggacctgttccaggccaccctggactacggcatgtacagcagagaggaggagctgctgagagagagaaagagaatcggcaccgtgggcatcgccagctacgactaccaccagggcagcggcaccttcctgttccaggccggcagcggcatctaccacgtgaaggacggcggcccccagggcttcacccagcagcccctgagacccaacctggtggagaccagctgccccaacatcagaatggaccccaagctgtgccccgccgaccccgactggatcgccttcatccacagcaacgacatctggatcagcaacatcgtgaccagagaggagagaagactgacctacgtgcacaacgagctggccaacatggaggaggacgccagaagcgccggcgtggccaccttcgtgctgcaggaggagttcgacagatacagcggctactggtggtgccccaaggccgagaccacccccagcggcggcaagatcctgagaatcctgtacgaggagaacgacgagagcgaggtggagatcatccacgtgaccagccccatgctggagaccagaagagccgacagcttcagataccccaagaccggcaccgccaaccccaaggtgaccttcaagatgagcgagatcatgatcgacgccgagggcagaatcatcgacgtgatcgacaaggagctgatccagcccttcgagatcctgttcgagggcgtggagtacatcgccagagccggctggacccccgagggcaagtacgcctggagcatcctgctggacagaagccagaccagactgcagatcgtgctgatcagccccgagctgttcatccccgtggaggacgacgtgatggagagacagagactgatcgagagcgtgcccgacagcgtgacccccctgatcatctacgaggagaccaccgacatctggatcaacatccacgacatcttccacgtgttcccccagagccacgaggaggagatcgagttcatcttcgccagcgagtgcaagaccggcttcagacacctgtacaagatcaccagcatcctgaaggagagcaagtacaagagaagcagcggcggcctgcccgcccccagcgacttcaagtgccccatcaaggaggagatcgccatcaccagcggcgagtgggaggtgctgggcagacacggcagcaacatccaggtggacgaggtgagaagactggtgtacttcgagggcaccaaggacagccccctggagcaccacctgtacgtggtgagctacgtgaaccccggcgaggtgaccagactgaccgacagaggctacagccacagctgctgcatcagccagcactgcgacttcttcatcagcaagtacagcaaccagaagaacccccactgcgtgagcctgtacaagctgagcagccccgaggacgaccccacctgcaagaccaaggagttctgggccaccatcctggacagcgccggccccctgcccgactacaccccccccgagatcttcagcttcgagagcaccaccggcttcaccctgtacggcatgctgtacaagccccacgacctgcagcccggcaagaagtaccccaccgtgctgttcatctacggcggcccccagggccagatcgagatcgacgaccaggtggagggcctgcagtacctggccagcagatacgacttcatcgacctggacagagtgggcatccacggctggagctacggcggctacctgagcctgatggccctgatgcagagaagcgacatcttcagagtggccatcgccggcgcccccgtgaccctgtggatcttctacgacaccggctacaccgagagatacatgggccaccccgaccagaacgagcagggctactacctgggcagcgtggccatgcaggccgagaagttccccagcgagcccaacagactgctgctgctgcacggcttcctggacgagaacgtgcacttcgcccacaccagcatcctgctgagcttcctggtgagagccggcaagccctacgacctgcagatctacccccaggagagacacagcatcagagtgcccgagagcggcgagcactacgagctgcacctgctgcactacctgcaggagaacctgggcagcagaatcgccgccctgaaggtgatctag

SEQ ID NO: 79299 - DNA, 2544 bp, Artificial Sequence
  Description of Artificial Sequence: Synthetic coding sequence
atgtggaagagaagcgagcagatgaagatcaagagcggcaagtgcaacatggccgccgccatggagaccgagcagctgggcgtggagatcttcgagaccgccgactgcgaggagaacatcgagagccaggacagacccaagctggagcccttctacgtggagagatacagctggagccagctgaagaagctgctggccgacaccagaaagtaccacggctacatgatggccaaggccccccacgacttcatgttcgtgaagagaaacgaccccgacggcccccacagcgacagaatctactacctggccatgagcggcgagaacagagagaacaccctgttctacagcgagatccccaagaccatcaacagagccgccgtgctgatgctgagctggaagcccctgctggacctgttccaggccaccctggactacggcatgtacagcagagaggaggagctgctgagagagagaaagagaatcggcaccgtgggcatcgccagctacgactaccaccagggcagcggcaccttcctgttccaggccggcagcggcatctaccacgtgaaggacggcggcccccagggcttcacccagcagcccctgagacccaacctggtggagaccagctgccccaacatcagaatggaccccaagctgtgccccgccgaccccgactggatcgccttcatccacagcaacgacatctggatcagcaacatcgtgaccagagaggagagaagactgacctacgtgcacaacgagctggccaacatggaggaggacgccagaagcgccggcgtggccaccttcgtgctgcaggaggagttcgacagatacagcggctactggtggtgccccaaggccgagaccacccccagcggcggcaagatcctgagaatcctgtacgaggagaacgacgagagcgaggtggagatcatccacgtgaccagccccatgctggagaccagaagagccgacagcttcagataccccaagaccggcaccgccaaccccaaggtgaccttcaagatgagcgagatcatgatcgacgccgagggcagaatcatcgacgtgatcgacaaggagctgatccagcccttcgagatcctgttcgagggcgtggagtacatcgccagagccggctggacccccgagggcaagtacgcctggagcatcctgctggacagaagccagaccagactgcagatcgtgctgatcagccccgagctgttcatccccgtggaggacgacgtgatggagagacagagactgatcgagagcgtgcccgacagcgtgacccccctgatcatctacgaggagaccaccgacatctggatcaacatccacgacatcttccacgtgttcccccagagccacgaggaggagatcgagttcatcttcgccagcgagtgcaagaccggcttcagacacctgtacaagatcaccagcatcctgaaggagagcaagtacaagagaagcagcggcggcctgcccgcccccagcgacttcaagtgccccatcaaggaggagatcgccatcaccagcggcgagtgggaggtgctgggcagacacggcagcaacatccaggtggacgaggtgagaagactggtgtacttcgagggcaccaaggacagccccctggagcaccacctgtacgtggtgagctacgtgaaccccggcgaggtgaccagactgaccgacagaggctacagccacagctgctgcatcagccagcactgcgacttcttcatcagcaagtacagcaaccagaagaacccccactgcgtgagcctgtacaagctgagcagccccgaggacgaccccacctgcaagaccaaggagttctgggccaccatcctggacagcgccggccccctgcccgactacaccccccccgagatcttcagcttcgagagcaccaccggcttcaccctgtacggcatgctgtacaagccccacgacctgcagcccggcaagaagtaccccaccgtgctgttcatctacggcggcccccaggtgcagctggtgaacaacagattcaagggcgtgaagtacttcagactgaacaccctggccagcctgggctacgtggtggtggtgatcgacaacagaggcagctgccacagaggcctgaagttcgagggcgccttcaagtacaagatggtggccatcgccggcgcccccgtgaccctgtggatcttctacgacaccggctacaccgagagatacatgggccaccccgaccagaacgagcagggctactacctgggcagcgtggccatgcaggccgagaagttccccagcgagcccaacagactgctgctgctgcacggcttcctggacgagaacgtgcacttcgcccacaccagcatcctgctgagcttcctggtgagagccggcaagccctacgacctgcagatctacccccaggagagacacagcatcagagtgcccgagagcggcgagcactacgagctgcacctgctgcactacctgcaggagaacctgggcagcagaatcgccgccctgaaggtgatctag

SEQ ID NO: 79300 - DNA, 2178 bp, Artificial Sequence
  Description of Artificial Sequence: Synthetic coding sequence
atgtggaagagaagcgagcagatgaagatcaagagcggcaagtgcaacatggccgccgccatggagaccgagcagctgggcgtggagatcttcgagaccgccgactgcgaggagaacatcgagagccaggacagacccaagctggagcccttctacgtggagagatacagctggagccagctgaagaagctgctggccgacaccagaaagtaccacggctacatgatggccaaggccccccacgacttcatgttcgtgaagagaaacgaccccgacggcccccacagcgacagaatctactacctggccatgagcggcgagaacagagagaacaccctgttctacagcgagatccccaagaccatcaacagagccgccgtgctgatgctgagctggaagcccctgctggacctgttccaggccaccctggactacggcatgtacagcagagaggaggagctgctgagagagagaaagagaatcggcaccgtgggcatcgccagctacgactaccaccagggcagcggcaccttcctgttccaggccggcagcggcatctaccacgtgaaggacggcggcccccagggcttcacccagcagcccctgagacccaacctggtggagaccagctgccccaacatcagaatggaccccaagctgtgccccgccgaccccgactggatcgccttcatccacagcaacgacatctggatcagcaacatcgtgaccagagaggagagaagactgacctacgtgcacaacgagctggccaacatggaggaggacgccagaagcgccggcgtggccaccttcgtgctgcaggaggagttcgacagatacagcggctactggtggtgccccaaggccgagaccacccccagcggcggcaagatcctgagaatcctgtacgaggagaacgacgagagcgaggtggagatcatccacgtgaccagccccatgctggagaccagaagagccgacagcttcagataccccaagaccggcaccgccaaccccaaggtgaccttcaagatgagcgagatcatgatcgacgccgagggcagaatccaggtggacgaggtgagaagactggtgtacttcgagggcaccaaggacagccccctggagcaccacctgtacgtggtgagctacgtgaaccccggcgaggtgaccagactgaccgacagaggctacagccacagctgctgcatcagccagcactgcgacttcttcatcagcaagtacagcaaccagaagaacccccactgcgtgagcctgtacaagctgagcagccccgaggacgaccccacctgcaagaccaaggagttctgggccaccatcctggacagcgccggccccctgcccgactacaccccccccgagatcttcagcttcgagagcaccaccggcttcaccctgtacggcatgctgtacaagccccacgacctgcagcccggcaagaagtaccccaccgtgctgttcatctacggcggcccccaggtgcagctggtgaacaacagattcaagggcgtgaagtacttcagactgaacaccctggccagcctgggctacgtggtggtggtgatcgacaacagaggcagctgccacagaggcctgaagttcgagggcgccttcaagtacaagatgggccagatcgagatcgacgaccaggtggagggcctgcagtacctggccagcagatacgacttcatcgacctggacagagtgggcatccacggctggagctacggcggctacctgagcctgatggccctgatgcagagaagcgacatcttcagagtggccatcgccggcgcccccgtgaccctgtggatcttctacgacaccggctacaccgagagatacatgggccaccccgaccagaacgagcagggctactacctgggcagcgtggccatgcaggccgagaagttccccagcgagcccaacagactgctgctgctgcacggcttcctggacgagaacgtgcacttcgcccacaccagcatcctgctgagcttcctggtgagagccggcaagccctacgacctgcagatctacccccaggagagacacagcatcagagtgcccgagagcggcgagcactacgagctgcacctgctgcactacctgcaggagaacctgggcagcagaatcgccgccctgaaggtgatctag

SEQ ID NO: 79301 - DNA, 2697 bp, Artificial Sequence
  Description of Artificial Sequence: Synthetic coding sequence
atgtggaagagaagcgagcagatgaagatcaagagcggcaagtgcaacatggccgccgccatggagaccgagcagctgggcgtggagatcttcgagaccgccgactgcgaggagaacatcgagagccaggacagacccaagctggagcccttctacgtggagagatacagctggagccagctgaagaagctgctggccgacaccagaaagtaccacggctacatgatggccaaggccccccacgacttcatgttcgtgaagagaaacgaccccgacggcccccacagcgacagaatctactacctggccatgagcggcgagaacagagagaacaccctgttctacagcgagatccccaagaccatcaacagagccgccgtgctgatgctgagctggaagcccctgctggacctgttccaggccaccctggactacggcatgtacagcagagaggaggagctgctgagagagagaaagagaatcggcaccgtgggcatcgccagctacgactaccaccagggcagcggcaccttcctgttccaggccggcagcggcatctaccacgtgaaggacggcggcccccagggcttcacccagcagcccctgagacccaacctggtggagaccagctgccccaacatcagaatggaccccaagctgtgccccgccgaccccgactggatcgccttcatccacagcaacgacatctggatcagcaacatcgtgaccagagaggagagaagactgacctacgtgcacaacgagctggccaacatggaggaggacgccagaagcgccggcgtggccaccttcgtgctgcaggaggagttcgacagatacagcggctactggtggtgccccaaggccgagaccacccccagcggcggcaagatcctgagaatcctgtacgaggagaacgacgagagcgaggtggagatcatccacgtgaccagccccatgctggagaccagaagagccgacagcttcagataccccaagaccggcaccgccaaccccaaggtgaccttcaagatgagcgagatcatgatcgacgccgagggcagaatcatcgacgtgatcgacaaggagctgatccagcccttcgagatcctgttcgagggcgtggagtacatcgccagagccggctggacccccgagggcaagtacgcctggagcatcctgctggacagaagccagaccagactgcagatcgtgctgatcagccccgagctgttcatccccgtggaggacgacgtgatggagagacagagactgatcgagagcgtgcccgacagcgtgacccccctgatcatctacgaggagaccaccgacatctggatcaacatccacgacatcttccacgtgttcccccagagccacgaggaggagatcgagttcatcttcgccagcgagtgcaagaccggcttcagacacctgtacaagatcaccagcatcctgaaggagagcaagtacaagagaagcagcggcggcctgcccgcccccagcgacttcaagtgccccatcaaggaggagatcgccatcaccagcggcgagtgggaggtgctgggcagacacggcagcaacatccaggtggacgaggtgagaagactggtgtacttcgagggcaccaaggacagccccctggagcaccacctgtacgtggtgagctacgtgaaccccggcgaggtgaccagactgaccgacagaggctacagccacagctgctgcatcagccagcactgcgacttcttcatcagcaagtacagcaaccagaagaacccccactgcgtgagcctgtacaagctgagcagccccgaggacgaccccacctgcaagaccaaggagttctgggccaccatcctggacagcgccggccccctgcccgactacaccccccccgagatcttcagcttcgagagcaccaccggcttcaccctgtacggcatgctgtacaagccccacgacctgcagcccggcaagaagtaccccaccgtgctgttcatctacggcggcccccaggtgcagctggtgaacaacagattcaagggcgtgaagtacttcagactgaacaccctggccagcctgggctacgtggtggtggtgatcgacaacagaggcagctgccacagaggcctgaagttcgagggcgccttcaagtacaagatgggccagatcgagatcgacgaccaggtggagggcctgcagtacctggccagcagatacgacttcatcgacctggacagagtgggcatccacggctggagctacggcggctacctgagcctgatggccctgatgcagagaagcgacatcttcagagtggccatcgccggcgcccccgtgaccctgtggatcttctacgacaccggctacaccgagagatacatgggccaccccgaccagaacgagcagggctactacctgggcagcgtggccatgcaggccgagaagttccccagcgagcccaacagactgctgctgctgcacggcttcctggacgagaacgtgcacttcgcccacaccagcatcctgctgagcttcctggtgagagccggcaagccctacgacctgcagatctacccccaggagagacacagcatcagagtgcccgagagcggcgagcactacgagctgcacctgctgcactacctgcaggagaacctgggcagcagaatcgccgccctgaaggtgatctag

SEQ ID NO: 79302 - DNA, 2349 bp, Artificial Sequence
  Description of Artificial Sequence: Synthetic coding sequence
atggccgccgccatggagaccgagcagctgggcgtggagatcttcgagaccgccgactgcgaggagaacatcgagagccaggacagacccaagctggagcccttctacgtggagagatacagctggagccagctgaagaagctgctggccgacaccagaaagtaccacggctacatgatggccaaggccccccacgacttcatgttcgtgaagagaaacgaccccgacggcccccacagcgacagaatctactacctggccatgagcggcgagaacagagagaacaccctgttctacagcgagatccccaagaccatcaacagagccgccgtgctgatgctgagctggaagcccctgctggacctgttccaggccaccctggactacggcatgtacagcagagaggaggagctgctgagagagagaaagagaatcggcaccgtgggcatcgccagctacgactaccaccagggcagcggcaccttcctgttccaggccggcagcggcatctaccacgtgaaggacggcggcccccagggcttcacccagcagcccctgagacccaacctggtggagaccagctgccccaacatcagaatggaccccaagctgtgccccgccgaccccgactggatcgccttcatccacagcaacgacatctggatcagcaacatcgtgaccagagaggagagaagactgacctacgtgcacaacgagctggccaacatggaggaggacgccagaagcgccggcgtggccaccttcgtgctgcaggaggagttcgacagatacagcggctactggtggtgccccaaggccgagaccacccccagcggcggcaagatcctgagaatcctgtacgaggagaacgacgagagcgaggtggagatcatccacgtgaccagccccatgctggagaccagaagagccgacagcttcagataccccaagaccggcaccgccaaccccaaggtgaccttcaagatgagcgagatcatgatcgacgccgagggcagaatcatcgacgtgatcgacaaggagctgatccagcccttcgagatcctgttcgagggcgtggagtacatcgccagagccggctggacccccgagggcaagtacgcctggagcatcctgctggacagaagccagaccagactgcagatcgtgctgatcagccccgagctgttcatccccgtggaggacgacgtgatggagagacagagactgatcgagagcgtgcccgacagcgtgacccccctgatcatctacgaggagaccaccgacatctggatcaacatccacgacatcttccacgtgttcccccagagccacgaggaggagatcgagttcatcttcgccagcgagtgcaagaccggcttcagacacctgtacaagatcaccagcatcctgaaggagagcaagtacaagagaagcagcggcggcctgcccgcccccagcgacttcaagtgccccatcaaggaggagatcgccatcaccagcggcgagtgggaggtgctgggcagacacggcagcaacatccaggtggacgaggtgagaagactggtgtacttcgagggcaccaaggacagccccctggagcaccacctgtacgtggtgagctacgtgaaccccggcgaggtgaccagactgaccgacagaggctacagccacagctgctgcatcagccagcactgcgacttcttcatcagcaagtacagcaaccagaagaacccccactgcgtgagcctgtacaagctgagcagccccgaggacgaccccacctgcaagaccaaggagttctgggccaccatcctggacagcgccggccccctgcccgactacaccccccccgagatcttcagcttcgagagcaccaccggcttcaccctgtacggcatgctgtacaagccccacgacctgcagcccggcaagaagtaccccaccgtgctgttcatctacggcggcccccaggtggccatcgccggcgcccccgtgaccctgtggatcttctacgacaccggctacaccgagagatacatgggccaccccgaccagaacgagcagggctactacctgggcagcgtggccatgcaggccgagaagttccccagcgagcccaacagactgctgctgctgcacggcttcctggacgagaacgtgcacttcgcccacaccagcatcctgctgagcttcctggtgagagccggcaagccctacgacctgcagatctacccccaggagagacacagcatcagagtgcccgagagcggcgagcactacgagctgcacctgctgcactacctgcaggagaacctgggcagcagaatcgccgccctgaaggtgatctag

SEQ ID NO: 79303 - DNA, 2697 bp, Artificial Sequence; identical to SEQ ID NO: 79301
  Description of Artificial Sequence: Synthetic coding sequence

SEQ ID NO: 79304 - DNA, 3669 bp, Artificial Sequence
  Description of Artificial Sequence: Synthetic coding sequence
atgagcgaggcccccagattcttcgtgggccccgaggacaccgagatcaaccccggcaactacagacacttcttccaccacgccgacgaggacgacgaggaggaggacgacagcccccccgagagacagatcgtggtgggcatctgcagcatggccaagaagagcaagagcaagcccatgaaggagatcctggagagaatcagcctgttcaagtacatcaccgtggtggtgttcgaggaggaggtgatcctgaacgagcccgtggagaactggcccctgtgcgactgcctgatcagcttccacagcaagggcttccccctggacaaggccgtggcctacgccaagctgagaaaccccttcgtgatcaacgacctgaacatgcagtacctgatccaggacagaagagaggtgtacagcatcctgcaggccgagggcatcctgctgcccagatacgccatcctgaacagagaccccaacaaccccaaggagtgcaacctgatcgagggcgaggaccacgtggaggtgaacggcgaggtgttccagaagcccttcgtggagaagcccgtgagcgccgaggaccacaacgtgtacatctactaccccaccagcgccggcggcggcagccagagactgttcagaaagatcggcagcagaagcagcgtgtacagccccgagagcaacgtgagaaagaccggcagctacatctacgaggagttcatgcccaccgacggcaccgacgtgaaggtgtacaccgtgggccccgactacgcccacgccgaggccagaaagagccccgccctggacggcaaggtggagagagacagcgagggcaaggaggtgagataccccgtgatcctgaacgccagagagaagctgatcgcctggaaggtgtgcctggccttcaagcagaccgtgtgcggcttcgacctgctgagagccaacggccagagctacgtgtgcgacgtgaacggcttcagcttcgtgaagaacagcatgaagtactacgacgactgcgccaagatcctgggcaacatcgtgatgagagagctggccccccagttccacatcccctggagcatccccctggaggccgaggacatccccatcgtgcccaccaccagcggcaccatgatggagctgagatgcgtgatcgccgtgatcagacacggcgacagaacccccaagcagaagatgaagatggaggtgagacaccagaagttcttcgacctgttcgagaagtgcgacggctacaagagcggcaagctgaagctgaagaagcccaagcagctgcaggaggtgctggacatcgccagacagctgctgatggagctgggccagaacaacgacagcgagatcgaggagaacaagcccaagctggagcagctgaagaccgtgctggagatgtacggccacttcagcggcatcaacagaaaggtgcagctgacctacctgccccacggctgccccaagaccagcagcgaggaggaggacagcagaagagaggagcccagcctgctgctggtgctgaagtggggcggcgagctgacccccgccggcagagtgcaggccgaggagctgggcagagccttcagatgcatgtaccccggcggccagggcgactacgccggcttccccggctgcggcctgctgagactgcacagcacctacagacacgacctgaagatctacgccagcgacgagggcagagtgcagatgaccgccgccgccttcgccaagggcctgctggccctggagggcgagctgacccccatcctggtgcagatggtgaagagcgccaacatgaacggcctgctggacagcgacagcgacagcctgagcagctgccagcagagagtgaaggccagactgcacgagatcctgcagaaggacagagacttcaccgccgaggactacgagaagctgacccccagcggcagcatcagcctgatcaagagcatgcacctgatcaagaaccccgtgaagacctgcgacaaggtgtacagcctgatccagagcctgaccagccagatcagacacagaatggaggaccccaagagcagcgacatccagctgtaccacagcgagaccctggagctgatgctgagaagatggagcaagctggagaaggacttcaagaccaagaacggcagatacgacatcagcaagatccccgacatctacgactgcatcaagtacgacgtgcagcacaacggcagcctgaagctggagaacaccatggagctgtacagactgagcaaggccctggccgacatcgtgatcccccaggagtacggcatcaccaaggccgagaagctggagatcgccaagggctactgcacccccctggtgagaaagatcagaagcgacctgcagagaacccaggacgacgacaccgtgaacaagctgcaccccgtgtacagcagaggcgtgctgagccccgagagacacgtgagaaccagactgtacttcaccagcgagagccacgtgcacagcctgctgagcatcctgagatacggcgccctgtgcaacgagagcaaggacgagcagtggaagagagccatggactacctgaacgtggtgaacgagctgaactacatgacccagatcgtgatcatgctgtacgaggaccccaacaaggacctgagcagcgaggagagattccacgtggagctgcacttcagccccggcgccaagggctgcgaggaggacaagaacctgcccagcggctacggctacagacccgccagcagagagaacgagggcagaagacccttcaagatcgacaacgacgacgagccccacaccagcaagagagacgaggtggacagagccgtgatcctgttcaagcccatggtgagcgagcccatccacatccacagaaagagccccctgcccagaagcagaaagaccgccaccaacgacgaggagagccccctgagcgtgagcagccccgagggcaccggcacctggctgcactacaccagcggcgtgggcaccggcagaagaagaagaagaagcggcgagcagatcaccagcagccccgtgagccccaagagcctggccttcaccagcagcatcttcggcagctggcagcaggtggtgagcgagaacgccaactacctgagaacccccagaaccctggtggagcagaagcagaaccccaccgtgggcagccactgcgccggcctgttcagcaccagcgtgctgggcggcagcagcagcgcccccaacctgcaggactacgccagaacccacagaaagaagctgaccagcagcggctgcatcgacggcttcgagctgtacagcatggtgcccagcatctgccccctggagaccctgcacaacgccctgagcctgaagcaggtggacgagttcctggccagcatcgccagccccagcagcgacgtgcccagaaagaccgccgagatcagcagcaccgccctgagaagcagccccatcatgagaaagaaggtgagcctgaacacctacacccccgccaagatcctgcccaccccccccgccaccctgaagagcaccaaggccagcagcaagcccgccaccagcggccccagcagcgccgtggtgcccaacaccagcagcagaaagaagaacatcaccagcaagaccgagacccacgagcacaagaagaacaccggcaagaagaagtag

SEQ ID NO: 79305 - DNA, 3732 bp, Artificial Sequence
  Description of Artificial Sequence: Synthetic coding sequence
atgagcgaggcccccagattcttcgtgggccccgaggacaccgagatcaaccccggcaactacagacacttcttccaccacgccgacgaggacgacgaggaggaggacgacagcccccccgagagacagatcgtggtgggcatctgcagcatggccaagaagagcaagagcaagcccatgaaggagatcctggagagaatcagcctgttcaagtacatcaccgtggtggtgttcgaggaggaggtgatcctgaacgagcccgtggagaactggcccctgtgcgactgcctgatcagcttccacagcaagggcttccccctggacaaggccgtggcctacgccaagctgagaaaccccttcgtgatcaacgacctgaacatgcagtacctgatccaggacagaagagaggtgtacagcatcctgcaggccgagggcatcctgctgcccagatacgccatcctgaacagagaccccaacaaccccaaggagtgcaacctgatcgagggcgaggaccacgtggaggtgaacggcgaggtgttccagaagcccttcgtggagaagcccgtgagcgccgaggaccacaacgtgtacatctactaccccaccagcgccggcggcggcagccagagactgttcagaaagatcggcagcagaagcagcgtgtacagccccgagagcaacgtgagaaagaccggcagctacatctacgaggagttcatgcccaccgacggcaccgacgtgaaggtgtacaccgtgggccccgactacgcccacgccgaggccagaaagagccccgccctggacggcaaggtggagagagacagcgagggcaaggaggtgagataccccgtgatcctgaacgccagagagaagctgatcgcctggaaggtgtgcctggccttcaagcagaccgtgtgcggcttcgacctgctgagagccaacggccagagctacgtgtgcgacgtgaacggcttcagcttcgtgaagaacagcatgaagtactacgacgactgcgccaagatcctgggcaacatcgtgatgagagagctggccccccagttccacatcccctggagcatccccctggaggccgaggacatccccatcgtgcccaccaccagcggcaccatgatggagctgagatgcgtgatcgccgtgatcagacacggcgacagaacccccaagcagaagatgaagatggaggtgagacaccagaagttcttcgacctgttcgagaagtgcgacggctacaagagcggcaagctgaagctgaagaagcccaagcagctgcaggaggtgctggacatcgccagacagctgctgatggagctgggccagaacaacgacagcgagatcgaggagaacaagcccaagctggagcagctgaagaccgtgctggagatgtacggccacttcagcggcatcaacagaaaggtgcagctgacctacctgccccacggctgccccaagaccagcagcgaggaggaggacagcagaagagaggagcccagcctgctgctggtgctgaagtggggcggcgagctgacccccgccggcagagtgcaggccgaggagctgggcagagccttcagatgcatgtaccccggcggccagggcgactacgccggcttccccggctgcggcctgctgagactgcacagcacctacagacacgacctgaagatctacgccagcgacgagggcagagtgcagatgaccgccgccgccttcgccaagggcctgctggccctggagggcgagctgacccccatcctggtgcagatggtgaagagcgccaacatgaacggcctgctggacagcgacagcgacagcctgagcagctgccagcagagagtgaaggccagactgcacgagatcctgcagaaggacagagacttcaccgccgaggactacgagaagctgacccccagcggcagcatcagcctgatcaagagcatgcacctgatcaagaaccccgtgaagacctgcgacaaggtgtacagcctgatccagagcctgaccagccagatcagacacagaatggaggaccccaagagcagcgacatccagctgtaccacagcgagaccctggagctgatgctgagaagatggagcaagctggagaaggacttcaagaccaagaacggcagatacgacatcagcaagatccccgacatctacgactgcatcaagtacgacgtgcagcacaacggcagcctgaagctggagaacaccatggagctgtacagactgagcaaggccctggccgacatcgtgatcccccaggagtacggcatcaccaaggccgagaagctggagatcgccaagggctactgcacccccctggtgagaaagatcagaagcgacctgcagagaacccaggacgacgacaccgtgaacaagctgcaccccgtgtacagcagaggcgtgctgagccccgagagacacgtgagaaccagactgtacttcaccagcgagagccacgtgcacagcctgctgagcatcctgagatacggcgccctgtgcaacgagagcaaggacgagcagtggaagagagccatggactacctgaacgtggtgaacgagctgaactacatgacccagatcgtgatcatgctgtacgaggaccccaacaaggacctgagcagcgaggagagattccacgtggagctgcacttcagccccggcgccaagggctgcgaggaggacaagaacctgcccagcggctacggctacagacccgccagcagagagaacgagggcagaagacccttcaagatcgacaacgacgacgagccccacaccagcaagagagacgaggtggacagagccgtgatcctgttcaagcccatggtgagcgagcccatccacatccacagaaagagccccctgcccagaagcagaaagaccgccaccaacgacgaggagagccccctgagcgtgagcagccccgagggcaccggcacctggctgcactacaccagcggcgtgggcaccggcagaagaagaagaagaagcggcgagcagatcaccagcagccccgtgagccccaagagcctggccttcaccagcagcatcttcggcagctggcagcaggtggtgagcgagaacgccaactacctgagaacccccagaaccctggtggagcagaagcagaaccccaccgtgggcagccactgcgccggcctgttcagcaccagcgtgctgggcggcagcagcagcgcccccaacctgcaggactacgccagaacccacagaaagaagctgaccagcagcggctgcatcgacgacgccaccagaggcagcgccgtgaagagattcagcatcagcttcgccagacaccccaccaacggcttcgagctgtacagcatggtgcccagcatctgccccctggagaccctgcacaacgccctgagcctgaagcaggtggacgagttcctggccagcatcgccagccccagcagcgacgtgcccagaaagaccgccgagatcagcagcaccgccctgagaagcagccccatcatgagaaagaaggtgagcctgaacacctacacccccgccaagatcctgcccaccccccccgccaccctgaagagcaccaaggccagcagcaagcccgccaccagcggccccagcagcgccgtggtgcccaacaccagcagcagaaagaagaacatcaccagcaagaccgagacccacgagcacaagaagaacaccggcaagaagaagtag

SEQ ID NO: 79306 - DNA, 3669 bp, Artificial Sequence; identical to SEQ ID NO: 79304
  Description of Artificial Sequence: Synthetic coding sequence

SEQ ID NO: 79307 - DNA, 3837 bp, Artificial Sequence
  Description of Artificial Sequence: Synthetic coding sequence
atgagcgaggcccccagattcttcgtgggccccgaggacaccgagatcaaccccggcaactacagacacttcttccaccacgccgacgaggacgacgaggaggaggacgacagcccccccgagagacagatcgtggtgggcatctgcagcatggccaagaagagcaagagcaagcccatgaaggagatcctggagagaatcagcctgttcaagtacatcaccgtggtggtgttcgaggaggaggtgatcctgaacgagcccgtggagaactggcccctgtgcgactgcctgatcagcttccacagcaagggcttccccctggacaaggccgtggcctacgccaagctgagaaaccccttcgtgatcaacgacctgaacatgcagtacctgatccaggacagaagagaggtgtacagcatcctgcaggccgagggcatcctgctgcccagatacgccatcctgaacagagaccccaacaaccccaaggagtgcaacctgatcgagggcgaggaccacgtggaggtgaacggcgaggtgttccagaagcccttcgtggagaagcccgtgagcgccgaggaccacaacgtgtacatctactaccccaccagcgccggcggcggcagccagagactgttcagaaagatcggcagcagaagcagcgtgtacagccccgagagcaacgtgagaaagaccggcagctacatctacgaggagttcatgcccaccgacggcaccgacgtgaaggtgtacaccgtgggccccgactacgcccacgccgaggccagaaagagccccgccctggacggcaaggtggagagagacagcgagggcaaggaggtgagataccccgtgatcctgaacgccagagagaagctgatcgcctggaaggtgtgcctggccttcaagcagaccgtgtgcggcttcgacctgctgagagccaacggccagagctacgtgtgcgacgtgaacggcttcagcttcgtgaagaacagcatgaagtactacgacgactgcgccaagatcctgggcaacatcgtgatgagagagctggccccccagttccacatcccctggagcatccccctggaggccgaggacatccccatcgtgcccaccaccagcggcaccatgatggagctgagatgcgtgatcgccgtgatcagacacggcgacagaacccccaagcagaagatgaagatggaggtgagacaccagaagttcttcgacctgttcgagaagtgcgacggctacaagagcggcaagctgaagctgaagaagcccaagcagctgcaggaggtgctggacatcgccagacagctgctgatggagctgggccagaacaacgacagcgagatcgaggagaacaagcccaagctggagcagctgaagaccgtgctggagatgtacggccacttcagcggcatcaacagaaaggtgcagctgacctacctgccccacggctgccccaagaccagcagcgaggaggaggacagcagaagagaggagcccagcctgctgctggtgctgaagtggggcggcgagctgacccccgccggcagagtgcaggccgaggagctgggcagagccttcagatgcatgtaccccggcggccagggcgactacgccggcttccccggctgcggcctgctgagactgcacagcacctacagacacgacctgaagatctacgccagcgacgagggcagagtgcagatgaccgccgccgccttcgccaagggcctgctggccctggagggcgagctgacccccatcctggtgcagatggtgaagagcgccaacatgaacggcctgctggacagcgacagcgacagcctgagcagctgccagcagagagtgaaggccagactgcacgagatcctgcagaaggacagagacttcaccgccgaggactacgagaagctgacccccagcggcagcatcagcctgatcaagagcatgcacctgatcaagaaccccgtgaagacctgcgacaaggtgtacagcctgatccagagcctgaccagccagatcagacacagaatggaggaccccaagagcagcgacatccagctgtaccacagcgagaccctggagctgatgctgagaagatggagcaagctggagaaggacttcaagaccaagaacggcagatacgacatcagcaagatccccgacatctacgactgcatcaagtacgacgtgcagcacaacggcagcctgaagctggagaacaccatggagctgtacagactgagcaaggccctggccgacatcgtgatcccccaggagtacggcatcaccaaggccgagaagctggagatcgccaagggctactgcacccccctggtgagaaagatcagaagcgacctgcagagaacccaggacgacgacaccgtgaacaagctgcaccccgtgtacagcagaggcgtgctgagccccgagagacacgtgagaaccagactgtacttcaccagcgagagccacgtgcacagcctgctgagcatcctgagatacggcgccctgtgcaacgaccacgacagccagaacgaggacggcggcatggtgaaggagatggagagcaaggacgagcagtggaagagagccatggactacctgaacgtggtgaacgagctgaactacatgacccagatcgtgatcatgctgtacgaggaccccaacaaggacctgagcagcgaggagagattccacgtggagctgcacttcagccccggcgccaagggctgcgaggaggacaagaacctgcccagcggctacggctacagacccgccagcagagagaacgagggcagaagacccttcaagatcgacaacgacgacgagccccacaccagcaagagagacgaggtggacagagccgtgatcctgttcaagcccatggtgagcgagcccatccacatccacagaaagagccccctgcccagaagcagaaagaccgccaccaacgacgaggagagccccctgagcgtgagcagccccgagggcaccggcacctggctgcactacaccagcggcgtgggcaccggcagaagaagaagaagaagcggcgagcagatcaccagcagccccgtgagccccaagagcctggccttcaccagcagcatcttcggcagctggcagcaggtggtgagcgagaacgccaactacctgagaacccccagaaccctggtggagcagaagcagaaccccaccgtgggcagccactgcgccggcctgttcagcaccagcgtgctgggcggcagcagcagcgcccccaacctgcaggactacgccagaacccacagaaagaagctgaccagcagcggctgcatcgacgacgccaccagaggcagcgccgtgaagagattcagcatcagcttcgccagacaccccaccaacgagcacctgcacctgtacagatgctggagcgtgagcagcgtggagttcctgggcagcagcggcttcgagctgtacagcatggtgcccagcatctgccccctggagaccctgcacaacgccctgagcctgaagcaggtggacgagttcctggccagcatcgccagccccagcagcgacgtgcccagaaagaccgccgagatcagcagcaccgccctgagaagcagccccatcatgagaaagaaggtgagcctgaacacctacacccccgccaagatcctgcccaccccccccgccaccctgaagagcaccaaggccagcagcaagcccgccaccagcggccccagcagcgccgtggtgcccaacaccagcagcagaaagaagaacatcaccagcaagaccgagacccacgagcacaagaagaacaccggcaagaagaagtag

SEQ ID NO: 79308 - DNA, 177 bp, Artificial Sequence
  Description of Artificial Sequence: Synthetic coding sequence
atgagcgaggcccccagattcttcgtgggccccgaggacaccgagatcaaccccggcaactacagacacttcttccaccacgccgacgaggacgacgaggaggaggacgacagcccccccgagagacagatcgtggtgggcatctgcagcatggccaagaagagcaagagcaagtag

SEQ ID NO: 79309 - DNA, 2877 bp, Artificial Sequence
  Description of Artificial Sequence: Synthetic coding sequence
atgctgaagagcaagaccttcctgaagaagaccagagccggcggcgtgatgaagatcgtgagagagcactacctgagagacgacatcggctgcggcgcccccggctgcgccgcctgcggcggcgcccacgagggccccgccctggagccccagccccaggaccccgccagcagcgtgtgcccccagccccactacctgctgcccgacaccaacgtgctgctgcaccagatcgacgtgctggaggaccccgccatcagaaacgtgatcgtgctgcagaccgtgctgcaggaggtgagaaacagaagcgcccccgtgtacaagagaatcagagacgtgaccaacaaccaggagaagcacttctacaccttcaccaacgagcaccacagagagacctacgtggagcaggagcagggcgagaacgccaacgacagaaacgacagagccatcagagtggccgccaagtggtacaacgagcacctgaagaagatgagcgccgacaaccagctgcaggtgatcttcatcaccaacgacagaagaaacaaggagaaggccatcgaggagggcatccccgccttcacctgcgaggagtacgtgaagagcctgaccgccaaccccgagctgatcgacagactggcctgcctgagcgaggagggcaacgagatcgagagcggcaagatcatcttcagcgagcacctgcccctgagcaagctgcagcagggcatcaagagcggcacctacctgcagggcaccttcagagccagcagagagaactacctggaggccaccgtgtggatccacggcgacaacgaggagaacaaggagatcatcctgcagggcctgaagcacctgaacagagccgtgcacgaggacatcgtggccgtggagctgctgcccaagagccagtgggtggcccccagcagcgtggtgctgcacgacgagggccagaacgaggaggacgtggagaaggaggaggagaccgagagaatgctgaagaccgccgtgagcgagaagatgctgaagcccaccggcagagtggtgggcatcatcaagagaaactggagaccctactgcggcatgctgagcaagagcgacatcaaggagagcagaagacacctgttcacccccgccgacaagagaatccccagaatcagaatcgagaccagacaggccagcaccctggagggcagaagaatcatcgtggccatcgacggctggcccagaaacagcagataccccaacggccacttcgtgagaaacctgggcgacgtgggcgagaaggagaccgagaccgaggtgctgctgctggagcacgacgtgccccaccagcccttcagccaggccgtgctgagcttcctgcccaagatgccctggagcatcaccgagaaggacatgaagaacagagaggacctgagacacctgtgcatctgcagcgtggacccccccggctgcaccgacatcgacgacgccctgcactgcagagagctggagaacggcaacctggaggtgggcgtgcacatcgccgacgtgagccacttcatcagacccggcaacgccctggaccaggagagcgccagaagaggcaccaccgtgtacctgtgcgagaagagaatcgacatggtgcccgagctgctgagcagcaacctgtgcagcctgaagtgcgacgtggacagactggccttcagctgcatctgggagatgaaccacaacgccgagatcctgaagaccaagttcaccaagagcgtgatcaacagcaaggccagcctgacctacgccgaggcccagctgagaatcgacagcgccaacatgaacgacgacatcaccaccagcctgagaggcctgaacaagctggccaagatcctgaagaagagaagaatcgagaagggcgccctgaccctgagcagccccgaggtgagattccacatggacagcgagacccacgaccccatcgacctgcagaccaaggagctgagagagaccaacagcatggtggaggagttcatgctgctggccaacatcagcgtggccaagaagatccacgaggagttcagcgagcacgccctgctgagaaagcaccccgcccccccccccagcaactacgagatcctggtgaaggccgccagaagcagaaacctggagatcaagaccgacaccgccaagagcctggccgagagcctggaccaggccgagagccccaccttcccctacctgaacaccctgctgagaatcctggccaccagatgcatgatgcaggccgtgtacttctgcagcggcatggacaacgacttccaccactacggcctggccagccccatctacacccacttcaccagccccatcagaagatacgccgacgtgatcgtgcacagactgctggccgtggccatcggcgccgactgcacctaccccgagctgaccgacaagcacaagctggccgacatctgcaagaacctgaacttcagacacaagatggcccagtacgcccagagagccagcgtggccttccacacccagctgttcttcaagagcaagggcatcgtgagcgaggaggcctacatcctgttcgtgagaaagaacgccatcgtggtgctgatccccaagtacggcctggagggcaccgtgttcttcgaggagaaggacaagcccaacccccagctgatctacgacgacgagatccccagcctgaagatcgaggacaccgtgttccacgtgttcgacaaggtgaaggtgaagatcatgctggacagcagcaacctgcagcaccagaagatcagaatgagcctggtggagccccagatccccggcatcagcatccccaccgacaccagcaacatggacctgaacggccccaagaagaagaagatgaagctgggcaagtag

SEQ ID NO: 79310 - DNA, 2391 bp, Artificial Sequence
  Description of Artificial Sequence: Synthetic coding sequence
atgagcgccgacaaccagctgcaggtgatcttcatcaccaacgacagaagaaacaaggagaaggccatcgaggagggcatccccgccttcacctgcgaggagtacgtgaagagcctgaccgccaaccccgagctgatcgacagactggcctgcctgagcgaggagggcaacgagatcgagagcggcaagatcatcttcagcgagcacctgcccctgagcaagctgcagcagggcatcaagagcggcacctacctgcagggcaccttcagagccagcagagagaactacctggaggccaccgtgtggatccacggcgacaacgaggagaacaaggagatcatcctgcagggcctgaagcacctgaacagagccgtgcacgaggacatcgtggccgtggagctgctgcccaagagccagtgggtggcccccagcagcgtggtgctgcacgacgagggccagaacgaggaggacgtggagaaggaggaggagaccgagagaatgctgaagaccgccgtgagcgagaagatgctgaagcccaccggcagagtggtgggcatcatcaagagaaactggagaccctactgcggcatgctgagcaagagcgacatcaaggagagcagaagacacctgttcacccccgccgacaagagaatccccagaatcagaatcgagaccagacaggccagcaccctggagggcagaagaatcatcgtggccatcgacggctggcccagaaacagcagataccccaacggccacttcgtgagaaacctgggcgacgtgggcgagaaggagaccgagaccgaggtgctgctgctggagcacgacgtgccccaccagcccttcagccaggccgtgctgagcttcctgcccaagatgccctggagcatcaccgagaaggacatgaagaacagagaggacctgagacacctgtgcatctgcagcgtggacccccccggctgcaccgacatcgacgacgccctgcactgcagagagctggagaacggcaacctggaggtgggcgtgcacatcgccgacgtgagccacttcatcagacccggcaacgccctggaccaggagagcgccagaagaggcaccaccgtgtacctgtgcgagaagagaatcgacatggtgcccgagctgctgagcagcaacctgtgcagcctgaagtgcgacgtggacagactggccttcagctgcatctgggagatgaaccacaacgccgagatcctgaagaccaagttcaccaagagcgtgatcaacagcaaggccagcctgacctacgccgaggcccagctgagaatcgacagcgccaacatgaacgacgacatcaccaccagcctgagaggcctgaacaagctggccaagatcctgaagaagagaagaatcgagaagggcgccctgaccctgagcagccccgaggtgagattccacatggacagcgagacccacgaccccatcgacctgcagaccaaggagctgagagagaccaacagcatggtggaggagttcatgctgctggccaacatcagcgtggccaagaagatccacgaggagttcagcgagcacgccctgctgagaaagcaccccgcccccccccccagcaactacgagatcctggtgaaggccgccagaagcagaaacctggagatcaagaccgacaccgccaagagcctggccgagagcctggaccaggccgagagccccaccttcccctacctgaacaccctgctgagaatcctggccaccagatgcatgatgcaggccgtgtacttctgcagcggcatggacaacgacttccaccactacggcctggccagccccatctacacccacttcaccagccccatcagaagatacgccgacgtgatcgtgcacagactgctggccgtggccatcggcgccgactgcacctaccccgagctgaccgacaagcacaagctggccgacatctgcaagaacctgaacttcagacacaagatggcccagtacgcccagagagccagcgtggccttccacacccagctgttcttcaagagcaagggcatcgtgagcgaggaggcctacatcctgttcgtgagaaagaacgccatcgtggtgctgatccccaagtacggcctggagggcaccgtgttcttcgaggagaaggacaagcccaacccccagctgatctacgacgacgagatccccagcctgaagatcgaggacaccgtgttccacgtgttcgacaaggtgaaggtgaagatcatgctggacagcagcaacctgcagcaccagaagatcagaatgagcctggtggagccccagatccccggcatcagcatccccaccgacaccagcaacatggacctgaacggccccaagaagaagaagatgaagctgggcaagtag

SEQ ID NO: 79311 - DNA, 2787 bp, Artificial Sequence
  Description of Artificial Sequence: Synthetic coding sequence
atgctgaagagcaagaccttcctgaagaagaccagagccggcggcgtgatgaagatcgtgagagagcactacctgagagacgacatcggctgcggcgcccccggctgcgccgcctgcggcggcgcccacgagggccccgccctggagccccagccccaggaccccgccagcagcgtgtgcccccagccccactacctgctgcccgacaccaacgtgctgctgcaccagatcgtgagcgcctggagacccggcacctgggccagcgtggccagcagcctgagactgcccggcagcctggagacctacgtggagcaggagcagggcgagaacgccaacgacagaaacgacagagccatcagagtggccgccaagtggtacaacgagcacctgaagaagatgagcgccgacaaccagctgcaggtgatcttcatcaccaacgacagaagaaacaaggagaaggccatcgaggagggcatccccgccttcacctgcgaggagtacgtgaagagcctgaccgccaaccccgagctgatcgacagactggcctgcctgagcgaggagggcaacgagatcgagagcggcaagatcatcttcagcgagcacctgcccctgagcaagctgcagcagggcatcaagagcggcacctacctgcagggcaccttcagagccagcagagagaactacctggaggccaccgtgtggatccacggcgacaacgaggagaacaaggagatcatcctgcagggcctgaagcacctgaacagagccgtgcacgaggacatcgtggccgtggagctgctgcccaagagccagtgggtggcccccagcagcgtggtgctgcacgacgagggccagaacgaggaggacgtggagaaggaggaggagaccgagagaatgctgaagaccgccgtgagcgagaagatgctgaagcccaccggcagagtggtgggcatcatcaagagaaactggagaccctactgcggcatgctgagcaagagcgacatcaaggagagcagaagacacctgttcacccccgccgacaagagaatccccagaatcagaatcgagaccagacaggccagcaccctggagggcagaagaatcatcgtggccatcgacggctggcccagaaacagcagataccccaacggccacttcgtgagaaacctgggcgacgtgggcgagaaggagaccgagaccgaggtgctgctgctggagcacgacgtgccccaccagcccttcagccaggccgtgctgagcttcctgcccaagatgccctggagcatcaccgagaaggacatgaagaacagagaggacctgagacacctgtgcatctgcagcgtggacccccccggctgcaccgacatcgacgacgccctgcactgcagagagctggagaacggcaacctggaggtgggcgtgcacatcgccgacgtgagccacttcatcagacccggcaacgccctggaccaggagagcgccagaagaggcaccaccgtgtacctgtgcgagaagagaatcgacatggtgcccgagctgctgagcagcaacctgtgcagcctgaagtgcgacgtggacagactggccttcagctgcatctgggagatgaaccacaacgccgagatcctgaagaccaagttcaccaagagcgtgatcaacagcaaggccagcctgacctacgccgaggcccagctgagaatcgacagcgccaacatgaacgacgacatcaccaccagcctgagaggcctgaacaagctggccaagatcctgaagaagagaagaatcgagaagggcgccctgaccctgagcagccccgaggtgagattccacatggacagcgagacccacgaccccatcgacctgcagaccaaggagctgagagagaccaacagcatggtggaggagttcatgctgctggccaacatcagcgtggccaagaagatccacgaggagttcagcgagcacgccctgctgagaaagcaccccgcccccccccccagcaactacgagatcctggtgaaggccgccagaagcagaaacctggagatcaagaccgacaccgccaagagcctggccgagagcctggaccaggccgagagccccaccttcccctacctgaacaccctgctgagaatcctggccaccagatgcatgatgcaggccgtgtacttctgcagcggcatggacaacgacttccaccactacggcctggccagccccatctacacccacttcaccagccccatcagaagatacgccgacgtgatcgtgcacagactgctggccgtggccatcggcgccgactgcacctaccccgagctgaccgacaagcacaagctggccgacatctgcaagaacctgaacttcagacacaagatggcccagtacgcccagagagccagcgtggccttccacacccagctgttcttcaagagcaagggcatcgtgagcgaggaggcctacatcctgttcgtgagaaagaacgccatcgtggtgctgatccccaagtacggcctggagggcaccgtgttcttcgaggagaaggacaagcccaacccccagctgatctacgacgacgagatccccagcctgaagatcgaggacaccgtgttccacgtgttcgacaaggtgaaggtgaagatcatgctggacagcagcaacctgcagcaccagaagatcagaatgagcctggtggagccccagatccccggcatcagcatccccaccgacaccagcaacatggacctgaacggccccaagaagaagaagatgaagctgggcaagtag

SEQ ID NO: 79312 - DNA, 2916 bp, Artificial Sequence
  Description of Artificial Sequence: Synthetic coding sequence
atgcagaccgcctgccaggccgtgcagcaccagagaggcagaagacagtacaacaagctgagaaacctgctgaaggacgccagacacgactgcatcctgttcgccaacgagttccagcagtgctgctacctgcccagagagagaggcgagagcatggagaagtggcagaccagaagcatctacaacgccgccgtgtggtactaccaccactgccaggacagaatgcccatcgtgatggtgaccgaggacgaggaggccatccagcagtacggcagcgagaccgagggcgtgttcgtgatcaccttcaagaactacctggacaacttctggcccgacctgaaggccgcccacgagctgtgcgacagcatcctgcagagcagaagagagagagagaacgagagccaggagagccacggcaaggagtaccccgagcacctgcccctggaggtgctggaggccggcatcaagagcggcagatacatccagggcatcctgaacgtgaacaagcacagagcccagatcgaggccttcgtgagactgcagggcgccagcagcaaggacagcgacctggtgagcgacatcctgatccacggcatgaaggccagaaacagaagcatccacggcgacgtggtggtggtggagctgctgcccaagaacgagtggaagggcagaaccgtggccctgtgcgagaacgactgcgacgacaaggccagcggcgagagccccagcgagcccatgcccaccggcagagtggtgggcatcctgcagaagaactggagagactacgtggtgaccttccccagcaaggaggaggtgcagagccagggcaagaacgcccagaagatcctggtgaccccctgggactacagaatccccaagatcagaatcagcacccagcaggccgagaccctgcaggacttcagagtggtggtgagaatcgacagctgggagagcaccagcgtgtaccccaacggccacttcgtgagagtgctgggcagaatcggcgacctggagggcgagatcgccaccatcctggtggagaacagcatcagcgtgatccccttcagcgaggcccagatgtgcgagatgcccgtgaacacccccgagagcccctggaaggtgagccccgaggaggagcagaagagaaaggacctgagaaagagccacctggtgttcagcatcgaccccaagggctgcgaggacgtggacgacaccctgagcgtgagaaccctgaacaacggcaacctggagctgggcgtgcacatcgccgacgtgacccacttcgtggcccccaacagctacatcgacatcgaggccagaaccagagccaccacctactacctggccgacagaagatacgacatgctgcccagcgtgctgagcgccgacctgtgcagcctgctgggcggcgtggacagatacgccgtgagcatcatgtgggagctggacaaggccagctacgagatcaagaaggtgtggtacggcagaaccatcatcagaagcgcctacaagctgttctacgaggccgcccaggagctgctggacggcaacctgagcgtggtggacgacatccccgagttcaaggacctggacgagaagagcagacaggccaagctggaggagctggtgtgggccatcggcaagctgaccgacatcgccagacacgtgagagccaagagagacggctgcggcgccctggagctggagggcgtggaggtgtgcgtgcagctggacgacaagaagaacatccacgacctgatccccaagcagcccctggaggtgcacgagaccgtggccgagtgcatgatcctggccaaccactgggtggccaagaagatctgggagagcttcccccaccaggccctgctgagacagcacccccccccccaccaggagttcttcagcgagctgagagagtgcgccaaggccaagggcttcttcatcgacaccagaagcaacaagaccctggccgacagcctggacaacgccaacgacccccacgaccccatcgtgaacagactgctgagaagcatggccacccaggccatgagcaacgccctgtacttcagcaccggcagctgcgccgaggaggagttccaccactacggcctggccctggacaagtacacccacttcaccagccccatcagaagatacagcgacatcgtggtgcacagactgctgatggccgccatcagcaaggacaagaagatggagatcaagggcaacctgttcagcaacaaggacctggaggagctgtgcagacacatcaacaacagaaaccaggccgcccagcacagccagaagcagagcaccgagctgttccagtgcatgtacttcaaggacaaggaccccgccaccgaggagagatgcatcagcgacggcgtgatctacagcatcagaaccaacggcgtgctgctgttcatccccagattcggcatcaagggcgccgcctacctgaagaacaaggacggcctggtgatcagctgcggccccgacagctgcagcgagtggaagcccggcagcctgcagagattccagaacaagatcaccagcaccaccaccgacggcgagagcgtgaccttccacctgttcgaccacgtgaccgtgagaatcagcatccaggccagcagatgccacagcgacaccatcagactggagatcatcagcaacaagccctacaagatccccaacaccgagctgatccaccagagcagccccctgctgaagagcgagctggtgaaggaggtgaccaagagcgtggaggaggcccagctggcccaggaggtgaaggtgaacatcatccaggaggagtaccaggagtacagacagaccaagggcagaagcctgtacaccctgctggaggagatcagagacctggccctgctggacgtgagcaacaactacggcatctag

SEQ ID NO: 79313 - DNA, 3165 bp, Artificial Sequence
  Description of Artificial Sequence: Synthetic coding sequence
atgctgcagaagagagagaaggtgctgctgctgagaaccttccagggcagaaccctgagaatcgtgagagagcactacctgagaccctgcgtgccctgccacagccccctgtgcccccagcccgccgcctgcagccacgacggcaagctgctgagcagcgacgtgacccactacgtgatccccgactggaaggtggtgcaggactacctggagatcctggagttccccgagctgaagggcatcatcttcatgcagaccgcctgccaggccgtgcagcaccagagaggcagaagacagtacaacaagctgagaaacctgctgaaggacgccagacacgactgcatcctgttcgccaacgagttccagcagtgctgctacctgcccagagagagaggcgagagcatggagaagtggcagaccagaagcatctacaacgccgccgtgtggtactaccaccactgccaggacagaatgcccatcgtgatggtgaccgaggacgaggaggccatccagcagtacggcagcgagaccgagggcgtgttcgtgatcaccttcaagaactacctggacaacttctggcccgacctgaaggccgcccacgagctgtgcgacagcatcctgcagagcagaagagagagagagaacgagagccaggagagccacggcaaggagtaccccgagcacctgcccctggaggtgctggaggccggcatcaagagcggcagatacatccagggcatcctgaacgtgaacaagcacagagcccagatcgaggccttcgtgagactgcagggcgccagcagcaaggacagcgacctggtgagcgacatcctgatccacggcatgaaggccagaaacagaagcatccacggcgacgtggtggtggtggagctgctgcccaagaacgagtggaagggcagaaccgtggccctgtgcgagaacgactgcgacgacaaggccagcggcgagagccccagcgagcccatgcccaccggcagagtggtgggcatcctgcagaagaactggagagactacgtggtgaccttccccagcaaggaggaggtgcagagccagggcaagaacgcccagaagatcctggtgaccccctgggactacagaatccccaagatcagaatcagcacccagcaggccgagaccctgcaggacttcagagtggtggtgagaatcgacagctgggagagcaccagcgtgtaccccaacggccacttcgtgagagtgctgggcagaatcggcgacctggagggcgagatcgccaccatcctggtggagaacagcatcagcgtgatccccttcagcgaggcccagatgtgcgagatgcccgtgaacacccccgagagcccctggaaggtgagccccgaggaggagcagaagagaaaggacctgagaaagagccacctggtgttcagcatcgaccccaagggctgcgaggacgtggacgacaccctgagcgtgagaaccctgaacaacggcaacctggagctgggcgtgcacatcgccgacgtgacccacttcgtggcccccaacagctacatcgacatcgaggccagaaccagagccaccacctactacctggccgacagaagatacgacatgctgcccagcgtgctgagcgccgacctgtgcagcctgctgggcggcgtggacagatacgccgtgagcatcatgtgggagctggacaaggccagctacgagatcaagaaggtgtggtacggcagaaccatcatcagaagcgcctacaagctgttctacgaggccgcccaggagctgctggacggcaacctgagcgtggtggacgacatccccgagttcaaggacctggacgagaagagcagacaggccaagctggaggagctggtgtgggccatcggcaagctgaccgacatcgccagacacgtgagagccaagagagacggctgcggcgccctggagctggagggcgtggaggtgtgcgtgcagctggacgacaagaagaacatccacgacctgatccccaagcagcccctggaggtgcacgagaccgtggccgagtgcatgatcctggccaaccactgggtggccaagaagatctgggagagcttcccccaccaggccctgctgagacagcacccccccccccaccaggagttcttcagcgagctgagagagtgcgccaaggccaagggcttcttcatcgacaccagaagcaacaagaccctggccgacagcctggacaacgccaacgacccccacgaccccatcgtgaacagactgctgagaagcatggccacccaggccatgagcaacgccctgtacttcagcaccggcagctgcgccgaggaggagttccaccactacggcctggccctggacaagtacacccacttcaccagccccatcagaagatacagcgacatcgtggtgcacagactgctgatggccgccatcagcaaggacaagaagatggagatcaagggcaacctgttcagcaacaaggacctggaggagctgtgcagacacatcaacaacagaaaccaggccgcccagcacagccagaagcagagcaccgagctgttccagtgcatgtacttcaaggacaaggaccccgccaccgaggagagatgcatcagcgacggcgtgatctacagcatcagaaccaacggcgtgctgctgttcatccccagattcggcatcaagggcgccgcctacctgaagaacaaggacggcctggtgatcagctgcggccccgacagctgcagcgagtggaagcccggcagcctgcagagattccagaacaagatcaccagcaccaccaccgacggcgagagcgtgaccttccacctgttcgaccacgtgaccgtgagaatcagcatccaggccagcagatgccacagcgacaccatcagactggagatcatcagcaacaagccctacaagatccccaacaccgagctgatccaccagagcagccccctgctgaagagcgagctggtgaaggaggtgaccaagagcgtggaggaggcccagctggcccaggaggtgaaggtgaacatcatccaggaggagtaccaggagtacagacagaccaagggcagaagcctgtacaccctgctggaggagatcagagacctggccctgctggacgtgagcaacaactacggcatctag

SEQ ID NO: 79314 - DNA, 762 bp, Artificial Sequence
  Description of Artificial Sequence: Synthetic coding sequence
atggagaagtggcagaccagaagcatctacaacgccgccgtgtggtactaccaccactgccaggacagaatgcccatcgtgatggtgaccgaggacgaggaggccatccagcagtacggcagcgagaccgagggcgtgttcgtgatcaccttcaagaactacctggacaacttctggcccgacctgaaggccgcccacgagctgtgcgacagcatcctgcagagcagaagagagagagagaacgagagccaggagagccacggcaaggagtaccccgagcacctgcccctggaggtgctggaggccggcatcaagagcggcagatacatccagggcatcctgaacgtgaacaagcacagagcccagatcgaggccttcgtgagactgcagggcgccagcagcaaggacagcgacctggtgagcgacatcctgatccacggcatgaaggccagaaacagaagcatccacggcgacgtggtggtggtggagctgctgcccaagaacgagtggaagggcagaaccgtggccctgtgcgagaacgactgcgacgacaaggccagcggcgagagccccagcgagcccatgcccaccggcctgcagggcggcagagcccacagattcctgggcgtgaacatctgcgtgagcaagtggaccttctgcgcctgcttcagaaagaacagaagaagcggcagaggcaactgcaaccaccccggcggcaagcagtacttcagctacagcttcctgagaagcagcgacgtgtag

SEQ ID NO: 79315 - DNA, 453 bp, Artificial Sequence
  Description of Artificial Sequence: Synthetic coding sequence
atggagaagtggcagaccagaagcatctacaacgccgccgtgtggtactaccaccactgccaggacagaatgcccatcgtgatggtgaccgaggacgaggaggccatccagcagtacggcagcgagaccgagggcgtgttcgtgatcaccttcaagaactacctggacaacttctggcccgacctgaaggccgcccacgagctgtgcgacagcatcctgcagagcagaagagagagagagaacgagagccaggagagccacggcaaggagtaccccgagcacctgcccctggaggtgctggaggccggcatcaagagcggcagatacatccagggcatcctgaacgtgaacaagcacagagcccagatcgaggccttcgtgagactgcagggcgccagcagcaaggacagcgacctggtgagcgacatcctgatccacggcatgaaggcctag

SEQ ID NO: 79316 - DNA, 174 bp, Artificial Sequence
  Description of Artificial Sequence: Synthetic coding sequence
atgcagaccgcctgccaggccgtgcagcaccagagaggcagaagacagtacaacaagctgagaaacctgctgaaggacgccagacacgactgcatcctgttcgccaacgagttccagcagtgctgctacctgcccagagagagaggcgagagcatggagaagtggcagacctag

SEQ ID NO: 79317 - DNA, 294 bp, Artificial Sequence
  Description of Artificial Sequence: Synthetic coding sequence
atgcagaccgcctgccaggccgtgcagcaccagagaggcagaagacagtacaacaagctgagaaacctgctgaaggacgccagacacgactgcatcctgttcgccaacgagttccagcagtgctgctacctgcccagagagagaggcgagagcatggagaagtggcagaccagaagcatctacaacgccgccgtgtggtactaccaccactgccaggacagaatgcccatcgtgatggtgaccgaggacgaggaggccatccagcagtacggcagcgagaccgagggcgtgtag

SEQ ID NO: 79318 - DNA, 312 bp, Artificial Sequence
  Description of Artificial Sequence: Synthetic coding sequence
atgcagaccgcctgccaggccgtgcagcaccagagaggcagaagacagtacaacaagctgagaaacctgctgaaggacgccagacacgactgcatcctgttcgccaacgagttccagcagtgctgctacctgcccagagagagaggcgagagcatggagaagtggcagaccagaagcatctacaacgccgccgtgtggtactaccaccactgccaggacagaatgcccatcgtgatggtgaccgaggacgaggaggccatccagcagtacggcagcgagaccgagggcgtgttcgtgatcaccttcaagtag

SEQ ID NO: 79319 - DNA, 1812 bp, Artificial Sequence
  Description of Artificial Sequence: Synthetic coding sequence
atgagccaccccgactacagaatgaacctgagacccctgggcacccccagaggcgtgagcgccgtggccggcccccacgacatcggcgccagccccggcgacaagaagagcaagaacagaagcaccagaggcaagaagaagagcatcttcgagacctacatgagcaaggaggacgtgagcgagggcctgaagagaggcaccctgatccagggcgtgctgagaatcaaccccaagaagttccacgaggccttcatccccagccccgacggcgacagagacatcttcatcgacggcgtggtggccagaaacagagccctgaacggcgacctggtggtggtgaagctgctgcccgaggagcactggaaggtggtgaagcccgagagcaacgacaaggagaccgaggccgcctacgagagcgacatccccgaggagctgtgcggccaccacctgccccagcagagcctgaagagctacaacgacagccccgacgtgatcgtggaggcccagttcgacggcagcgacagcgaggacggccacggcatcacccagaacgtgctggtggacggcgtgaagaagctgagcgtgtgcgtgagcgagaagggcagagaggacggcgacgcccccgtgaccaaggacgagaccacctgcatcagccaggacaccagagccctgagcgagaagagcctgcagagaagcgccaaggtggtgtacatcctggagaagaagcacagcagagccgccaccggcttcctgaagctgctggccgacaagaacagcgagctgttcagaaagtacgccctgttcagccccagcgaccacagagtgcccagaatctacgtgcccctgaaggactgcccccaggacttcgtggccagacccaaggactacgccaacaccctgttcatctgcagaatcgtggactggaaggaggactgcaacttcgccctgggccagctggccaagagcctgggccaggccggcgagatcgagcccgagaccgagggcatcctgaccgagtacggcgtggacttcagcgacttcagcagcgaggtgctggagtgcctgccccagggcctgccctggaccatcccccccgaggagttcagcaagagaagagacctgagaaaggactgcatcttcaccatcgaccccagcaccgccagagacctggacgacgccctgagctgcaagcccctggccgacggcaacttcaaggtgggcgtgcacatcgccgacgtgagctacttcgtgcccgagggcagcgacctggacaaggtggccgccgagagagccaccagcgtgtacctggtgcagaaggtggtgcccatgctgcccagactgctgtgcgaggagctgtgcagcctgaaccccatgagcgacaagctgaccttcagcgtgatctggaccctgacccccgagggcaagatcctggacgagtggttcggcagaaccatcatcagaagctgcaccaagctgagctacgagcacgcccagagcatgatcgagagccccaccgagaagatccccgccaaggagctgccccccatcagccccgagcacagcagcgaggaggtgcaccagcagaacgccgacaaggacggcgccgcccacctgcaggccagccacagccccagcgccgaggacgccgaggcccagcccagcaccgaggagagactgcccgagaccagaggcatctgcgacagagaccccgacaccagactgttcttcctgcagcagcagagcagagtgctggaggccaagccccagaacaccatcagagtggaggagcagaccacccagctgcagatctag

SEQ ID NO: 79320 - DNA, 2658 bp, Artificial Sequence
  Description of Artificial Sequence: Synthetic coding sequence
atgagccaccccgactacagaatgaacctgagacccctgggcacccccagaggcgtgagcgccgtggccggcccccacgacatcggcgccagccccggcgacaagaagagcaagaacagaagcaccagaggcaagaagaagagcatcttcgagacctacatgagcaaggaggacgtgagcgagggcctgaagagaggcaccctgatccagggcgtgctgagaatcaaccccaagaagttccacgaggccttcatccccagccccgacggcgacagagacatcttcatcgacggcgtggtggccagaaacagagccctgaacggcgacctggtggtggtgaagctgctgcccgaggagcactggaaggtggtgaagcccgagagcaacgacaaggagaccgaggccgcctacgagagcgacatccccgaggagctgtgcggccaccacctgccccagcagagcctgaagagctacaacgacagccccgacgtgatcgtggaggcccagttcgacggcagcgacagcgaggacggccacggcatcacccagaacgtgctggtggacggcgtgaagaagctgagcgtgtgcgtgagcgagaagggcagagaggacggcgacgcccccgtgaccaaggacgagaccacctgcatcagccaggacaccagagccctgagcgagaagagcctgcagagaagcgccaaggtggtgtacatcctggagaagaagcacagcagagccgccaccggcttcctgaagctgctggccgacaagaacagcgagctgttcagaaagtacgccctgttcagccccagcgaccacagagtgcccagaatctacgtgcccctgaaggactgcccccaggacttcgtggccagacccaaggactacgccaacaccctgttcatctgcagaatcgtggactggaaggaggactgcaacttcgccctgggccagctggccaagagcctgggccaggccggcgagatcgagcccgagaccgagggcatcctgaccgagtacggcgtggacttcagcgacttcagcagcgaggtgctggagtgcctgccccagggcctgccctggaccatcccccccgaggagttcagcaagagaagagacctgagaaaggactgcatcttcaccatcgaccccagcaccgccagagacctggacgacgccctgagctgcaagcccctggccgacggcaacttcaaggtgggcgtgcacatcgccgacgtgagctacttcgtgcccgagggcagcgacctggacaaggtggccgccgagagagccaccagcgtgtacctggtgcagaaggtggtgcccatgctgcccagactgctgtgcgaggagctgtgcagcctgaaccccatgagcgacaagctgaccttcagcgtgatctggaccctgacccccgagggcaagatcctggacgagtggttcggcagaaccatcatcagaagctgcaccaagctgagctacgagcacgcccagagcatgatcgagagccccaccgagaagatccccgccaaggagctgccccccatcagccccgagcacagcagcgaggaggtgcaccaggccgtgctgaacctgcacggcatcgccaagcagctgagacagcagagattcgtggacggcgccctgagactggaccagctgaagctggccttcaccctggaccacgagaccggcctgccccagggctgccacatctacgagtacagagagagcaacaagctggtggaggagttcatgctgctggccaacatggccgtggcccacaagatccacagagccttccccgagcaggccctgctgagaagacacccccccccccagaccagaatgctgagcgacctggtggagttctgcgaccagatgggcctgcccgtggacttcagcagcgccggcgccctgaacaagagcctgacccagaccttcggcgacgacaagtacagcctggccagaaaggaggtgctgaccaacatgtgcagcagacccatgcagatggccctgtacttctgcagcggcctgctgcaggaccccgcccagttcagacactacgccctgaacgtgcccctgtacacccacttcaccagccccatcagaagattcgccgacgtgctggtgcacagactgctggccgccgccctgggctacagagagagactggacatggcccccgacaccctgcagaagcaggccgaccactgcaacgacagaagaatggccagcaagagagtgcaggagctgagcaccagcctgttcttcgccgtgctggtgaaggagagcggccccctggagagcgaggccatggtgatgggcatcctgaagcaggccttcgacgtgctggtgctgagatacggcgtgcagaagagaatctactgcaacgccctggccctgagaagccaccacttccagaaggtgggcaagaagcccgagctgaccctggtgtgggagcccgaggacatggagcaggagcccgcccagcaggtgatcaccatcttcagcctggtggaggtggtgctgcaggccgagagcaccgccctgaagtacagcgccatcctgaagagacccggcacccagggccacctgggccccgagaaggaggaggaggagagcgacggcgagcccgaggacagcagcaccagctag

SEQ ID NO: 79321 - DNA, 1071 bp, Artificial Sequence
  Description of Artificial Sequence: Synthetic coding sequence
atgagccaccccgactacagaatgaacctgagacccctgggcacccccagaggcgtgagcgccgtggccggcccccacgacatcggcgccagccccggcgacaagaagagcaagaacagaagcaccagaggcaagaagaagagcatcttcgagacctacatgagcaaggaggacgtgagcgagggcctgaagagaggcaccctgatccagggcgtgctgagaatcaaccccaagaagttccacgaggccttcatccccagccccgacggcgacagagacatcttcatcgacggcgtggtggccagaaacagagccctgaacggcgacctggtggtggtgaagctgctgcccgaggagcactggaaggtggtgaagcccgagagcaacgacaaggagaccgaggccgcctacgagagcgacatccccgaggagctgtgcggccaccacctgccccagcagagcctgaagagctacaacgacagccccgacgtgatcgtggaggcccagttcgacggcagcgacagcgaggacggccacggcatcacccagaacgtgctggtggacggcgtgaagaagctgagcgtgtgcgtgagcgagaaggacaacgagatcgaggcccagagaagcagctgggcctaccccgtgagccacagaaagagcgaggagagaatggtgatgcacagactgcagaagatgagaccccccgccttccacaagacccaggagctgtacagaagaaacccctgcaaggaccagcagagatggttcaccagctggagaaagaacatcctggagcagcagcccgccagcagcaacagctggctgatcagaaccgccaactgcctgggcaacaccccctgcttcctgccccagaccaccgagtgcctggagttcatgtgcctgagcagaaccgtgcccagaaccctgtggcacggcctgaagatcatgcccacccactgcagcagcgccgccctgtggaccggcagaagaaccgccatcctgccctggggcagctggctgagagtgctgggcagactggtgaagctgagcctgaagcagaaggagtactag

SEQ ID NO: 79322 - DNA, 2658 bp, Artificial Sequence; identical to SEQ ID NO: 79320
  Description of Artificial Sequence: Synthetic coding sequence

SEQ ID NO: 79323 - DNA, 750 bp, Artificial Sequence
  Description of Artificial Sequence: Synthetic coding sequence
atgagccaccccgactacagaatgaacctgagacccctgggcacccccagaggcgtgagcgccgtggccggcccccacgacatcggcgccagccccggcgacaagaagagcaagaacagaagcaccagaggcaagaagaagagcatcttcgagacctacatgagcaaggaggacgtgagcgagggcctgaagagaggcaccctgatccagggcgtgctgagaatcaaccccaagaagttccacgaggccttcatccccagccccgacggcgacagagacatcttcatcgacggcgtggtggccagaaacagagccctgaacggcgacctggtggtggtgaagctgctgcccgaggagcactggaaggtggtgaagcccgagagcaacgacaaggagaccgaggccgcctacgagagcgacatccccgaggagctgtgcggccaccacctgccccagcagagcctgaagagctacaacgacagccccgacgtgatcgtggaggcccagttcgacggcagcgacagcgaggacggccacggcatcacccagaacgtgctggtggacggcgtgaagaagctgagcgtgtgcgtgagcgagaagggcagagaggacggcgacgcccccgtgaccaaggacgagaccacctgcatcagccaggacaccagagccctgagcgagaagagcctgcagagaagcgccaaggtgatcgcctacagattcagccccagagtgcagatggccttcacctag

SEQ ID NO: 79324 - DNA, 2028 bp, Artificial Sequence
  Description of Artificial Sequence: Synthetic coding sequence
atgagccaccccgactacagaatgaacctgagacccctgggcacccccagaggcgtgagcgccgtggccggcccccacgacatcggcgccagccccggcgacaagaagagcaagaacagaagcaccagaggcaagaagaagagcatcttcgagacctacatgagcaaggaggacgtgagcgagggcctgaagagaggcaccctgatccagggcgtgctgagaatcaaccccaagaagttccacgaggccttcatccccagccccgacggcgacagagacatcttcatcgacggcgtggtggccagaaacagagccctgaacggcgacctggtggtggtgaagctgctgcccgaggagcactggaaggtggtgaagcccgagagcaacgacaaggagaccgaggccgcctacgagagcgacatccccgaggagctgtgcggccaccacctgccccagcagagcctgaagagctacaacgacagccccgacgtgatcgtggaggcccagttcgacggcagcgacagcgaggacggccacggcatcacccagaacgtgctggtggacggcgtgaagaagctgagcgtgtgcgtgagcgagaagggcagagaggacggcgacgcccccgtgaccaaggacgagaccacctgcatcagccaggacaccagagccctgagcgagaagagcctgcagagaagcgccaaggtggtgtacatcctggagaagaagcacagcagagccgccaccggcttcctgaagctgctggccgacaagaacagcgagctgttcagaaagtacgccctgttcagccccagcgaccacagagtgcccagaatctacgtgcccctgaaggactgcccccaggacttcgtggccagacccaaggactacgccaacaccctgttcatctgcagaatcgtggactggaaggaggactgcaacttcgccctgggccagctggccaagagcctgggccaggccggcgagatcgagcccgagaccgagggcatcctgaccgagtacggcgtggacttcagcgacttcagcagcgaggtgctggagtgcctgccccagggcctgccctggaccatcccccccgaggagttcagcaagagaagagacctgagaaaggactgcatcttcaccatcgaccccagcaccgccagagacctggacgacgccctgagctgcaagcccctggccgacggcaacttcaaggtgggcgtgcacatcgccgacgtgagctacttcgtgcccgagggcagcgacctggacaaggtggccgccgagagagccaccagcgtgtacctggtgcagaaggtggtgcccatgctgcccagactgctgtgcgaggagctgtgcagcctgaaccccatgagcgacaagctgaccttcagcgtgatctggaccctgacccccgagggcaagatcctggacgagtggttcggcagaaccatcatcagaagctgcaccaagctgagctacgagcacgcccagagcatgatcgagagccccaccgagaagatccccgccaaggagctgccccccatcagccccgagcacagcagcgaggaggtgcaccaggccgtgctgaacctgcacggcatcgccaagcagctgagacagcagagattcgtggacggcgccctgagactggaccagctgaagctggccttcaccctggaccacgagaccggcctgccccagggctgccacatctacgagtacagagagagcaacaagctggtggaggagttcatgctgctggccaacatggccgtggcccacaagatccacagagccttccccgagcaggccctgctgagaagacacccccccccccagaccagaatgctgagcgacctggtggagttctgcgaccagatgggcctgcccgtggacttcagcagcgccggcgccctgaacaagagcctgacccagaccttcggcgacgacaagtacagcctggccagaaaggaggtgctgaccaacatgtgcagcagactgcccgtgcccccccactggctgtag

SEQ ID NO: 79325 - DNA, 435 bp, Artificial Sequence
  Description of Artificial Sequence: Synthetic coding sequence
atgagccaccccgactacagaatgaacctgagacccctgggcacccccagaggcgtgagcgccgtggccggcccccacgacatcggcgccagccccggcgacaagaagagcaagaacagaagcaccagaggcaagaagaagagcatcttcgagacctacatgagcaaggaggacgtgagcgagggcctgaagagaggcaccctgatccagggcgtgctgagaatcaaccccaagaagttccacgaggccttcatccccagccccgacggcgacagagacatcttcatcgacggcgtggtggccagaaacagagccctgaacggcgacctggtggtggtgaagctgctgcccgaggagcactggaaggtggtgaagcccgagagcaacgacaaggagaccgaggccgcctacgagagcgacatccccgaggagtag

SEQ ID NO: 79326 - DNA, 1860 bp, Artificial Sequence
  Description of Artificial Sequence: Synthetic coding sequence
atgagccaccccgactacagaatgaacctgagacccctgggcacccccagaggcgtgagcgccgtggccggcccccacgacatcggcgccagccccggcgacaagaagagcaagaacagaagcaccagaggcaagaagaagagcatcttcgagacctacatgagcaaggaggacgtgagcgagggcctgaagagaggcaccctgatccagggcgtgctgagaatcaaccccaagaagttccacgaggccttcatccccagccccgacggcgacagagacatcttcatcgacggcgtggtggccagaaacagagccctgaacggcgacctggtggtggtgaagctgctgcccgaggagcactggaaggtggtgaagcccgagagcaacgacaaggagaccgaggccgcctacgagagcgacatccccgaggagctgtgcggccaccacctgccccagcagagcctgaagagctacaacgacagccccgacgtgatcgtggaggcccagttcgacggcagcgacagcgaggacggccacggcatcacccagaacgtgctggtggacggcgtgaagaagctgagcgtgtgcgtgagcgagaagggcagagaggacggcgacgcccccgtgaccaaggacgagaccacctgcatcagccaggacaccagagccctgagcgagaagagcctgcagagaagcgccaaggtggtgtacatcctggagaagaagcacagcagagccgccaccggcttcctgaagctgctggccgacaagaacagcgagctgttcagaaagtacgccctgttcagccccagcgaccacagagtgcccagaatctacgtgcccctgaaggactgcccccaggacttcgtggccagacccaaggactacgccaacaccctgttcatctgcagaatcgtggactggaaggaggactgcaacttcgccctgggccagctggccaagagcctgggccaggccggcgagatcgagcccgagaccgagggcatcctgaccgagtacggcgtggacttcagcgacttcagcagcgaggtgctggagtgcctgccccagggcctgccctggaccatcccccccgaggagttcagcaagagaagagacctgagaaaggactgcatcttcaccatcgaccccagcaccgccagagacctggacgacgccctgagctgcaagcccctggccgacggcaacttcaaggtgggcgtgcacatcgccgacgtgagctacttcgtgcccgagggcagcgacctggacaaggtggccgccgagagagccaccagcgtgtacctggtgcagaaggtggtgcccatgctgcccagactgctgtgcgaggagctgtgcagcctgaaccccatgagcgacaagctgaccttcagcgtgatctggaccctgacccccgagggcaagatcctggacgagtggttcggcagaaccatcatcagaagctgcaccaagctgagctacgagcacgcccagagcatgatcgagagccccaccgagaagatccccgccaaggagctgccccccatcagccccgagcacagcagcgaggaggtgcaccaggccgtgctgaacctgcacggcatcgccaagcagctgagacagcagagattcgtggacggcgccctgagactggaccagctgaagctggccttcaccctggaccacgagaccggcctgccccagggctgccacatctacgagtacagagagagcaacaagccctgctgcgccggcacccccagacccaagcagggctgcagcgtgacctggtggaacagcgccaccagatggggctgcccctggaccagcgccccccaggagcccagcatgaaggcctag

SEQ ID NO: 79327 - DNA, 615 bp, Artificial Sequence
  Description of Artificial Sequence: Synthetic coding sequence
atgagcaccgagaccgagctgcaggtggccgtgaagaccagcgccaagaaggacagcagaaagaagggccaggacagaagcgaggccaccctgatcaagagattcaagggcgagggcgtgagatacaaggccaagctgatcggcatcgacgaggtgagcgccgccagaggcgacaagctgtgccaggacagcatgatgaagctgaagggcgtggtggccggcgccagaagcaagggcgagcacaagcagaagatcttcctgaccatcagcttcggcggcatcaagatcttcgacgagaagaccggcgccctgcagcaccaccacgccgtgcacgagatcagctacatcgccaaggacatcaccgaccacagagccttcggctacgtgtgcggcaaggagggcaaccacagattcgtggccatcaagaccgcccaggccgccgagcccgtgatcctggacctgagagacctgttccagctgatctacgagctgaagcagagagaggagctggagaagaaggcccagaaggacaagcagtgcgagcaggccgtgtaccaggtgcccaccagccagaagaaggagggcgtgtacgacgtgcccaagagccagccctag

SEQ ID NO: 79328 - DNA, 642 bp, Artificial Sequence
  Description of Artificial Sequence: Synthetic coding sequence
atgagcaccgagaccgagctgcaggtggccgtgaagaccagcgccaagaaggacagcagaaagaagggccaggacagaagcgaggccaccctgatcaagagattcaagggcgagggcgtgagatacaaggccaagctgatcggcatcgacgaggtgagcgccgccagaggcgacaagctgtgccaggacagcatgatgaagctgaagggcgtggtggccggcgccagaagcaagggcgagcacaagcagaagatcttcctgaccatcagcttcggcggcatcaagatcttcgacgagaagaccggcgccctgcagcaccaccacgccgtgcacgagatcagctacatcgccaaggacatcaccgaccacagagccttcggctacgtgtgcggcaaggagggcaaccacagattcgtggccatcaagaccgcccaggccgccgagcccgtgatcctggacctgagagacctgttccagctgatctacgagctgaagcagagagaggagctggagaagaaggcccagaaggacaagcagtgcgagcaggccgtgtaccagaccatcctggaggaggacgtggaggaccccgtgtaccaggtgatcagcgagaccagcagaggcttcagattcaagagcgactag

SEQ ID NO: 79329 - DNA, 1767 bp, Artificial Sequence
  Description of Artificial Sequence: Synthetic coding sequence
atgagcaccgagaccgagctgcaggtggccgtgaagaccagcgccaagaaggacagcagaaagaagggccaggacagaagcgaggccaccctgatcaagagattcaagggcgagggcgtgagatacaaggccaagctgatcggcatcgacgaggtgagcgccgccagaggcgacaagctgtgccaggacagcatgatgaagctgaagggcgtggtggccggcgccagaagcaagggcgagcacaagcagaagatcttcctgaccatcagcttcggcggcatcaagatcttcgacgagaagaccggcgccctgcagcaccaccacgccgtgcacgagatcagctacatcgccaaggacatcaccgaccacagagccttcggctacgtgtgcggcaaggagggcaaccacagattcgtggccatcaagaccgcccaggccgccgagcccgtgatcctggacctgagagacctgttccagctgatctacgagctgaagcagagagaggagctggagaagaaggcccagaaggacaagcagtgcgagcaggccgtgtaccagaccatcctggaggaggacgtggaggaccccgtgtaccagtacatcgtgttcgaggccggccacgagcccatcagagaccccgagaccgaggagaacatctaccaggtgcccaccagccagaagaaggagggcgtgtacgacgtgcccaagagccagcccgtgagcaacggctacagcttcgaggacttcgaggagagattcgccgccgccacccccaacagaaacctgcccaccgacttcgacgagatcttcgaggccaccaaggccgtgacccagctggagctgttcggcgacatgagcaccccccccgacatcaccagcccccccacccccgccacccccggcgacgccttcatccccagcagcagccagaccctgcccgccagcgccgacgtgttcagcagcgtgcccttcggcaccgccgccgtgcccagcggctacgtggccatgggcgccgtgctgcccagcttctggggccagcagcccctggtgcagcagcagatggtgatgggcgcccagccccccgtggcccaggtgatgcccggcgcccagcccatcgcctggggccagcccggcctgttccccgccacccagcagccctggcccaccgtggccggccagttcccccccgccgccttcatgcccacccagaccgtgatgcccctgcccgccgccatgttccagggccccctgacccccctggccaccgtgcccggcaccagcgacagcaccagaagcagcccccagaccgacaagcccagacagaagatgggcaaggagaccttcaaggacttccagatggcccagcccccccccgtgcccagcagaaagcccgaccagcccagcctgacctgcaccagcgaggccttcagcagctacttcaacaaggtgggcgtggcccaggacaccgacgactgcgacgacttcgacatcagccagctgaacctgacccccgtgaccagcaccacccccagcaccaacagcccccccacccccgcccccagacagagcagccccagcaagagcagcgccagccacgccagcgaccccaccaccgacgacatcttcgaggagggcttcgagagccccagcaagagcgaggagcaggaggcccccgacggcagccaggccagcagcaacagcgaccccttcggcgagcccagcggcgagcccagcggcgacaacatcagcccccaggccggcagctag

SEQ ID NO: 79330 - DNA, 720 bp, Artificial Sequence
  Description of Artificial Sequence: Synthetic coding sequence
atgagcaccgagaccgagctgcaggtggccgtgaagaccagcgccaagaaggacagcagaaagaagggccaggacagaagcgaggccaccctgatcaagagattcaagggcgagggcgtgagatacaaggccaagctgatcggcatcgacgaggtgagcgccgccagaggcgacaagctgtgccaggacagcatgatgaagctgaagggcgtggtggccggcgccagaagcaagggcgagcacaagcagaagatcttcctgaccatcagcttcggcggcatcaagatcttcgacgagaagaccggcgtgcccaccagccagaagaaggagggcgtgtacgacgtgcccaagagccagcccgtgagcaacggctacagcttcgaggacttcgaggagagattcgccgccgccacccccaacagaaacctgcccaccgacttcgacgagatcttcgaggccaccaaggccgtgacccagctggagctgttcggcgacatgagcaccccccccgacatcaccagcccccccacccccgccacccccggcgacgccttcatccccagcagcagccagaccctgcccgccagcgccgacgtgttcagcagcgtgcccttcggcaccgccgccgtgcccagcggctacgtggccatgggcgccgtgctgcccagcttctggggccagcagcccctggtgcagcagcagatggtgatgggcgcctag

SEQ ID NO: 79331 - DNA, 1668 bp, Artificial Sequence
  Description of Artificial Sequence: Synthetic coding sequence
atgagcaccgagaccgagctgcaggtggccgtgaagaccagcgccaagaaggacagcagaaagaagggccaggacagaagcgaggccaccctgatcaagagattcaagggcgagggcgtgagatacaaggccaagctgatcggcatcgacgaggtgagcgccgccagaggcgacaagctgtgccaggacagcatgatgaagctgaagggcgtggtggccggcgccagaagcaagggcgagcacaagcagaagatcttcctgaccatcagcttcggcggcatcaagatcttcgacgagaagaccggcgccctgcagcaccaccacgccgtgcacgagatcagctacatcgccaaggacatcaccgaccacagagccttcggctacgtgtgcggcaaggagggcaaccacagattcgtggccatcaagaccgcccaggccgccgagcccgtgatcctggacctgagagacctgttccagctgatctacgagctgaagcagagagaggagctggagaagaaggcccagaaggacaagcagtgcgagcaggccgtgtaccagaccatcctggaggaggacgtggaggaccccgtgtaccagtacatcgtgttcgaggccggccacgagcccatcagagaccccgagaccgaggagaacatctaccaggtgcccaccagccagaagaaggagggcgtgtacgacgtgcccaagagccagcccgtgagcgccgtgacccagctggagctgttcggcgacatgagcaccccccccgacatcaccagcccccccacccccgccacccccggcgacgccttcatccccagcagcagccagaccctgcccgccagcgccgacgtgttcagcagcgtgcccttcggcaccgccgccgtgcccagcggctacgtggccatgggcgccgtgctgcccagcttctggggccagcagcccctggtgcagcagcagatggtgatgggcgcccagccccccgtggcccaggtgatgcccggcgcccagcccatcgcctggggccagcccggcctgttccccgccacccagcagccctggcccaccgtggccggccagttcccccccgccgccttcatgcccacccagaccgtgatgcccctgcccgccgccatgttccagggccccctgacccccctggccaccgtgcccggcaccagcgacagcaccagaagcagcccccagaccgacaagcccagacagaagatgggcaaggagaccttcaaggacttccagatggcccagcccccccccgtgcccagcagaaagcccgaccagcccagcctgacctgcaccagcgaggccttcagcagctacttcaacaaggtgggcgtggcccaggacaccgacgactgcgacgacttcgacatcagccagctgaacctgacccccgtgaccagcaccacccccagcaccaacagcccccccacccccgcccccagacagagcagccccagcaagagcagcgccagccacgccagcgaccccaccaccgacgacatcttcgaggagggcttcgagagccccagcaagagcgaggagcaggaggcccccgacggcagccaggccagcagcaacagcgaccccttcggcgagcccagcggcgagcccagcggcgacaacatcagcccccaggccggcagctag

SEQ ID NO: 79332 - DNA, 1668 bp, Artificial Sequence; identical to SEQ ID NO: 79331
  Description of Artificial Sequence: Synthetic coding sequence

SEQ ID NO: 79333 - DNA, 1668 bp, Artificial Sequence; identical to SEQ ID NO: 79331
  Description of Artificial Sequence: Synthetic coding sequence

SEQ ID NO: 79334 - DNA, 1614 bp, Artificial Sequence
  Description of Artificial Sequence: Synthetic coding sequence
atgagcaccgagaccgagctgcaggtggccgtgaagaccagcgccaagaaggacagcagaaagaagggccaggacagaagcgaggccaccctgatcaagagattcaagggcgagggcgtgagatacaaggccaagctgatcggcatcgacgaggtgagcgccgccagaggcgacaagctgtgccaggacagcatgatgaagctgaagggcgtggtggccggcgccagaagcaagggcgagcacaagcagaagatcttcctgaccatcagcttcggcggcatcaagatcttcgacgagaagaccggcgccctgcagcaccaccacgccgtgcacgagatcagctacatcgccaaggacatcaccgaccacagagccttcggctacgtgtgcggcaaggagggcaaccacagattcgtggccatcaagaccgcccaggccgccgagcccgtgatcctggacctgagagacctgttccagctgatctacgagctgaagcagagagaggagctggagaagaaggcccagaaggacaagcagtgcgagcaggccgtgtaccaggtgcccaccagccagaagaaggagggcgtgtacgacgtgcccaagagccagcccgtgagcaacggctacagcttcgaggacttcgaggagagattcgccgccgccacccccgccgtgacccagctggagctgttcggcgacatgagcaccccccccgacatcaccagcccccccacccccgccacccccggcgacgccttcatccccagcagcagccagaccctgcccgccagcgccgacgtgttcagcagcgtgcccttcggcaccgccgccgtgcccagcggctacgtggccatgggcgccgtgctgcccagcttctggggccagcagcccctggtgcagcagcagatggtgatgggcgcccagccccccgtggcccaggtgatgcccggcgcccagcccatcgcctggggccagcccggcctgttccccgccacccagcagccctggcccaccgtggccggccagttcccccccgccgccttcatgcccacccagaccgtgatgcccctgcccgccgccatgttccagggccccctgacccccctggccaccgtgcccggcaccagcgacagcaccagaagcagcccccagaccgacaagcccagacagaagatgggcaaggagaccttcaaggacttccagatggcccagcccccccccgtgcccagcagaaagcccgaccagcccagcctgacctgcaccagcgaggccttcagcagctacttcaacaaggtgggcgtggcccaggacaccgacgactgcgacgacttcgacatcagccagctgaacctgacccccgtgaccagcaccacccccagcaccaacagcccccccacccccgcccccagacagagcagccccagcaagagcagcgccagccacgccagcgaccccaccaccgacgacatcttcgaggagggcttcgagagccccagcaagagcgaggagcaggaggcccccgacggcagccaggccagcagcaacagcgaccccttcggcgagcccagcggcgagcccagcggcgacaacatcagcccccaggccggcagctag

SEQ ID NO: 79335 - DNA, 1662 bp, Artificial Sequence
  Description of Artificial Sequence: Synthetic coding sequence
atgagcaccgagaccgagctgcaggtggccgtgaagaccagcgccaagaaggacagcagaaagaagggccaggacagaagcgaggccaccctgatcaagagattcaagggcgagggcgtgagatacaaggccaagctgatcggcatcgacgaggtgagcgccgccagaggcgacaagctgtgccaggacagcatgatgaagctgaagggcgtggtggccggcgccagaagcaagggcgagcacaagcagaagatcttcctgaccatcagcttcggcggcatcaagatcttcgacgagaagaccggcgccctgcagcaccaccacgccgtgcacgagatcagctacatcgccaaggacatcaccgaccacagagccttcggctacgtgtgcggcaaggagggcaaccacagattcgtggccatcaagaccgcccaggccgccgagcccgtgatcctggacctgagagacctgttccagctgatctacgagctgaagcagagagaggagctggagaagaaggcccagaaggacaagcagtgcgagcaggccgtgtaccaggtgcccaccagccagaagaaggagggcgtgtacgacgtgcccaagagccagcccgtgagcaacggctacagcttcgaggacttcgaggagagattcgccgccgccacccccaacagaaacctgcccaccgacttcgacgagatcttcgaggccaccaaggccgtgacccagctggagctgttcggcgacatgagcaccccccccgacatcaccagcccccccacccccgccacccccggcgacgccttcatccccagcagcagccagaccctgcccgccagcgccgacgtgttcagcagcgtgcccttcggcaccgccgccgtgcccagcggctacgtggccatgggcgccgtgctgcccagcttctggggccagcagcccctggtgcagcagcagatggtgatgggcgcccagccccccgtggcccaggtgatgcccggcgcccagcccatcgcctggggccagcccggcctgttccccgccacccagcagccctggcccaccgtggccggccagttcccccccgccgccttcatgcccacccagaccgtgatgcccctgcccgccgccatgttccagggccccctgacccccctggccaccgtgcccggcaccagcgacagcaccagaagcagcccccagaccgacaagcccagacagaagatgggcaaggagaccttcaaggacttccagatggcccagcccccccccgtgcccagcagaaagcccgaccagcccagcctgacctgcaccagcgaggccttcagcagctacttcaacaaggtgggcgtggcccaggacaccgacgactgcgacgacttcgacatcagccagctgaacctgacccccgtgaccagcaccacccccagcaccaacagcccccccacccccgcccccagacagagcagccccagcaagagcagcgccagccacgccagcgaccccaccaccgacgacatcttcgaggagggcttcgagagccccagcaagagcgaggagcaggaggcccccgacggcagccaggccagcagcaacagcgaccccttcggcgagcccagcggcgagcccagcggcgacaacatcagcccccaggccggcagctag

SEQ ID NO: 79336 - DNA, 1410 bp, Artificial Sequence
  Description of Artificial Sequence: Synthetic coding sequence
atgagcaccgagaccgagctgcaggtggccgtgaagaccagcgccaagaaggacagcagaaagaagggccaggacagaagcgaggccaccctgatcaagagattcaagggcgagggcgtgagatacaaggccaagctgatcggcatcgacgaggtgagcgccgccagaggcgacaagctgtgccaggacagcatgatgaagctgaagggcgtggtggccggcgccagaagcaagggcgagcacaagcagaagatcttcctgaccatcagcttcggcggcatcaagatcttcgacgagaagaccggcgtgcccaccagccagaagaaggagggcgtgtacgacgtgcccaagagccagcccgtgagcaacggctacagcttcgaggacttcgaggagagattcgccgccgccacccccaacagaaacctgcccaccgacttcgacgagatcttcgaggccaccaaggccgtgacccagctggagctgttcggcgacatgagcaccccccccgacatcaccagcccccccacccccgccacccccggcgacgccttcatccccagcagcagccagaccctgcccgccagcgccgacgtgttcagcagcgtgcccttcggcaccgccgccgtgcccagcggctacgtggccatgggcgccgtgctgcccagcttctggggccagcagcccctggtgcagcagcagatggtgatgggcgcccagccccccgtggcccaggtgatgcccggcgcccagcccatcgcctggggccagcccggcctgttccccgccacccagcagccctggcccaccgtggccggccagttcccccccgccgccttcatgcccacccagaccgtgatgcccctgcccgccgccatgttccagggccccctgacccccctggccaccgtgcccggcaccagcgacagcaccagaagcagcccccagaccgacaagcccagacagaagatgggcaaggagaccttcaaggacttccagatggcccagcccccccccgtgcccagcagaaagcccgaccagcccagcctgacctgcaccagcgaggccttcagcagctacttcaacaaggtgggcgtggcccaggacaccgacgactgcgacgacttcgacatcagccagctgaacctgacccccgtgaccagcaccacccccagcaccaacagcccccccacccccgcccccagacagagcagccccagcaagagcagcgccagccacgccagcgaccccaccaccgacgacatcttcgaggagggcttcgagagccccagcaagagcgaggagcaggaggcccccgacggcagccaggccagcagcaacagcgaccccttcggcgagcccagcggcgagcccagcggcgacaacatcagcccccaggccggcagctag

SEQ ID NO: 79337 - DNA, 2313 bp, Artificial Sequence
  Description of Artificial Sequence: Synthetic coding sequence
atgagcaacgaggtggagaccagcgccaccaacggccagcccgaccagcaggccgcccccaaggcccccagcaagaaggagaagaagaagggccccgagaagaccgacgagtacctgctggccagattcaagggcgacggcgtgaagtacaaggccaagctgatcggcatcgacgacgtgcccgacgccagaggcgacaagatgagccaggacagcatgatgaagctgaagggcatggccgccgccggcagaagccagggccagcacaagcagagaatctgggtgaacatcagcctgagcggcatcaagatcatcgacgagaagaccggcgtgatcgagcacgagcaccccgtgaacaagatcagcttcatcgccagagacgtgaccgacaacagagccttcggctacgtgtgcggcggcgagggccagcaccagttcttcgccatcaagaccggccagcaggccgagcccctggtggtggacctgaaggacctgttccaggtgatctacaacgtgaagaagaaggaggaggagaagaagaagatcgaggaggccagcaaggccgtggagaacggcagcgaggccctgatgatcctggacgaccagaccaacaagctgaagagcggcgtggaccagatggacctgttcggcgacatgagcaccccccccgacctgaacagccccaccgagagcaaggacatcctgctggtggacctgaacagcgagatcgacaccaaccagaacagcctgagagagaaccccttcctgaccaacggcatcaccagctgcagcctgcccagacccaccccccaggccagcttcctgcccgagaacgccttcagcgccaacctgaacttcttccccacccccaaccccgaccccttcagagacgaccccttcacccagcccgaccagagcacccccagcagcttcgacagcctgaagagccccgaccagaagaaggagaacagcagcagcagcagcacccccctgagcaacggccccctgaacggcgacgtggactacttcggccagcagttcgaccagatcagcaacagaaccggcaagcaggaggcccaggccggcccctggcccttcagcagcagccagacccagcccgccgtgagaacccagaacggcgtgagcgagagagagcagaacggcttcagcgtgaagagcagccccaaccccttcgtgggcagcccccccaagggcctgagcatccagaacggcgtgaagcaggacctggagagcagcgtgcagagcagcccccacgacagcatcgccatcatcccccccccccagagcaccaagcccggcagaggcagaagaaccgccaagagcagcgccaacgacctgctggccagcgacatcttcgccccccccgtgagcgagcccagcggccaggccagccccaccggccagcccaccgccctgcagcccaaccccctggacctgttcaagaccagcgcccccgcccccgtgggccccctggtgggcctgggcggcgtgaccgtgaccctgccccaggccggcccctggaacaccgccagcctggtgttcaaccagagccccagcatggcccccggcgccatgatgggcggccagcccagcggcttcagccagcccgtgatcttcggcaccagccccgccgtgagcggctggaaccagcccagccccttcgccgccagcacccccccccccgtgcccgtggtgtggggccccagcgccagcgtggcccccaacgcctggagcaccaccagccccctgggcaaccccttccagagcaacatcttccccgcccccgccgtgagcacccagccccccagcatgcacagcagcctgctggtgacccccccccagcccccccccagagccggcccccccaaggacatcagcagcgacgccttcaccgccctggaccccctgggcgacaaggagatcaaggacgtgaaggagatgttcaaggacttccagctgagacagccccccgccgtgcccgccagaaagggcgagcagaccagcagcggcaccctgagcgccttcgccagctacttcaacagcaaggtgggcatcccccaggagaacgccgaccacgacgacttcgacgccaaccagctgctgaacaagatcaacgagccccccaagcccgcccccagacaggtgagcctgcccgtgaccaagagcaccgacaacgccttcgagaaccccttcttcaaggacagcttcggcagcagccaggccagcgtggccagcagccagcccgtgagcagcgagatgtacagagaccccttcggcaaccccttcgcctag

SEQ ID NO: 79338 - DNA, 1659 bp, Artificial Sequence
  Description of Artificial Sequence: Synthetic coding sequence
atgagcaacgaggtggagaccagcgccaccaacggccagcccgaccagcaggccgcccccaaggcccccagcaagaaggagaagaagaagggccccgagaagaccgacgagtacctgctggccagattcaagggcgacggcgtgaagtacaaggccaagctgatcggcatcgacgacgtgcccgacgccagaggcgacaagatgagccaggacagcatgatgaagctgaagggcatggccgccgccggcagaagccagggccagcacaagcagagaatctgggtgaacatcagcctgagcggcatcaagatcatcgacgagaagaccggcgtgatcgagcacgagcaccccgtgaacaagatcagcttcatcgccagagacgtgaccgacaacagagccttcggctacgtgtgcggcggcgagggccagcaccagttcttcgccatcaagaccggccagcaggccgagcccctggtggtggacctgaaggacctgttccaggtgatctacaacgtgaagaagaaggaggaggagaagaagaagatcgaggaggccagcaaggccgtggagaacggcagcgaggccctgatgatcctggacgaccagaccaacaagctgaagagcggcgtggaccagatggacctgttcggcgacatgagcaccccccccgacctgaacagccccaccagcagcgccaacgacctgctggccagcgacatcttcgccccccccgtgagcgagcccagcggccaggccagccccaccggccagcccaccgccctgcagcccaaccccctggacctgttcaagaccagcgcccccgcccccgtgggccccctggtgggcctgggcggcgtgaccgtgaccctgccccaggccggcccctggaacaccgccagcctggtgttcaaccagagccccagcatggcccccggcgccatgatgggcggccagcccagcggcttcagccagcccgtgatcttcggcaccagccccgccgtgagcggctggaaccagcccagccccttcgccgccagcacccccccccccgtgcccgtggtgtggggccccagcgccagcgtggcccccaacgcctggagcaccaccagccccctgggcaaccccttccagagcaacatcttccccgcccccgccgtgagcacccagccccccagcatgcacagcagcctgctggtgacccccccccagcccccccccagagccggcccccccaaggacatcagcagcgacgccttcaccgccctggaccccctgggcgacaaggagatcaaggacgtgaaggagatgttcaaggacttccagctgagacagccccccgccgtgcccgccagaaagggcgagcagaccagcagcggcaccctgagcgccttcgccagctacttcaacagcaaggtgggcatcccccaggagaacgccgaccacgacgacttcgacgccaaccagctgctgaacaagatcaacgagccccccaagcccgcccccagacaggtgagcctgcccgtgaccaagagcaccgacaacgccttcgagaaccccttcttcaaggacagcttcggcagcagccaggccagcgtggccagcagccagcccgtgagcagcgagatgtacagagaccccttcggcaaccccttcgcctag

SEQ ID NO: 79339 - DNA, 204 bp, Artificial Sequence
  Description of Artificial Sequence: Synthetic coding sequence
atgagcaacgaggtggagaccagcgccaccaacggccagcccgaccagcaggccgcccccaaggcccccagcaagaaggagaagaagaagggccccgagaagaccgacgagtacctgctggccagattcaagggcgacggcgtgaagtacaaggccaagctgatcggcatcgacgacgtgcccgacgccagaggcgacaagtag

SEQ ID NO: 79340 - DNA, 231 bp, Artificial Sequence
  Description of Artificial Sequence: Synthetic coding sequence
atgagcaacgaggtggagaccagcgccaccaacggccagcccgaccagcaggccgcccccaaggcccccagcaagaaggagaagaagaagggccccgagaagaccgacgagtacctgctggccagattcaagggcgacggcgtgaagtacaaggccaagctgatcggcatcgacgacgtgcccgacgccagaggcgacaagatgagccaggacagcatgatgaagctgtag

SEQ ID NO: 79341 - DNA, 120 bp, Artificial Sequence
  Description of Artificial Sequence: Synthetic coding sequence
atgagcaacgaggtggagaccagcgccaccaacggccagcccgaccagcaggccgcccccaaggcccccagcaagaaggagaagaagaagggccccgagaagaccgacgagtacctgtag

SEQ ID NO: 79342 - DNA, 2250 bp, Artificial Sequence
  Description of Artificial Sequence: Synthetic coding sequence
atgagcaacgaggtggagaccagcgccaccaacggccagcccgaccagcaggccgcccccaaggcccccagcaagaaggagaagaagaagggccccgagaagaccgacgagtacctgctggccagattcaagggcgacggcgtgaagtacaaggccaagctgatcggcatcgacgacgtgcccgacgccagaggcgacaagatgagccaggacagcatgatgaagctgaagggcatggccgccgccggcagaagccagggccagcacaagcagagaatctgggtgaacatcagcctgagcggcatcaagatcatcgacgagaagaccggcgtgatcgagcacgagcaccccgtgaacaagatcagcttcatcgccagagacgtgaccgacaacagagccttcggctacgtgtgcggcggcgagggccagcaccagttcttcgccatcaagaccggccagcaggccgagcccctggtggtggacctgaaggacctgttccaggtgatctacaacgtgaagaagaaggaggaggagaagaagaagatcgaggaggccagcaaggccgtggagaacggcagcgaggccctgatgatcctggacgaccagaccaacaagctgaagagcgagagcaaggacatcctgctggtggacctgaacagcgagatcgacaccaaccagaacagcctgagagagaaccccttcctgaccaacggcatcaccagctgcagcctgcccagacccaccccccaggccagcttcctgcccgagaacgccttcagcgccaacctgaacttcttccccacccccaaccccgaccccttcagagacgaccccttcacccagcccgaccagagcacccccagcagcttcgacagcctgaagagccccgaccagaagaaggagaacagcagcagcagcagcacccccctgagcaacggccccctgaacggcgacgtggactacttcggccagcagttcgaccagatcagcaacagaaccggcaagcaggaggcccaggccggcccctggcccttcagcagcagccagacccagcccgccgtgagaacccagaacggcgtgagcgagagagagcagaacggcttcagcgtgaagagcagccccaaccccttcgtgggcagcccccccaagggcctgagcatccagaacggcgtgaagcaggacctggagagcagcgtgcagagcagcccccacgacagcatcgccatcatcccccccccccagagcaccaagcccggcagaggcagaagaaccgccaagagcagcgccaacgacctgctggccagcgacatcttcgccccccccgtgagcgagcccagcggccaggccagccccaccggccagcccaccgccctgcagcccaaccccctggacctgttcaagaccagcgcccccgcccccgtgggccccctggtgggcctgggcggcgtgaccgtgaccctgccccaggccggcccctggaacaccgccagcctggtgttcaaccagagccccagcatggcccccggcgccatgatgggcggccagcccagcggcttcagccagcccgtgatcttcggcaccagccccgccgtgagcggctggaaccagcccagccccttcgccgccagcacccccccccccgtgcccgtggtgtggggccccagcgccagcgtggcccccaacgcctggagcaccaccagccccctgggcaaccccttccagagcaacatcttccccgcccccgccgtgagcacccagccccccagcatgcacagcagcctgctggtgacccccccccagcccccccccagagccggcccccccaaggacatcagcagcgacgccttcaccgccctggaccccctgggcgacaaggagatcaaggacgtgaaggagatgttcaaggacttccagctgagacagccccccgccgtgcccgccagaaagggcgagcagaccagcagcggcaccctgagcgccttcgccagctacttcaacagcaaggtgggcatcccccaggagaacgccgaccacgacgacttcgacgccaaccagctgctgaacaagatcaacgagccccccaagcccgcccccagacaggtgagcctgcccgtgaccaagagcaccgacaacgccttcgagaaccccttcttcaaggacagcttcggcagcagccaggccagcgtggccagcagccagcccgtgagcagcgagatgtacagagaccccttcggcaaccccttcgcctag

SEQ ID NO: 79343 - DNA, 2568 bp, Artificial Sequence
  Description of Artificial Sequence: Synthetic coding sequence
atgatcctgatccccagaatgctgctggtgctgttcctgctgctgcccatcctgagcagcgccaaggcccaggtgaaccccgccatctgcagataccccctgggcatgagcggcggccagatccccgacgaggacatcaccgccagcagccagtggagcgagagcaccgccgccaagtacggcagactggacagcgaggagggcgacggcgcctggtgccccgagatccccgtggagcccgacgacctgaaggagttcctgcagatcgacctgcacaccctgcacttcatcaccctggtgggcacccagggcagacacgccggcggccacggcatcgagttcgcccccatgtacaagatcaactacagcagagacggcaccagatggatcagctggagaaacagacacggcaagcaggtgctggacggcaacagcaacccctacgacatcttcctgaaggacctggagccccccatcgtggccagattcgtgagattcatccccgtgaccgaccacagcatgaacgtgtgcatgagagtggagctgtacggctgcgtgtggctggacggcctggtgagctacaacgcccccgccggccagcagttcgtgctgcccggcggcagcatcatctacctgaacgacagcgtgtacgacggcgccgtgggctacagcatgaccgagggcctgggccagctgaccgacggcgtgagcggcctggacgacttcacccagacccacgagtaccacgtgtggcccggctacgactacgtgggctggagaaacgagagcgccaccaacggctacatcgagatcatgttcgagttcgacagaatcagaaacttcaccaccatgaaggtgcactgcaacaacatgttcgccaagggcgtgaagatcttcaaggaggtgcagtgctacttcagaagcgaggccagcgagtgggagcccaacgccatcagcttccccctggtgctggacgacgtgaaccccagcgccagattcgtgaccgtgcccctgcaccacagaatggccagcgccatcaagtgccagtaccacttcgccgacacctggatgatgttcagcgagatcaccttccagagcgacgccgccatgtacaacaacagcgaggccctgcccaccagccccatggcccccaccacctacgaccccatgctgaaggtggacgacagcaacaccagaatcctgatcggctgcctggtggccatcatcttcatcctgctggccatcatcgtgatcatcctgtggagacagttctggcagaagatgctggagaaggccagcagaagaatgctggacgacgagatgaccgtgagcctgagcctgcccagcgacagcagcatgttcaacaacaacagaagcagcagccccagcgagcagggcagcaacagcacctacgacagaatcttccccctgagacccgactaccaggagcccagcagactgatcagaaagctgcccgagttcgcccccggcgaggaggagagcggctgcagcggcgtggtgaagcccgtgcagcccagcggccccgagggcgtgccccactacgccgaggccgacatcgtgaacctgcagggcgtgaccggcggcaacacctacagcgtgcccgccgtgaccatggacctgctgagcggcaaggacgtggccgtggaggagttccccagaaagctgctgaccttcaaggagaagctgggcgagggccagttcggcgaggtgcacctgtgcgaggtggagggcatggagaagttcaaggacaaggacttcgccctggacgtgagcgccaaccagcccgtgctggtggccgtgaagatgctgagagccgacgccaacaagaacgccagaaacgacttcctgaaggagatcaagatcatgagcagactgaaggaccccaacatcatccacctgctggccgtgtgcatcaccgacgaccccctgtgcatgatcaccgagtacatggagaacggcgacctgaaccagttcctgagcagacacgagccccccaacagcagcagcagcgacgtgagaaccgtgagctacaccaacctgaagttcatggccacccagatcgccagcggcatgaagtacctgagcagcctgaacttcgtgcacagagacctggccaccagaaactgcctggtgggcaagaactacaccatcaagatcgccgacttcggcatgagcagaaacctgtacagcggcgactactacagaatccagggcagagccgtgctgcccatcagatggatgagctgggagagcatcctgctgggcaagttcaccaccgccagcgacgtgtgggccttcggcgtgaccctgtgggagaccttcaccttctgccaggagcagccctacagccagctgagcgacgagcaggtgatcgagaacaccggcgagttcttcagagaccagggcagacagacctacctgccccagcccgccatctgccccgacagcgtgtacaagctgatgctgagctgctggagaagagacaccaagaacagacccagcttccaggagatccacctgctgctgctgcagcagggcgacgagtag

SEQ ID NO: 79344 - DNA, 2568 bp, Artificial Sequence; identical to SEQ ID NO: 79343
  Description of Artificial Sequence: Synthetic coding sequence

SEQ ID NO: 79345 - DNA, 447 bp, Artificial Sequence
  Description of Artificial Sequence: Synthetic coding sequence
atgatcctgatccccagaatgctgctggtgctgttcctgctgctgcccatcctgagcagcgccaaggcccaggtgaaccccgccatctgcagataccccctgggcatgagcggcggccagatccccgacgaggacatcaccgccagcagccagtggagcgagagcaccgccgccaagtacggcagactggacagcgaggagggcgacggcgcctggtgccccgagatccccgtggagcccgacgacctgaaggagttcctgcagatcgacctgcacaccctgcacttcatcaccctggtgggcacccagggcagacacgccggcggccacggcatcgagttcgcccccatgtacaagatcaactacagcagagacggcaccagatggatcagctggagaaacagacacggcaagcaggtgctggacggcaacagcaacccctactag

SEQ ID NO: 79346 - DNA, 516 bp, Artificial Sequence
  Description of Artificial Sequence: Synthetic coding sequence
tgaatcttcatcctgctggccatcatcgtgatcatcctgtggagacagttctggcagaagatgctggagaaggccagcagaagaatgctggacgacgagatgaccgtgagcctgagcctgcccagcgacagcagcatgttcaacaacaacagaagcagcagccccagcgagcagggcagcaacagcacctacgacagaatcttccccctgagacccgactaccaggagcccagcagactgatcagaaagctgcccgagttcgcccccggcgaggaggagagcggctgcagcggcgtggtgaagcccgtgcagcccagcggccccgagggcgtgccccactacgccgaggccgacatcgtgaacctgcagggcgtgaccggcggcaacacctacagcgtgcccgccgtgaccatggacctgctgagcggcaaggacgtggccgtggaggagttccccagaaagctgctgaccttcaaggagaagctgggcgagggccagttcggcgaggtgagctag

SEQ ID NO: 79347 - DNA, 393 bp, Artificial Sequence
  Description of Artificial Sequence: Synthetic coding sequence
atgatcctgatccccagaatgctgctggtgctgttcctgctgctgcccatcctgagcagcgccaaggcccaggtgaaccccgccatctgcagataccccctgggcatgagcggcggccagatccccgacgaggacatcaccgccagcagccagtggagcgagagcaccgccgccaagtacggcagactggacagcgaggagggcgacggcgcctggtgccccgagatccccgtggagcccgacgacctgaaggagttcctgcagatcgacctgcacaccctgcacttcatcaccctggtgggcacccagggcagacacgccggcggccacggcatcgagttcgcccccatgtacaagatcaactacagcagagacggcaccagatggatctag

SEQ ID NO: 79348 - DNA, 501 bp, Artificial Sequence
  Description of Artificial Sequence: Synthetic coding sequence
ctgaaggtggacgacagcaacaccagaatcctgatcggctgcctggtggccatcatcttcatcctgctggccatcatcgtgatcatcctgtggagacagttctggcagaagatgctggagaaggccagcagaagaatgctggacgacgagatgaccgtgagcctgagcctgcccagcgacagcagcatgttcaacaacaacagaagcagcagccccagcgagcagggcagcaacagcacctacgacagaatcttccccctgagacccgactaccaggagcccagcagactgatcagaaagctgcccgagttcgcccccggcgaggaggagagcggcgaggacgacgtggtgggcagagtgagcagagagaagccccagcaggccagcggcagatacgacacccccgcccccagcagcctgcacctgttcctggtgagcgccaacctgctgagaagcccccacagcctgagcagattcggcctgcccctgctgctggcctag

SEQ ID NO: 79349 - DNA, 447 bp, Artificial Sequence; identical to SEQ ID NO: 79345
  Description of Artificial Sequence: Synthetic coding sequence

SEQ ID NO: 79350 - DNA, 2403 bp, Artificial Sequence
  Description of Artificial Sequence: Synthetic coding sequence
atgaactacatcttcggcaacaacaccctgctgtacagcagaggcagcagaggcggcaacaccagcagcagccacggcagcgccggccccaagcagaagcactgggccaagaagggcagcagcgacgagctgcaggccgagcccgagcccagcagatggcagcagatcgtggccttcttcaccagaagacacagcttcatcgactgcatcagcgtggccaccagcagcacccaggccaaccccccccccgtgctggtgaacaccgacagcctggagacccccacctacgtgaacggcaccgacgccgactacgagtacgaggagatcaccctggagagaggcaacagcggcctgggcttcagcatcgccggcggcaccgacaacccccacatcggcgacgacagcagcatcttcatcaccaagatcatcaccggcggcgccgccgcccaggacggcagactgagagtgaacgactgcatcctgagagtgaacgaggtggacgtgagagacgtgacccacagcaaggccgtggaggccctgaaggaggccggcagcatcgtgagactgtacgtgaagagaagaaagcccgtgagcgagaagatcatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcaagctgcagatcggcgacaagctgctggccgtgaacaacgtgtgcctggaggaggtgacccacgaggaggccgtgaccgccctgaagaacaccagcgacttcgtgtacctgaaggtggccaagcccaccagcatgtacatgaacgacggctacgccccccccgacatcaccaacagcagcagccagcccgtggacaaccacgtgagccccagcagcttcctgggccagacccccgccagccccgccagatacagccccgtgagcaaggccgtgctgggcgacgacgagatcaccagagagcccagaaaggtggtgctgcacagaggcagcaccggcctgggcttcaacatcgtgggcggcgaggacggcgagggcatcttcatcagcttcatcctggccggcggccccgccgacctgagcggcgagctgagaaagggcgacagaatcatcagcgtgaacagcgtggacctgagagccgccagccacgagcaggccgccgccgccctgaagaacgccggccaggccgtgaccatcgtggcccagtacagacccgaggagtacagcagattcgaggccaagatccacgacctgagagagcagatgatgaacagcagcatcagcagcggcagcggcagcctgagaaccagccagaagagaagcctgtacgtgagagccctgttcgactacgacaagaccaaggacagcggcctgcccagccagggcctgaacttcaagttcggcgacatcctgcacgtgatcaacgccagcgacgacgagtggtggcaggccagacaggtgacccccgacggcgagagcgacgaggtgggcgtgatccccagcaagagaagagtggagaagaaggagagagccagactgaagaccgtgaagttcaacagcaagaccagagacaagggcgagatccccgacgacatgggcagcaagggcctgaagcacgtgaccagcaacgccagcgacagcgagagcagctacctgatcctgatcaccgacgagtacggctgcagcaagggcggccaggaggagtacgtgctgagctacgagcccgtgaaccagcaggaggtgaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgaccagcagagagcagatggagaaggacatccaggagcacaagttcatcgaggccggccagtacaacaaccacctgtacggcaccagcgtgcagagcgtgagagaggtggccgagaagggcaagcactgcatcctggacgtgagcggcaacgccatcaagagactgcagatcgcccagctgtaccccatcagcatcttcatcaagcccaagagcatggagaacatcatggagatgaacaagagactgaccgaggagcaggccagaaagaccttcgagagagccatgaagctggagcaggagttcaccgagcacttcaccgccatcgtgcagggcgacaccctggaggacatctacaaccaggtgaagcagatcatcgaggagcagagcggcagctacatctgggtgcccgccaaggagaagctgtag

SEQ ID NO: 79351 - DNA, 2367 bp, Artificial Sequence
  Description of Artificial Sequence: Synthetic coding sequence
atgaactacatcttcggcaacaacaccctgctgtacagcagaggcagcagaggcggcaacaccagcagcagccacggcagcgccggccccaagcagaagcactgggccaagaagggcagcagcgacgagctgcaggccgagcccgagcccagcagatggcagcagatcgtggccttcttcaccagaagacacagcttcatcgactgcatcagcgtggccaccagcagcacccaggccaaccccccccccgtgctggtgaacaccgacagcctggagacccccacctacgtgaacggcaccgacgccgactacgagtacgaggagatcaccctggagagaggcaacagcggcctgggcttcagcatcgccggcggcaccgacaacccccacatcggcgacgacagcagcatcttcatcaccaagatcatcaccggcggcgccgccgcccaggacggcagactgagagtgaacgactgcatcctgagagtgaacgaggtggacgtgagagacgtgacccacagcaaggccgtggaggccctgaaggaggccggcagcatcgtgagactgtacgtgaagagaagaaagcccgtgagcgagaagatcatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcaagctgcagatcggcgacaagctgctggccgtgaacaacgtgtgcctggaggaggtgacccacgaggaggccgtgaccgccctgaagaacaccagcgacttcgtgtacctgaaggtggccaagcccaccagcatgtacatgaacgacggctacgccccccccgacatcaccaacagcagcagccagcccgtggacaaccacgtgagccccagcagcttcctgggccagacccccgccagccccgccagatacagccccgtgagcaaggccgtgctgggcgacgacgagatcaccagagagcccagaaaggtggtgctgcacagaggcagcaccggcctgggcttcaacatcgtgggcggcgaggacggcgagggcatcttcatcagcttcatcctggccggcggccccgccgacctgagcggcgagctgagaaagggcgacagaatcatcagcgtgaacagcgtggacctgagagccgccagccacgagcaggccgccgccgccctgaagaacgccggccaggccgtgaccatcgtggcccagtacagacccgaggagtacagcagattcgaggccaagatccacgacctgagagagcagatgatgaacagcagcatcagcagcggcagcggcagcctgagaaccagccagaagagaagcctgtacgtgagagccctgttcgactacgacaagaccaaggacagcggcctgcccagccagggcctgaacttcaagttcggcgacatcctgcacgtgatcaacgccagcgacgacgagtggtggcaggccagacaggtgacccccgacggcgagagcgacgaggtgggcgtgatccccagcaagagaagagtggagaagaaggagagagccagactgaagaccgtgaagttcaacagcaagaccagagacaagggcgagatccccgacgacatgggcagcaagggcctgaagcacgtgaccagcaacgccagcgacagcgagagcagctacagaggccaggaggagtacgtgctgagctacgagcccgtgaaccagcaggaggtgaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgaccagcagagagcagatggagaaggacatccaggagcacaagttcatcgaggccggccagtacaacaaccacctgtacggcaccagcgtgcagagcgtgagagaggtggccgagaagggcaagcactgcatcctggacgtgagcggcaacgccatcaagagactgcagatcgcccagctgtaccccatcagcatcttcatcaagcccaagagcatggagaacatcatggagatgaacaagagactgaccgaggagcaggccagaaagaccttcgagagagccatgaagctggagcaggagttcaccgagcacttcaccgccatcgtgcagggcgacaccctggaggacatctacaaccaggtgaagcagatcatcgaggagcagagcggcagctacatctgggtgcccgccaaggagaagctgtag

SEQ ID NO: 79352 - DNA, 1539 bp, Artificial Sequence
  Description of Artificial Sequence: Synthetic coding sequence
atggagagagccagaaagttcagcggcagcggcctggccatgggcctgggcagcgccagcgccagcgcctggagaagagccagccagagatgggcctggcccctgagaagcctgagacccggcggcgacgccagagagcccagaaagatcatcctgcacaagggcagcaccggcctgggcttcaacatcgtgggcggcgaggacggcgagggcatcttcgtgagcttcatcctggccggcggccccgccgacctgagcggcgagctgagaagaggcgacagaatcctgagcgtgaacggcgtgaacctgagaaacgccacccacgagcaggccgccgccgccctgaagagagccggccagagcgtgaccatcgtggcccagtacagacccgaggagtacagcagattcgagagcaagatccacgacctgagagagcagatgatgaacagcagcatgagcagcggcagcggcagcctgagaaccagcgagaagagaagcctgtacgtgagagccctgttcgactacgacagaaccagagacagctgcctgcccagccagggcctgagcttcagctacggcgacatcctgcacgtgatcaacgccagcgacgacgagtggtggcaggccagactggtgaccccccacggcgagagcgagcagatcggcgtgatccccagcaagaagagagtggagaagaaggagagagccagactgaagaccgtgaagttccacgccagaaccggcatgatcgagagcaacagaagcatcaagaccaagagaaagaagagcttcagactgagcagaaagttccccttctacaagagcaaggagaacatggcccaggagagcagcatccaggagcagggcgtgaccagcaacaccagcgacagcgagagcagcagcaagggccaggaggacgccatcctgagctacgagcccgtgaccagacaggagatccactacgccagacccgtgatcatcctgggccccatgaaggacagagtgaacgacgacctgatcagcgagttcccccacaagttcggcagctgcgtgccccacaccaccagacccagaagagacaacgaggtggacggccaggactaccacttcgtggtgagcagagagcagatggagaaggacatccaggacaacaagttcatcgaggccggccagttcaacgacaacctgtacggcaccagcatccagagcgtgagagccgtggccgagagaggcaagcactgcatcctggacgtgagcggcaacgccatcaagagactgcagcaggcccagctgtaccccatcgccatcttcatcaagcccaagagcatcgaggccctgatggagatgaacagaagacagacctacgagcaggccaacaagatctacgacaaggccatgaagctggagcaggagttcggcgagtacttcaccgccatcgtgcagggcgacagcctggaggagatctacaacaagatcaagcagatcatcgaggaccagagcggccactacatctgggtgcccagccccgagaagctgtag

SEQ ID NO: 79353 - DNA, 3021 bp, Artificial Sequence
  Description of Artificial Sequence: Synthetic coding sequence
gaggaggaggccggcgacctggtgcagcccggcatcagcttccccggccccgccgaggaggacctggacccccagtacagctggagccccacccagcacttcaacgaggagagatacagccccgcccccagaagcatgaagggcctgagcggcagcagaacccagccccccctgtgcagcggccacacctgcggcctggccccccccgaggactgcgagcacctgcaccacggccccgacgccagacccccctacctgctgagccccgccgacagctgccccggcggcagacacagatgcagccccagaagcagcgtgcacagcgagtgcgtgatgatgcccgtggtgctgggcgaccacgtgagcagcagcaccttccccagaatgcactacagcagccactacgacaccagagacgactgcgccgtggcccacgccggcgccaagatcaacagaatccccgccaacctgctggaccagttcgagaagcagctgcccctgcacagagacggcttccacaccctgcagtaccagagaaccagcgccgccgccgagcagagaagcgagagccccggcagaatcagacacctggtgcacagcgtgcagaagctgttcaccaagagccacagcctggagggcagcagcaagagcaacgccaacggcaccaaggccgacggcagagccgacgaccaccaccacgcccaccacgccaagcacagcaagagaagcaagagcaaggagagaaagcccgagggcaagcccagacccggcatgagcagctggtggagcagcgacgacaacctggacagcgacagcacctacagaacccccagcgtgctgaacagacaccacctgggccccgtggcccactgctaccccgacgccctgcagagccccttcggcgacctgagcctgaagaccagcaagagcaacaacgacgtgaagtgcagcgcctgcgagggcctggccctgacccccgacgccaagtacctgaagagaagcagctggagcaccctgaccgtgagccaggccaaggaggcctacagaaagagcagcctgaacctggacaagcccctgctgcaccaggacgccaagcccgccctgagaccctgccactacctgcaggtgccccaggacgagtggggcggctaccccaccggcggcaaggacgaggagatcccctgcagaagaatgagaagcggcagctacatcaaggccatgggcgacgaggagagcggcgagagcgacagcagccccaagaccagccccaagagcgccatcctgcccgagcccctgctgaagagcatcggccagagacccctgggcgagcaccagacccagacctacctgcaggccgccagcgacgtgcccgtgggccacagcctggaccccgccgccaactacaacagccccaagttcagaagcagaaaccagagctacatgagagccgtgagcaccctgagccaggccagctgcgtgagccaggtgagcgaggccgagatcaacggccagttcgagagcgtgtgcgagagcgtgttcagcgaggtggagagccaggccatggacgccctggacctgcccggctgcttcagaaccagaagccacagctacctgagagccatccaggccggctacagccaggacgacgagtgcatccccatgatgacccccagcgacatcaccagcaccatcagaagcaccgccgccgtgagctacaccaactacaagaagacccccccccccgtgccccccagaaccaccagcaagcccctgatcagcgtgaccgcccagagcagcaccgagagcacccaggacgcctaccaggacagcagagcccagagaatgagcccctggccccaggacagcagaggcctgtacaacagcaccgacagcctggacagcaacaaggccatgaacctggccctggagaccgccgccgcccagagacacctgcccgagagccagagcagcagcgtgagaaccagcgacaaggccatcctggtgagcaaggccgaggagctgctgaagagcagatgcagcagcatcggcatccaggtggagaccgccaccgacagcgacaccgagagcagaggcctgagagagtaccacagcgtgggcgtgcaggtggaggacgagaagagacacggcagattcaagagaagcaacagcgtgaccgccgccgtgcaggccgacctggagctggagggcttccccggccacatcaccaccgaggacaagggcctgcagttcggcagcagcttccagagacacagcgagcccagcacccccacccagtacagcgccgtgagaaccgtgagaacccagggcctgttcagctacagagaggactacagaacccaggtggacaccagcaccctgcccccccccgacccctggctggagcccgccatcgacaccgtggagaccggcagaatgagcccctgcagaagagacggcagctggttcctgaagctgctgcacgccgagaccaagagaatggagggctggtgcaaggagatggagagagaggccgaggagaacgacctgagcgaggagatcctgggcaagatcagaagcgccgtgggcagcgcccagctgctgatgagccagaagttccagcagttctactggctgtgccagcagaacatggaccccagcgccatgcccagacccaccagccaggacctggccggctactgggacatgctgcagctgagcatcgaggacgtgagcatgaagttcgacgagctgcagagactgagactgaacgactggaagatgatggagagccccgagagaaaggaggagagaaaggtgcccccccccatccccaagaagccccccaagggcaagttccccatcaccagagagaagagcctggacctgcccgacagacagagacaggaggccagaagaagactgatggccgccaagagagccgccagcttcagacagaacagcgccagcgagagagccgacagcatcgagatctacatccccgaggcccagaccagactgtag

SEQ ID NO: 79354 - DNA, 2928 bp, Artificial Sequence
  Description of Artificial Sequence: Synthetic coding sequence
atgaagggcctgagcggcagcagaacccagccccccctgtgcagcggccacacctgcggcctggccccccccgaggactgcgagcacctgcaccacggccccgacgccagacccccctacctgctgagccccgccgacagctgccccggcggcagacacagatgcagccccagaagcagcgtgcacagcgagtgcgtgatgatgcccgtggtgctgggcgaccacgtgagcagcagcaccttccccagaatgcactacagcagccactacgacaccagagacgactgcgccgtggcccacgccggcgccaagatcaacagaatccccgccaacctgctggaccagttcgagaagcagctgcccctgcacagagacggcttccacaccctgcagtaccagagaaccagcgccgccgccgagcagagaagcgagagccccggcagaatcagacacctggtgcacagcgtgcagaagctgttcaccaagagccacagcctggagggcagcagcaagagcaacgccaacggcaccaaggccgacggcagagccgacgaccaccaccacgcccaccacgccaagcacagcaagagaagcaagagcaaggagagaaagcccgagggcaagcccagacccggcatgagcagctggtggagcagcgacgacaacctggacagcgacagcacctacagaacccccagcgtgctgaacagacaccacctgggccccgtggcccactgctaccccgacgccctgcagagccccttcggcgacctgagcctgaagaccagcaagagcaacaacgacgtgaagtgcagcgcctgcgagggcctggccctgacccccgacgccaagtacctgaagagaagcagctggagcaccctgaccgtgagccaggccaaggaggcctacagaaagagcagcctgaacctggacaagcccctgctgcaccaggacgccaagcccgccctgagaccctgccactacctgcaggtgccccaggacgagtggggcggctaccccaccggcggcaaggacgaggagatcccctgcagaagaatgagaagcggcagctacatcaaggccatgggcgacgaggagagcggcgagagcgacagcagccccaagaccagccccaagagcgccatcctgcccgagcccctgctgaagagcatcggccagagacccctgggcgagcaccagacccagacctacctgcaggccgccagcgacgtgcccgtgggccacagcctggaccccgccgccaactacaacagccccaagttcagaagcagaaaccagagctacatgagagccgtgagcaccctgagccaggccagctgcgtgagccaggtgagcgaggccgagatcaacggccagttcgagagcgtgtgcgagagcgtgttcagcgaggtggagagccaggccatggacgccctggacctgcccggctgcttcagaaccagaagccacagctacctgagagccatccaggccggctacagccaggacgacgagtgcatccccatgatgacccccagcgacatcaccagcaccatcagaagcaccgccgccgtgagctacaccaactacaagaagacccccccccccgtgccccccagaaccaccagcaagcccctgatcagcgtgaccgcccagagcagcaccgagagcacccaggacgcctaccaggacagcagagcccagagaatgagcccctggccccaggacagcagaggcctgtacaacagcaccgacagcctggacagcaacaaggccatgaacctggccctggagaccgccgccgcccagagacacctgcccgagagccagagcagcagcgtgagaaccagcgacaaggccatcctggtgagcaaggccgaggagctgctgaagagcagatgcagcagcatcggcatccaggacagcgagttccccgagcaccagccctaccccagaagcgacgtggagaccgccaccgacagcgacaccgagagcagaggcctgagagagtaccacagcgtgggcgtgcaggtggaggacgagaagagacacggcagattcaagagaagcaacagcgtgaccgccgccgtgcaggccgacctggagctggagggcttccccggccacatcaccaccgaggacaagggcctgcagttcggcagcagcttccagagacacagcgagcccagcacccccacccagtacagcgccgtgagaaccgtgagaacccagggcctgttcagctacagagaggactacagaacccaggtggacaccagcaccctgcccccccccgacccctggctggagcccgccatcgacaccgtggagaccggcagaatgagcccctgcagaagagacggcagctggttcctgaagctgctgcacgccgagaccaagagaatggagggctggtgcaaggagatggagagagaggccgaggagaacgacctgagcgaggagatcctgggcaagatcagaagcgccgtgggcagcgcccagctgctgatgagccagaagttccagcagttctactggctgtgccagcagaacatggaccccagcgccatgcccagacccaccagccaggacctggccggctactgggacatgctgcagctgagcatcgaggacgtgagcatgaagttcgacgagctgcagagactgagactgaacgactggaagatgatggagagccccgagagaaaggaggagagaaaggtgcccccccccatccccaagaagccccccaagggcaagttccccatcaccagagagaagagcctggacctgcccgacagacagagacaggaggccagaagaagactgatggccgccaagagagccgccagcttcagacagaacagcgccagcgagagagccgacagcatcgagatctacatccccgaggcccagaccagactgtag

SEQ ID NO: 79355 - DNA, 2937 bp, Artificial Sequence
  Description of Artificial Sequence: Synthetic coding sequence
tgacccacccagcacttcaacgaggagagatacagccccgcccccagaagcatgaagggcctgagcggcagcagaacccagccccccctgtgcagcggccacacctgcggcctggccccccccgaggactgcgagcacctgcaccacggccccgacgccagacccccctacctgctgagccccgccgacagctgccccggcggcagacacagatgcagccccagaagcagcgtgcacagcgagtgcgtgatgatgcccgtggtgctgggcgaccacgtgagcagcagcaccttccccagaatgcactacagcagccactacgacaccagagacgactgcgccgtggcccacgccggcgccaagatcaacagaatccccgccaacctgctggaccagttcgagaagcagctgcccctgcacagagacggcttccacaccctgcagtaccagagaaccagcgccgccgccgagcagagaagcgagagccccggcagaatcagacacctggtgcacagcgtgcagaagctgttcaccaagagccacagcctggagggcagcagcaagagcaacgccaacggcaccaaggccgacggcagagccgacgaccaccaccacgcccaccacgccaagcacagcaagagaagcaagagcaaggagagaaagcccgagggcaagcccagacccggcatgagcagctggtggagcagcgacgacaacctggacagcgacagcacctacagaacccccagcgtgctgaacagacaccacctgggccccgtggcccactgctaccccgacgccctgcagagccccttcggcgacctgagcctgaagaccagcaagagcaacaacgacgtgaagtgcagcgcctgcgagggcctggccctgacccccgacgccaagtacctgaagagaagcagctggagcaccctgaccgtgagccaggccaaggaggcctacagaaagagcagcctgaacctggacaagcccctgctgcaccaggacgccaagcccgccctgagaccctgccactacctgcaggtgccccaggacgagtggggcggctaccccaccggcggcaaggacgaggagatcccctgcagaagaatgagaagcggcagctacatcaaggccatgggcgacgaggagagcggcgagagcgacagcagccccaagaccagccccaagagcgccatcctgcccgagcccctgctgaagagcatcggccagagacccctgggcgagcaccagacccagacctacctgcaggccgccagcgacgtgcccgtgggccacagcctggaccccgccgccaactacaacagccccaagttcagaagcagaaaccagagctacatgagagccgtgagcaccctgagccaggccagctgcgtgagccaggtgagcgaggccgagatcaacggccagttcgagagcgtgtgcgagagcgtgttcagcgaggtggagagccaggccatggacgccctggacctgcccggctgcttcagaaccagaagccacagctacctgagagccatccaggccggctacagccaggacgacgagtgcatccccatgatgacccccagcgacatcaccagcaccatcagaagcaccgccgccgtgagctacaccaactacaagaagacccccccccccgtgccccccagaaccaccagcaagcccctgatcagcgtgaccgcccagagcagcaccgagagcacccaggacgcctaccaggacagcagagcccagagaatgagcccctggccccaggacagcagaggcctgtacaacagcaccgacagcctggacagcaacaaggccatgaacctggccctggagaccgccgccgcccagagacacctgcccgagagccagagcagcagcgtgagaaccagcgacaaggccatcctggtgagcaaggccgaggagctgctgaagagcagatgcagcagcatcggcatccaggtggagaccgccaccgacagcgacaccgagagcagaggcctgagagagtaccacagcgtgggcgtgcaggtggaggacgagaagagacacggcagattcaagagaagcaacagcgtgaccgccgccgtgcaggccgacctggagctggagggcttccccggccacatcaccaccgaggacaagggcctgcagttcggcagcagcttccagagacacagcgagcccagcacccccacccagtacagcgccgtgagaaccgtgagaacccagggcctgttcagctacagagaggactacagaacccaggtggacaccagcaccctgcccccccccgacccctggctggagcccgccatcgacaccgtggagaccggcagaatgagcccctgcagaagagacggcagctggttcctgaagctgctgcacgccgagaccaagagaatggagggctggtgcaaggagatggagagagaggccgaggagaacgacctgagcgaggagatcctgggcaagatcagaagcgccgtgggcagcgcccagctgctgatgagccagaagttccagcagttctactggctgtgccagcagaacatggaccccagcgccatgcccagacccaccagccaggacctggccggctactgggacatgctgcagctgagcatcgaggacgtgagcatgaagttcgacgagctgcagagactgagactgaacgactggaagatgatggagagccccgagagaaaggaggagagaaaggtgcccccccccatccccaagaagccccccaagggcaagttccccatcaccagagagaagagcctggacctgcccgacagacagagacaggaggccagaagaagactgatggccgccaagagagccgccagcttcagacagaacagcgccagcgagagagccgacagcatcgagatctacatccccgaggcccagaccagactgtag

SEQ ID NO: 79356 - DNA, 2562 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccccagatcaccaacgaggtgatcggccccgagctggtgcacgtgagcgagaagaacctgagcgagatcgagaacgtgcacggcttcgtgagccacagccacatcagccccatcaaggtgaacggcaccgacgccgactacgagtacgaggagatcaccctggagagaggcaacagcggcctgggcttcagcatcgccggcggcaccgacaacccccacatcggcgacgacagcagcatcttcatcaccaagatcatcaccggcggcgccgccgcccaggacggcagactgagagtgaacgactgcatcctgagagtgaacgaggtggacgtgagagacgtgacccacagcaaggccgtggaggccctgaaggaggccggcagcatcgtgagactgtacgtgaagagaagaaagcccgtgagcgagaagatcatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcaagctgcagatcggcgacaagctgctggccgtgaacaacgtgtgcctggaggaggtgacccacgaggaggccgtgaccgccctgaagaacaccagcgacttcgtgtacctgaaggtggccaagcccaccagcatgtacatgaacgacggctacgccccccccgacatcaccaacagcagcagccagcccgtggacaaccacgtgagccccagcagcttcctgggccagacccccgccagccccgccagatacagccccgtgagcaaggccgtgctgggcgacgacgagatcaccagagagcccagaaaggtggtgctgcacagaggcagcaccggcctgggcttcaacatcgtgggcggcgaggacggcgagggcatcttcatcagcttcatcctggccggcggccccgccgacctgagcggcgagctgagaaagggcgacagaatcatcagcgtgaacagcgtggacctgagagccgccagccacgagcaggccgccgccgccctgaagaacgccggccaggccgtgaccatcgtggcccagtacagacccgaggagtacagcagattcgaggccaagatccacgacctgagagagcagatgatgaacagcagcatcagcagcggcagcggcagcctgagaaccagccagaagagaagcctgtacgtgagagccctgttcgactacgacaagaccaaggacagcggcctgcccagccagggcctgaacttcaagttcggcgacatcctgcacgtgatcaacgccagcgacgacgagtggtggcaggccagacaggtgacccccgacggcgagagcgacgaggtgggcgtgatccccagcaagagaagagtggagaagaaggagagagccagactgaagaccgtgaagttcaacagcaagaccagagacaagggcgagatccccgacgacatgggcagcaagggcctgaagcacgtgaccagcaacgccagcgacagcgagagcagctacagaggccaggaggagtacgtgctgagctacgagcccgtgaaccagcaggaggtgaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgaccagcagagagcagatggagaaggacatccaggagcacaagttcatcgaggccggccagtacaacaaccacctgtacggcaccagcgtgcagagcgtgagagaggtggccgagaagggcaagcactgcatcctggacgtgagcggcaacgccatcaagagactgcagatcgcccagctgtaccccatcagcatcttcatcaagcccaagagcatggagaacatcatggagatgaacaagagactgaccgaggagcaggccagaaagaccttcgagagagccatgaagctggagcaggagttcaccgagcacttcaccgccatcgtgcagggcgacaccctggaggacatctacaaccaggtgaagcagatcatcgaggagcagagcggcagctacatctgggtgcccgccaaggagaagctgtag

SEQ ID NO: 79357 - DNA, 2781 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccccagatcaccaacgaggtgatcggccccgagctggtgcacgtgagcgagaagaacctgagcgagatcgagaacgtgcacggcttcgtgagccacagccacatcagccccatcaagcccaccgaggccgtgctgcccagcccccccaccgtgcccgtgatccccgtgctgcccgtgcccgccgagaacaccgtgatcctgcccaccatcccccaggccaaccccccccccgtgctggtgaacaccgacagcctggagacccccacctacgtgaacggcaccgacgccgactacgagtacgaggagatcaccctggagagaggcaacagcggcctgggcttcagcatcgccggcggcaccgacaacccccacatcggcgacgacagcagcatcttcatcaccaagatcatcaccggcggcgccgccgcccaggacggcagactgagagtgaacgactgcatcctgagagtgaacgaggtggacgtgagagacgtgacccacagcaaggccgtggaggccctgaaggaggccggcagcatcgtgagactgtacgtgaagagaagaaagcccgtgagcgagaagatcatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcaagctgcagatcggcgacaagctgctggccgtgaacaacgtgtgcctggaggaggtgacccacgaggaggccgtgaccgccctgaagaacaccagcgacttcgtgtacctgaaggtggccaagcccaccagcatgtacatgaacgacggctacgccccccccgacatcaccaacagcagcagccagcccgtggacaaccacgtgagccccagcagcttcctgggccagacccccgccagccccgccagatacagccccgtgagcaaggccgtgctgggcgacgacgagatcaccagagagcccagaaaggtggtgctgcacagaggcagcaccggcctgggcttcaacatcgtgggcggcgaggacggcgagggcatcttcatcagcttcatcctggccggcggccccgccgacctgagcggcgagctgagaaagggcgacagaatcatcagcgtgaacagcgtggacctgagagccgccagccacgagcaggccgccgccgccctgaagaacgccggccaggccgtgaccatcgtggcccagtacagacccgaggagtacagcagattcgaggccaagatccacgacctgagagagcagatgatgaacagcagcatcagcagcggcagcggcagcctgagaaccagccagaagagaagcctgtacgtgagagccctgttcgactacgacaagaccaaggacagcggcctgcccagccagggcctgaacttcaagttcggcgacatcctgcacgtgatcaacgccagcgacgacgagtggtggcaggccagacaggtgacccccgacggcgagagcgacgaggtgggcgtgatccccagcaagagaagagtggagaagaaggagagagccagactgaagaccgtgaagttcaacagcaagaccagagacaagggccagagcttcaacgacaagagaaagaagaacctgttcagcagaaagttccccttctacaagaacaaggaccagagcgagcaggagaccagcgacgccgaccagcacgtgaccagcaacgccagcgacagcgagagcagctacagaggccaggaggagtacgtgctgagctacgagcccgtgaaccagcaggaggtgaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgaccagcagagagcagatggagaaggacatccaggagcacaagttcatcgaggccggccagtacaacaaccacctgtacggcaccagcgtgcagagcgtgagagaggtggccgagaagggcaagcactgcatcctggacgtgagcggcaacgccatcaagagactgcagatcgcccagctgtaccccatcagcatcttcatcaagcccaagagcatggagaacatcatggagatgaacaagagactgaccgaggagcaggccagaaagaccttcgagagagccatgaagctggagcaggagttcaccgagcacttcaccgccatcgtgcagggcgacaccctggaggacatctacaaccaggtgaagcagatcatcgaggagcagagcggcagctacatctgggtgcccgccaaggagaagctgtag

SEQ ID NO: 79358 - DNA, 2682 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccccagatcaccaacgaggtgatcggccccgagctggtgcacgtgagcgagaagaacctgagcgagatcgagaacgtgcacggcttcgtgagccacagccacatcagccccatcaaggccaaccccccccccgtgctggtgaacaccgacagcctggagacccccacctacgtgaacggcaccgacgccgactacgagtacgaggagatcaccctggagagaggcaacagcggcctgggcttcagcatcgccggcggcaccgacaacccccacatcggcgacgacagcagcatcttcatcaccaagatcatcaccggcggcgccgccgcccaggacggcagactgagagtgaacgactgcatcctgagagtgaacgaggtggacgtgagagacgtgacccacagcaaggccgtggaggccctgaaggaggccggcagcatcgtgagactgtacgtgaagagaagaaagcccgtgagcgagaagatcatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcaagctgcagatcggcgacaagctgctggccgtgaacaacgtgtgcctggaggaggtgacccacgaggaggccgtgaccgccctgaagaacaccagcgacttcgtgtacctgaaggtggccaagcccaccagcatgtacatgaacgacggctacgccccccccgacatcaccaacagcagcagccagcccgtggacaaccacgtgagccccagcagcttcctgggccagacccccgccagccccgccagatacagccccgtgagcaaggccgtgctgggcgacgacgagatcaccagagagcccagaaaggtggtgctgcacagaggcagcaccggcctgggcttcaacatcgtgggcggcgaggacggcgagggcatcttcatcagcttcatcctggccggcggccccgccgacctgagcggcgagctgagaaagggcgacagaatcatcagcgtgaacagcgtggacctgagagccgccagccacgagcaggccgccgccgccctgaagaacgccggccaggccgtgaccatcgtggcccagtacagacccgaggagtacagcagattcgaggccaagatccacgacctgagagagcagatgatgaacagcagcatcagcagcggcagcggcagcctgagaaccagccagaagagaagcctgtacgtgagagccctgttcgactacgacaagaccaaggacagcggcctgcccagccagggcctgaacttcaagttcggcgacatcctgcacgtgatcaacgccagcgacgacgagtggtggcaggccagacaggtgacccccgacggcgagagcgacgaggtgggcgtgatccccagcaagagaagagtggagaagaaggagagagccagactgaagaccgtgaagttcaacagcaagaccagagacaagggccagagcttcaacgacaagagaaagaagaacctgttcagcagaaagttccccttctacaagaacaaggaccagagcgagcaggagaccagcgacgccgaccagcacgtgaccagcaacgccagcgacagcgagagcagctacagaggccaggaggagtacgtgctgagctacgagcccgtgaaccagcaggaggtgaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgaccagcagagagcagatggagaaggacatccaggagcacaagttcatcgaggccggccagtacaacaaccacctgtacggcaccagcgtgcagagcgtgagagaggtggccgagaagggcaagcactgcatcctggacgtgagcggcaacgccatcaagagactgcagatcgcccagctgtaccccatcagcatcttcatcaagcccaagagcatggagaacatcatggagatgaacaagagactgaccgaggagcaggccagaaagaccttcgagagagccatgaagctggagcaggagttcaccgagcacttcaccgccatcgtgcagggcgacaccctggaggacatctacaaccaggtgaagcagatcatcgaggagcagagcggcagctacatctgggtgcccgccaaggagaagctgtag

SEQ ID NO: 79359 - DNA, 2754 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccccagatcaccaacgaggtgatcggccccgagctggtgcacgtgagcgagaagaacctgagcgagatcgagaacgtgcacggcttcgtgagccacagccacatcagccccatcaagcccaccgaggccgtgctgcccagcccccccaccgtgcccgtgatccccgtgctgcccgtgcccgccgagaacaccgtgatcctgcccaccatcccccaggccaaccccccccccgtgctggtgaacaccgacagcctggagacccccacctacgtgaacggcaccgacgccgactacgagtacgaggagatcaccctggagagaggcaacagcggcctgggcttcagcatcgccggcggcaccgacaacccccacatcggcgacgacagcagcatcttcatcaccaagatcatcaccggcggcgccgccgcccaggacggcagactgagagtgaacgactgcatcctgagagtgaacgaggtggacgtgagagacgtgacccacagcaaggccgtggaggccctgaaggaggccggcagcatcgtgagactgtacgtgaagagaagaaagcccgtgagcgagaagatcatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcaagctgcagatcggcgacaagctgctggccgtgaacaacgtgtgcctggaggaggtgacccacgaggaggccgtgaccgccctgaagaacaccagcgacttcgtgtacctgaaggtggccaagcccaccagcatgtacatgaacgacggctacgccccccccgacatcaccaacagcagcagccagcccgtggacaaccacgtgagccccagcagcttcctgggccagacccccgccagccccgccagatacagccccgtgagcaaggccgtgctgggcgacgacgagatcaccagagagcccagaaaggtggtgctgcacagaggcagcaccggcctgggcttcaacatcgtgggcggcgaggacggcgagggcatcttcatcagcttcatcctggccggcggccccgccgacctgagcggcgagctgagaaagggcgacagaatcatcagcgtgaacagcgtggacctgagagccgccagccacgagcaggccgccgccgccctgaagaacgccggccaggccgtgaccatcgtggcccagtacagacccgaggagtacagcagattcgaggccaagatccacgacctgagagagcagatgatgaacagcagcatcagcagcggcagcggcagcctgagaaccagccagaagagaagcctgtacgtgagagccctgttcgactacgacaagaccaaggacagcggcctgcccagccagggcctgaacttcaagttcggcgacatcctgcacgtgatcaacgccagcgacgacgagtggtggcaggccagacaggtgacccccgacggcgagagcgacgaggtgggcgtgatccccagcaagagaagagtggagaagaaggagagagccagactgaagaccgtgaagttcaacagcaagaccagagacaagggcgagatccccgacgacatgggcagcaagggcctgaagcacgtgaccagcaacgccagcgacagcgagagcagctacctgatcctgatcaccgacgagtacggctgcagcaagggcagaggccaggaggagtacgtgctgagctacgagcccgtgaaccagcaggaggtgaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgaccagcagagagcagatggagaaggacatccaggagcacaagttcatcgaggccggccagtacaacaaccacctgtacggcaccagcgtgcagagcgtgagagaggtggccgagaagggcaagcactgcatcctggacgtgagcggcaacgccatcaagagactgcagatcgcccagctgtaccccatcagcatcttcatcaagcccaagagcatggagaacatcatggagatgaacaagagactgaccgaggagcaggccagaaagaccttcgagagagccatgaagctggagcaggagttcaccgagcacttcaccgccatcgtgcagggcgacaccctggaggacatctacaaccaggtgaagcagatcatcgaggagcagagcggcagctacatctgggtgcccgccaaggagaagctgtag

SEQ ID NO: 79360 - DNA, 2676 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccccagatcaccaacgaggtgatcggccccgagctggtgcacgtgagcgagaagaacctgagcgagatcgagaacgtgcacggcttcgtgagccacagccacatcagccccatcaagcccaccgaggccgtgctgcccagcccccccaccgtgcccgtgatccccgtgctgcccgtgcccgccgagaacaccgtgatcctgcccaccatcccccaggccaaccccccccccgtgctggtgaacaccgacagcctggagacccccacctacgtgaacggcaccgacgccgactacgagtacgaggagatcaccctggagagaggcaacagcggcctgggcttcagcatcgccggcggcaccgacaacccccacatcggcgacgacagcagcatcttcatcaccaagatcatcaccggcggcgccgccgcccaggacggcagactgagagtgaacgactgcatcctgagagtgaacgaggtggacgtgagagacgtgacccacagcaaggccgtggaggccctgaaggaggccggcagcatcgtgagactgtacgtgaagagaagaaagcccgtgagcgagaagatcatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcaagctgcagatcggcgacaagctgctggccgtgaacaacgtgtgcctggaggaggtgacccacgaggaggccgtgaccgccctgaagaacaccagcgacttcgtgtacctgaaggtggccaagcccaccagcatgtacatgaacgacggctacgccccccccgacatcaccaacagcagcagccagcccgtggacaaccacgtgagccccagcagcttcctgggccagacccccgccagccccgccagatacagccccgtgagcaaggccgtgctgggcgacgacgagatcaccagagagcccagaaaggtggtgctgcacagaggcagcaccggcctgggcttcaacatcgtgggcggcgaggacggcgagggcatcttcatcagcttcatcctggccggcggccccgccgacctgagcggcgagctgagaaagggcgacagaatcatcagcgtgaacagcgtggacctgagagccgccagccacgagcaggccgccgccgccctgaagaacgccggccaggccgtgaccatcgtggcccagtacagacccgaggagtacagcagattcgaggccaagatccacgacctgagagagcagatgatgaacagcagcatcagcagcggcagcggcagcctgagaaccagccagaagagaagcctgtacgtgagagccctgttcgactacgacaagaccaaggacagcggcctgcccagccagggcctgaacttcaagttcggcgacatcctgcacgtgatcaacgccagcgacgacgagtggtggcaggccagacaggtgacccccgacggcgagagcgacgaggtgggcgtgatccccagcaagagaagagtggagaagaaggagagagccagactgaagaccgtgaagttcaacagcaagaccagagacaagggcgagatccccgacgacatgggcagcaagggcctgatcggcggccaggaggagtacgtgctgagctacgagcccgtgaaccagcaggaggtgaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgaccagcagagagcagatggagaaggacatccaggagcacaagttcatcgaggccggccagtacaacaaccacctgtacggcaccagcgtgcagagcgtgagagaggtggccgagaagggcaagcactgcatcctggacgtgagcggcaacgccatcaagagactgcagatcgcccagctgtaccccatcagcatcttcatcaagcccaagagcatggagaacatcatggagatgaacaagagactgaccgaggagcaggccagaaagaccttcgagagagccatgaagctggagcaggagttcaccgagcacttcaccgccatcgtgcagggcgacaccctggaggacatctacaaccaggtgaagcagatcatcgaggagcagagcggcagctacatctgggtgcccgccaaggagaagctgtag

SEQ ID NO: 79361 - DNA, 627 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccccagatcaccaacgaggtgatcggccccgagctggtgcacgtgagcgagaagaacctgagcgagatcgagaacgtgcacggcttcgtgagccacagccacatcagccccatcaagcccaccgaggccgtgctgcccagcccccccaccgtgcccgtgatccccgtgctgcccgtgcccgccgagaacaccgtgatcctgcccaccatcccccaggccaaccccccccccgtgctggtgaacaccgacagcctggagtag

SEQ ID NO: 79362 - DNA, 2616 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccccagatcaccaacgaggtgatcggccccgagctggtgcacgtgagcgagaagaacctgagcgagatcgagaacgtgcacggcttcgtgagccacagccacatcagccccatcaaggccaaccccccccccgtgctggtgaacaccgacagcctggagacccccacctacgtgaacggcaccgacgccgactacgagtacgaggagatcaccctggagagaggcaacagcggcctgggcttcagcatcgccggcggcaccgacaacccccacatcggcgacgacagcagcatcttcatcaccaagatcatcaccggcggcgccgccgcccaggacggcagactgagagtgaacgactgcatcctgagagtgaacgaggtggacgtgagagacgtgacccacagcaaggccgtggaggccctgaaggaggccggcagcatcgtgagactgtacgtgaagagaagaaagcccgtgagcgagaagatcatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcaagctgcagatcggcgacaagctgctggccgtgaacaacgtgtgcctggaggaggtgacccacgaggaggccgtgaccgccctgaagaacaccagcgacttcgtgtacctgaaggtggccaagcccaccagcatgtacatgaacgacggctacgccccccccgacatcaccaacagcagcagccagcccgtggacaaccacgtgagccccagcagcttcctgggccagacccccgccagccccgccagatacagccccgtgagcaaggccgtgctgggcgacgacgagatcaccagagagcccagaaaggtggtgctgcacagaggcagcaccggcctgggcttcaacatcgtgggcggcgaggacggcgagggcatcttcatcagcttcatcctggccggcggccccgccgacctgagcggcgagctgagaaagggcgacagaatcatcagcgtgaacagcgtggacctgagagccgccagccacgagcaggccgccgccgccctgaagaacgccggccaggccgtgaccatcgtggcccagtacagacccgaggagtacagcagattcgaggccaagatccacgacctgagagagcagatgatgaacagcagcatcagcagcggcagcggcagcctgagaaccagccagaagagaagcctgtacgtgagagccctgttcgactacgacaagaccaaggacagcggcctgcccagccagggcctgaacttcaagttcggcgacatcctgcacgtgatcaacgccagcgacgacgagtggtggcaggccagacaggtgacccccgacggcgagagcgacgaggtgggcgtgatccccagcaagagaagagtggagaagaaggagagagccagactgaagaccgtgaagttcaacagcaagaccagagacaagggcgagatccccgacgacatgggcagcaagggcctgaagcacgtgaccagcaacgccagcgacagcgagagcagctacagaggccaggaggagtacgtgctgagctacgagcccgtgaaccagcaggaggtgaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgaccagcagagagcagatggagaaggacatccaggagcacaagttcatcgaggccggccagtacaacaaccacctgtacggcaccagcgtgcagagcgtgagagaggtggccgagaagggcaagcactgcatcctggacgtgagcggcaacgccatcaagagactgcagatcgcccagctgtaccccatcagcatcttcatcaagcccaagagcatggagaacatcatggagatgaacaagagactgaccgaggagcaggccagaaagaccttcgagagagccatgaagctggagcaggagttcaccgagcacttcaccgccatcgtgcagggcgacaccctggaggacatctacaaccaggtgaagcagatcatcgaggagcagagcggcagctacatctgggtgcccgccaaggagaagctgtag

SEQ ID NO: 79363 - DNA, 321 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagtag

SEQ ID NO: 79364 - DNA, 1113 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccccagatcaccaacgaggtgatcggccccgagctggtgcacgtgagcgagaagaacctgagcgagatcgagaacgtgcacggcttcgtgagccacagccacatcagccccatcaaggtgaacggcaccgacgccgactacgagtacgaggagatcaccctggagagaggcaacagcggcctgggcttcagcatcgccggcggcaccgacaacccccacatcggcgacgacagcagcatcttcatcaccaagatcatcaccggcggcgccgccgcccaggacggcagactgagagtgaacgactgcatcctgagagtgaacgaggtggacgtgagagacgtgacccacagcaaggccgtggaggccctgaaggaggccggcagcatcgtgagactgtacgtgaagagaagaaagcccgtgagcgagaagatcatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcaagctgcagatcggcgacaagctgctggccgtgaacaacgtgtgcctggaggaggtgacccacgaggaggccgtgaccgccctgaagaacaccagcgacttcgtgtacctgaaggtggccaagcccaccagcatgtacatgaacgacggctacgccccccccgacatcaccaactag

SEQ ID NO: 79365 - DNA, 2715 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccccagatcaccaacgaggtgatcggccccgagctggtgcacgtgagcgagaagaacctgagcgagatcgagaacgtgcacggcttcgtgagccacagccacatcagccccatcaagcccaccgaggccgtgctgcccagcccccccaccgtgcccgtgatccccgtgctgcccgtgcccgccgagaacaccgtgatcctgcccaccatcccccaggccaaccccccccccgtgctggtgaacaccgacagcctggagacccccacctacgtgaacggcaccgacgccgactacgagtacgaggagatcaccctggagagaggcaacagcggcctgggcttcagcatcgccggcggcaccgacaacccccacatcggcgacgacagcagcatcttcatcaccaagatcatcaccggcggcgccgccgcccaggacggcagactgagagtgaacgactgcatcctgagagtgaacgaggtggacgtgagagacgtgacccacagcaaggccgtggaggccctgaaggaggccggcagcatcgtgagactgtacgtgaagagaagaaagcccgtgagcgagaagatcatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcaagctgcagatcggcgacaagctgctggccgtgaacaacgtgtgcctggaggaggtgacccacgaggaggccgtgaccgccctgaagaacaccagcgacttcgtgtacctgaaggtggccaagcccaccagcatgtacatgaacgacggctacgccccccccgacatcaccaacagcagcagccagcccgtggacaaccacgtgagccccagcagcttcctgggccagacccccgccagccccgccagatacagccccgtgagcaaggccgtgctgggcgacgacgagatcaccagagagcccagaaaggtggtgctgcacagaggcagcaccggcctgggcttcaacatcgtgggcggcgaggacggcgagggcatcttcatcagcttcatcctggccggcggccccgccgacctgagcggcgagctgagaaagggcgacagaatcatcagcgtgaacagcgtggacctgagagccgccagccacgagcaggccgccgccgccctgaagaacgccggccaggccgtgaccatcgtggcccagtacagacccgaggagtacagcagattcgaggccaagatccacgacctgagagagcagatgatgaacagcagcatcagcagcggcagcggcagcctgagaaccagccagaagagaagcctgtacgtgagagccctgttcgactacgacaagaccaaggacagcggcctgcccagccagggcctgaacttcaagttcggcgacatcctgcacgtgatcaacgccagcgacgacgagtggtggcaggccagacaggtgacccccgacggcgagagcgacgaggtgggcgtgatccccagcaagagaagagtggagaagaaggagagagccagactgaagaccgtgaagttcaacagcaagaccagagacaagggcgagatccccgacgacatgggcagcaagggcctgaagcacgtgaccagcaacgccagcgacagcgagagcagctacagaggccaggaggagtacgtgctgagctacgagcccgtgaaccagcaggaggtgaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgaccagcagagagcagatggagaaggacatccaggagcacaagttcatcgaggccggccagtacaacaaccacctgtacggcaccagcgtgcagagcgtgagagaggtggccgagaagggcaagcactgcatcctggacgtgagcggcaacgccatcaagagactgcagatcgcccagctgtaccccatcagcatcttcatcaagcccaagagcatggagaacatcatggagatgaacaagagactgaccgaggagcaggccagaaagaccttcgagagagccatgaagctggagcaggagttcaccgagcacttcaccgccatcgtgcagggcgacaccctggaggacatctacaaccaggtgaagcagatcatcgaggagcagagcggcagctacatctgggtgcccgccaaggagaagctgtag

SEQ ID NO: 79366 - DNA, 465 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccccagatcaccaacgaggtgatcggccccgagctggtgcacgtgagcgagaagaacctgagcgagatcgagaacgtgcacggcttcgtgagccactag

SEQ ID NO: 79367 - DNA, 2562 bp, Artificial Sequence; identical to SEQ ID NO: 79356
  Description of Artificial Sequence: Synthetic coding sequence

SEQ ID NO: 79368 - DNA, 111 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagatag

SEQ ID NO: 79369 - DNA, 372 bp, Artificial Sequence
  Description of Artificial Sequence: Synthetic coding sequence
atgcccgtgagaaagcaggacacccagagagccctgcacctgctggaggagtacagaagcaagctgagccagaccgaggacagacagctgagaagcagcatcgagagagtgatcaacatcttccagagcaacctgttccaggccctgatcgacatccaggagttctacgaggtgaccctgctggacaaccccaagtgcatcgacagaagcaagcccagcgagcccatccagcccgtgaacacctgggagatcagcagcctgcccagcagcaccgtgaccagcgagaccctgcccagcagcctgagccccagcgtggagaagtacagataccaggacgaggacacccccccccaggagcacatcagcccctag

SEQ ID NO: 79370 - DNA, 2715 bp, Artificial Sequence; identical to SEQ ID NO: 79365
  Description of Artificial Sequence: Synthetic coding sequence

SEQ ID NO: 79371 - DNA, 2682 bp, Artificial Sequence; identical to SEQ ID NO: 79358
  Description of Artificial Sequence: Synthetic coding sequence

SEQ ID NO: 79372 - DNA, 2730 bp, Artificial Sequence
  Description of Artificial Sequence: Synthetic coding sequence
atgaacgcctacctgaccaagcagcacagctgcagcagaggcagcgacggcatggacgccgtgagaagcgcccccaccctgatcagagacgcccactgcgcctgcggctggcagagaaactgccagggcctgggctacagcagccagaccatgcccagcagcggccccggcggccccgccagcaacagaaccggcggcagcagcttcaacagaaccctgtgggacagcgtgagaaagagcccccacaagaccagcaccaagggcaagggcacctgcggcgagcactgcacctgcccccacggctggttcagccccgcccaggccagccccgcccccatcatcgtgaacaccgacaccctggacaccatcccctacgtgaacggcaccgagatcgagtacgagttcgaggagatcaccctggagagaggcaacagcggcctgggcttcagcatcgccggcggcaccgacaacccccacatcggcgacgaccccggcatcttcatcaccaagatcatccccggcggcgccgccgccgaggacggcagactgagagtgaacgactgcatcctgagagtgaacgaggtggacgtgagcgaggtgagccacagcaaggccgtggaggccctgaaggaggccggcagcatcgtgagactgtacgtgagaagaagaagacccatcctggagaccgtggtggagatcaagctgttcaagggccccaagggcctgggcttcagcatcgccggcggcgtgggcaaccagcacatccccggcgacaacagcatctacgtgaccaagatcatcgacggcggcgccgcccagaaggacggcagactgcaggtgggcgacagactgctgatggtgaacaactacagcctggaggaggtgacccacgaggaggccgtggccatcctgaagaacaccagcgaggtggtgtacctgaaggtgggcaagcccaccaccatctacatgaccgacccctacggcccccccgacatcacccacagctacagcccccccatggagaaccacctgctgagcggcaacaacggcaccctggagtacaagaccagcctgccccccatcagccccggcagatacagccccatccccaagcacatgctggtggacgacgactacaccagaccccccgagcccgtgtacagcaccgtgaacaagctgtgcgacaagcccgccagccccagacactacagccccgtggagtgcgacaagagcttcctgctgagcgccccctacagccactaccacctgggcctgctgcccgacagcgagatgaccagccacagccagcacagcaccgccaccagacagcccagcatgaccctgcagagagccgtgagcctggagggcgagcccagaaaggtggtgctgcacaagggcagcaccggcctgggcttcaacatcgtgggcggcgaggacggcgagggcatcttcgtgagcttcatcctggccggcggccccgccgacctgagcggcgagctgcagagaggcgaccagatcctgagcgtgaacggcatcgacctgagaggcgccagccacgagcaggccgccgccgccctgaagggcgccggccagaccgtgaccatcatcgcccagtaccagcccgaggactacgccagattcgaggccaagatccacgacctgagagagcagatgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcagcttcaacgacaagagaaagaagagcttcatcttcagcagaaagttccccttctacaagaacaaggagcagagcgagcaggagaccagcgaccccgagagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79373 - DNA, 2376 bp, Artificial Sequence
  Description of Artificial Sequence: Synthetic coding sequence
atgcagcacgccttcatccccgccagccccgcccccatcatcgtgaacaccgacaccctggacaccatcccctacgtgaacggcaccgagatcgagtacgagttcgaggagatcaccctggagagaggcaacagcggcctgggcttcagcatcgccggcggcaccgacaacccccacatcggcgacgaccccggcatcttcatcaccaagatcatccccggcggcgccgccgccgaggacggcagactgagagtgaacgactgcatcctgagagtgaacgaggtggacgtgagcgaggtgagccacagcaaggccgtggaggccctgaaggaggccggcagcatcgtgagactgtacgtgagaagaagaagacccatcctggagaccgtggtggagatcaagctgttcaagggccccaagggcctgggcttcagcatcgccggcggcgtgggcaaccagcacatccccggcgacaacagcatctacgtgaccaagatcatcgacggcggcgccgcccagaaggacggcagactgcaggtgggcgacagactgctgatggtgaacaactacagcctggaggaggtgacccacgaggaggccgtggccatcctgaagaacaccagcgaggtggtgtacctgaaggtgggcaagcccaccaccatctacatgaccgacccctacggcccccccgacatcacccacagctacagcccccccatggagaaccacctgctgagcggcaacaacggcaccctggagtacaagaccagcctgccccccatcagccccggcagatacagccccatccccaagcacatgctggtggacgacgactacaccagaccccccgagcccgtgtacagcaccgtgaacaagctgtgcgacaagcccgccagccccagacactacagccccgtggagtgcgacaagagcttcctgctgagcgccccctacagccactaccacctgggcctgctgcccgacagcgagatgaccagccacagccagcacagcaccgccaccagacagcccagcatgaccctgcagagagccgtgagcctggagggcgagcccagaaaggtggtgctgcacaagggcagcaccggcctgggcttcaacatcgtgggcggcgaggacggcgagggcatcttcgtgagcttcatcctggccggcggccccgccgacctgagcggcgagctgcagagaggcgaccagatcctgagcgtgaacggcatcgacctgagaggcgccagccacgagcaggccgccgccgccctgaagggcgccggccagaccgtgaccatcatcgcccagtaccagcccgaggactacgccagattcgaggccaagatccacgacctgagagagcagatgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcgacatccccggcctgggcgacgacggctacggcaccaagaccctgagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79374 - DNA, 2928 bp, Artificial Sequence
  Description of Artificial Sequence: Synthetic coding sequence
atgggcatcttcaagagcagcctgttccaggccctgctggacatccaggagttctacgaggtgaccctgctgaacagccagaagagctgcgagcagaagatcgaggaggccaaccaggtgctgcagaagtgggagaagaccagcctgctggccccctgccacgacagactgcagaagagcagcgagctgaccgactgcagcggcagcaaggagaacgccagctgcatcgagcagaacaaggagaaccagagcttcgagaacgagaccgacgagaccaccacccagaaccagggcagatgccccgcccagaactgcagcgtggaggcccccgcctggatgcccgtgcaccactgcaccaagtacagataccaggacgaggacgccccccacgaccacagcctgcccagactgacccacgaggtgagaggccccgagctggtgcacgtgagcgagaagaacctgagccagatcgagaacgtgcacggctacgtgctgcagagccacatcagccccctgaaggccagccccgcccccatcatcgtgaacaccgacaccctggacaccatcccctacgtgaacggcaccgagatcgagtacgagttcgaggagatcaccctggagagaggcaacagcggcctgggcttcagcatcgccggcggcaccgacaacccccacatcggcgacgaccccggcatcttcatcaccaagatcatccccggcggcgccgccgccgaggacggcagactgagagtgaacgactgcatcctgagagtgaacgaggtggacgtgagcgaggtgagccacagcaaggccgtggaggccctgaaggaggccggcagcatcgtgagactgtacgtgagaagaagaagacccatcctggagaccgtggtggagatcaagctgttcaagggccccaagggcctgggcttcagcatcgccggcggcgtgggcaaccagcacatccccggcgacaacagcatctacgtgaccaagatcatcgacggcggcgccgcccagaaggacggcagactgcaggtgggcgacagactgctgatggtgaacaactacagcctggaggaggtgacccacgaggaggccgtggccatcctgaagaacaccagcgaggtggtgtacctgaaggtgggcaagcccaccaccatctacatgaccgacccctacggcccccccgacatcacccacagctacagcccccccatggagaaccacctgctgagcggcaacaacggcaccctggagtacaagaccagcctgccccccatcagccccggcagatacagccccatccccaagcacatgctggtggacgacgactacaccagaccccccgagcccgtgtacagcaccgtgaacaagctgtgcgacaagcccgccagccccagacactacagccccgtggagtgcgacaagagcttcctgctgagcgccccctacagccactaccacctgggcctgctgcccgacagcgagatgaccagccacagccagcacagcaccgccaccagacagcccagcatgaccctgcagagagccgtgagcctggagggcgagcccagaaaggtggtgctgcacaagggcagcaccggcctgggcttcaacatcgtgggcggcgaggacggcgagggcatcttcgtgagcttcatcctggccggcggccccgccgacctgagcggcgagctgcagagaggcgaccagatcctgagcgtgaacggcatcgacctgagaggcgccagccacgagcaggccgccgccgccctgaagggcgccggccagaccgtgaccatcatcgcccagtaccagcccgaggactacgccagattcgaggccaagatccacgacctgagagagcagatgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcagcttcaacgacaagagaaagaagagcttcatcttcagcagaaagttccccttctacaagaacaaggagcagagcgagcaggagaccagcgaccccgagagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79375 - DNA, 1005 bp, Artificial Sequence
  Description of Artificial Sequence: Synthetic coding sequence
atgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcgacatccccggcctgggcgacgacggctacggcaccaagaccctgagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79376 - DNA, 2613 bp, Artificial Sequence
  Description of Artificial Sequence: Synthetic coding sequence
atgttcttcgcctgctactgcgccctgagaaccaacgtgaagaagtacagataccaggacgaggacgccccccacgaccacagcctgcccagactgacccacgaggtgagaggccccgagctggtgcacgtgagcgagaagaacctgagccagatcgagaacgtgcacggctacgtgctgcagagccacatcagccccctgaaggccagccccgcccccatcatcgtgaacaccgacaccctggacaccatcccctacgtgaacggcaccgagatcgagtacgagttcgaggagatcaccctggagagaggcaacagcggcctgggcttcagcatcgccggcggcaccgacaacccccacatcggcgacgaccccggcatcttcatcaccaagatcatccccggcggcgccgccgccgaggacggcagactgagagtgaacgactgcatcctgagagtgaacgaggtggacgtgagcgaggtgagccacagcaaggccgtggaggccctgaaggaggccggcagcatcgtgagactgtacgtgagaagaagaagacccatcctggagaccgtggtggagatcaagctgttcaagggccccaagggcctgggcttcagcatcgccggcggcgtgggcaaccagcacatccccggcgacaacagcatctacgtgaccaagatcatcgacggcggcgccgcccagaaggacggcagactgcaggtgggcgacagactgctgatggtgaacaactacagcctggaggaggtgacccacgaggaggccgtggccatcctgaagaacaccagcgaggtggtgtacctgaaggtgggcaagcccaccaccatctacatgaccgacccctacggcccccccgacatcacccacagctacagcccccccatggagaaccacctgctgagcggcaacaacggcaccctggagtacaagaccagcctgccccccatcagccccggcagatacagccccatccccaagcacatgctggtggacgacgactacaccagaccccccgagcccgtgtacagcaccgtgaacaagctgtgcgacaagcccgccagccccagacactacagccccgtggagtgcgacaagagcttcctgctgagcgccccctacagccactaccacctgggcctgctgcccgacagcgagatgaccagccacagccagcacagcaccgccaccagacagcccagcatgaccctgcagagagccgtgagcctggagggcgagcccagaaaggtggtgctgcacaagggcagcaccggcctgggcttcaacatcgtgggcggcgaggacggcgagggcatcttcgtgagcttcatcctggccggcggccccgccgacctgagcggcgagctgcagagaggcgaccagatcctgagcgtgaacggcatcgacctgagaggcgccagccacgagcaggccgccgccgccctgaagggcgccggccagaccgtgaccatcatcgcccagtaccagcccgaggactacgccagattcgaggccaagatccacgacctgagagagcagatgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcagcttcaacgacaagagaaagaagagcttcatcttcagcagaaagttccccttctacaagaacaaggagcagagcgagcaggagaccagcgaccccgagagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79377 - DNA, 1047 bp, Artificial Sequence
  Description of Artificial Sequence: Synthetic coding sequence
atgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcgacatccccggcctgggcgacgacggctacggcaccaagaccctgaagcacgtgagcagcaacgccagcgacagcgagagcagctacagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79378 - DNA, 2250 bp, Artificial Sequence
  Description of Artificial Sequence: Synthetic coding sequence
atgcagagacccagcgtgagcagagccgagaactaccagctgctgtgggacaccatcgccagcctgaagcagtgcgagcaggccatgcagcacgccttcatccccgtgaacggcaccgagatcgagtacgagttcgaggagatcaccctggagagaggcaacagcggcctgggcttcagcatcgccggcggcaccgacaacccccacatcggcgacgaccccggcatcttcatcaccaagatcatccccggcggcgccgccgccgaggacggcagactgagagtgaacgactgcatcctgagagtgaacgaggtggacgtgagcgaggtgagccacagcaaggccgtggaggccctgaaggaggccggcagcatcgtgagactgtacgtgagaagaagaagacccatcctggagaccgtggtggagatcaagctgttcaagggccccaagggcctgggcttcagcatcgccggcggcgtgggcaaccagcacatccccggcgacaacagcatctacgtgaccaagatcatcgacggcggcgccgcccagaaggacggcagactgcaggtgggcgacagactgctgatggtgaacaactacagcctggaggaggtgacccacgaggaggccgtggccatcctgaagaacaccagcgaggtggtgtacctgaaggtgggcaagcccaccaccatctacatgaccgacccctacggcccccccgacatcacccacagctacagcccccccatggagaaccacctgctgagcggcaacaacggcaccctggagtacaagaccagcctgccccccatcagccccggcagatacagccccatccccaagcacatgctggtggacgacgactacaccagccacagccagcacagcaccgccaccagacagcccagcatgaccctgcagagagccgtgagcctggagggcgagcccagaaaggtggtgctgcacaagggcagcaccggcctgggcttcaacatcgtgggcggcgaggacggcgagggcatcttcgtgagcttcatcctggccggcggccccgccgacctgagcggcgagctgcagagaggcgaccagatcctgagcgtgaacggcatcgacctgagaggcgccagccacgagcaggccgccgccgccctgaagggcgccggccagaccgtgaccatcatcgcccagtaccagcccgaggactacgccagattcgaggccaagatccacgacctgagagagcagatgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcgacatccccggcctgggcgacgacggctacggcaccaagaccctgagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79379 - DNA, 1005 bp, Artificial Sequence; identical to SEQ ID NO: 79375
  Description of Artificial Sequence: Synthetic coding sequence

SEQ ID NO: 79380 - DNA, 2601 bp, Artificial Sequence
  Description of Artificial Sequence: Synthetic coding sequence
atgttcttcgcctgctactgcgccctgagaaccaacgtgaagaagtacagataccaggacgaggacgccccccacgaccacagcctgcccagactgacccacgaggtgagaggccccgagctggtgcacgtgagcgagaagaacctgagccagatcgagaacgtgcacggctacgtgctgcagagccacatcagccccctgaaggccagccccgcccccatcatcgtgaacaccgacaccctggacaccatcccctacgtgaacggcaccgagatcgagtacgagttcgaggagatcaccctggagagaggcaacagcggcctgggcttcagcatcgccggcggcaccgacaacccccacatcggcgacgaccccggcatcttcatcaccaagatcatccccggcggcgccgccgccgaggacggcagactgagagtgaacgactgcatcctgagagtgaacgaggtggacgtgagcgaggtgagccacagcaaggccgtggaggccctgaaggaggccggcagcatcgtgagactgtacgtgagaagaagaagacccatcctggagaccgtggtggagatcaagctgttcaagggccccaagggcctgggcttcagcatcgccggcggcgtgggcaaccagcacatccccggcgacaacagcatctacgtgaccaagatcatcgacggcggcgccgcccagaaggacggcagactgcaggtgggcgacagactgctgatggtgaacaactacagcctggaggaggtgacccacgaggaggccgtggccatcctgaagaacaccagcgaggtggtgtacctgaaggtgggcaagcccaccaccatctacatgaccgacccctacggcccccccgacatcacccacagctacagcccccccatggagaaccacctgctgagcggcaacaacggcaccctggagtacaagaccagcctgccccccatcagccccggcagatacagccccatccccaagcacatgctggtggacgacgactacaccagaccccccgagcccgtgtacagcaccgtgaacaagctgtgcgacaagcccgccagccccagacactacagccccgtggagtgcgacaagagcttcctgctgagcgccccctacagccactaccacctgggcctgctgcccgacagcgagatgaccagccacagccagcacagcaccgccaccagacagcccagcatgaccctgcagagagccgtgagcctggagggcgagcccagaaaggtggtgctgcacaagggcagcaccggcctgggcttcaacatcgtgggcggcgaggacggcgagggcatcttcgtgagcttcatcctggccggcggccccgccgacctgagcggcgagctgcagagaggcgaccagatcctgagcgtgaacggcatcgacctgagaggcgccagccacgagcaggccgccgccgccctgaagggcgccggccagaccgtgaccatcatcgcccagtaccagcccgaggactacgccagattcgaggccaagatccacgacctgagagagcagatgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcgacatccccggcctgggcgacgacggctacggcaccaagaccctgaagcacgtgagcagcaacgccagcgacagcgagagcagctacagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79381 - DNA, 285 bp, Artificial Sequence
  Description of Artificial Sequence: Synthetic coding sequence
atgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagacctag

SEQ ID NO: 79382 - DNA, 2559 bp, Artificial Sequence
  Description of Artificial Sequence: Synthetic coding sequence
atgttcttcgcctgctactgcgccctgagaaccaacgtgaagaagtacagataccaggacgaggacgccccccacgaccacagcctgcccagactgacccacgaggtgagaggccccgagctggtgcacgtgagcgagaagaacctgagccagatcgagaacgtgcacggctacgtgctgcagagccacatcagccccctgaaggccagccccgcccccatcatcgtgaacaccgacaccctggacaccatcccctacgtgaacggcaccgagatcgagtacgagttcgaggagatcaccctggagagaggcaacagcggcctgggcttcagcatcgccggcggcaccgacaacccccacatcggcgacgaccccggcatcttcatcaccaagatcatccccggcggcgccgccgccgaggacggcagactgagagtgaacgactgcatcctgagagtgaacgaggtggacgtgagcgaggtgagccacagcaaggccgtggaggccctgaaggaggccggcagcatcgtgagactgtacgtgagaagaagaagacccatcctggagaccgtggtggagatcaagctgttcaagggccccaagggcctgggcttcagcatcgccggcggcgtgggcaaccagcacatccccggcgacaacagcatctacgtgaccaagatcatcgacggcggcgccgcccagaaggacggcagactgcaggtgggcgacagactgctgatggtgaacaactacagcctggaggaggtgacccacgaggaggccgtggccatcctgaagaacaccagcgaggtggtgtacctgaaggtgggcaagcccaccaccatctacatgaccgacccctacggcccccccgacatcacccacagctacagcccccccatggagaaccacctgctgagcggcaacaacggcaccctggagtacaagaccagcctgccccccatcagccccggcagatacagccccatccccaagcacatgctggtggacgacgactacaccagaccccccgagcccgtgtacagcaccgtgaacaagctgtgcgacaagcccgccagccccagacactacagccccgtggagtgcgacaagagcttcctgctgagcgccccctacagccactaccacctgggcctgctgcccgacagcgagatgaccagccacagccagcacagcaccgccaccagacagcccagcatgaccctgcagagagccgtgagcctggagggcgagcccagaaaggtggtgctgcacaagggcagcaccggcctgggcttcaacatcgtgggcggcgaggacggcgagggcatcttcgtgagcttcatcctggccggcggccccgccgacctgagcggcgagctgcagagaggcgaccagatcctgagcgtgaacggcatcgacctgagaggcgccagccacgagcaggccgccgccgccctgaagggcgccggccagaccgtgaccatcatcgcccagtaccagcccgaggactacgccagattcgaggccaagatccacgacctgagagagcagatgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcgacatccccggcctgggcgacgacggctacggcaccaagaccctgagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79383 - DNA, 1863 bp, Artificial Sequence
  Description of Artificial Sequence: Synthetic coding sequence
atggtgaacaactacagcctggaggaggtgacccacgaggaggccgtggccatcctgaagaacaccagcgaggtggtgtacctgaaggtgggcaagcccaccaccatctacatgaccgacccctacggcccccccgacatcacccacagctacagcccccccatggagaaccacctgctgagcggcaacaacggcaccctggagtacaagaccagcctgccccccatcagccccggcagatacagccccatccccaagcacatgctggtggacgacgactacaccagaccccccgagcccgtgtacagcaccgtgaacaagctgtgcgacaagcccgccagccccagacactacagccccgtggagtgcgacaagagcttcctgctgagcgccccctacagccactaccacctgggcctgctgcccgacagcgagatgaccagccacagccagcacagcaccgccaccagacagcccagcatgaccctgcagagagccgtgagcctggagggcgagcccagaaaggtggtgctgcacaagggcagcaccggcctgggcttcaacatcgtgggcggcgaggacggcgagggcatcttcgtgagcttcatcctggccggcggccccgccgacctgagcggcgagctgcagagaggcgaccagatcctgagcgtgaacggcatcgacctgagaggcgccagccacgagcaggccgccgccgccctgaagggcgccggccagaccgtgaccatcatcgcccagtaccagcccgaggactacgccagattcgaggccaagatccacgacctgagagagcagatgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcgacatccccggcctgggcgacgacggctacggcaccaagaccctgaagcacgtgagcagcaacgccagcgacagcgagagcagctacagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79384 - DNA, 2928 bp, Artificial Sequence; identical to SEQ ID NO: 79374
  Description of Artificial Sequence: Synthetic coding sequence

SEQ ID NO: 79385 - DNA, 2928 bp, Artificial Sequence
  Description of Artificial Sequence: Synthetic coding sequence
ttcggcttcatcgtgagcgtgcacttccagagctacctgaacatccaggagttctacgaggtgaccctgctgaacagccagaagagctgcgagcagaagatcgaggaggccaaccaggtgctgcagaagtgggagaagaccagcctgctggccccctgccacgacagactgcagaagagcagcgagctgaccgactgcagcggcagcaaggagaacgccagctgcatcgagcagaacaaggagaaccagagcttcgagaacgagaccgacgagaccaccacccagaaccagggcagatgccccgcccagaactgcagcgtggaggcccccgcctggatgcccgtgcaccactgcaccaagtacagataccaggacgaggacgccccccacgaccacagcctgcccagactgacccacgaggtgagaggccccgagctggtgcacgtgagcgagaagaacctgagccagatcgagaacgtgcacggctacgtgctgcagagccacatcagccccctgaaggccagccccgcccccatcatcgtgaacaccgacaccctggacaccatcccctacgtgaacggcaccgagatcgagtacgagttcgaggagatcaccctggagagaggcaacagcggcctgggcttcagcatcgccggcggcaccgacaacccccacatcggcgacgaccccggcatcttcatcaccaagatcatccccggcggcgccgccgccgaggacggcagactgagagtgaacgactgcatcctgagagtgaacgaggtggacgtgagcgaggtgagccacagcaaggccgtggaggccctgaaggaggccggcagcatcgtgagactgtacgtgagaagaagaagacccatcctggagaccgtggtggagatcaagctgttcaagggccccaagggcctgggcttcagcatcgccggcggcgtgggcaaccagcacatccccggcgacaacagcatctacgtgaccaagatcatcgacggcggcgccgcccagaaggacggcagactgcaggtgggcgacagactgctgatggtgaacaactacagcctggaggaggtgacccacgaggaggccgtggccatcctgaagaacaccagcgaggtggtgtacctgaaggtgggcaagcccaccaccatctacatgaccgacccctacggcccccccgacatcacccacagctacagcccccccatggagaaccacctgctgagcggcaacaacggcaccctggagtacaagaccagcctgccccccatcagccccggcagatacagccccatccccaagcacatgctggtggacgacgactacaccagaccccccgagcccgtgtacagcaccgtgaacaagctgtgcgacaagcccgccagccccagacactacagccccgtggagtgcgacaagagcttcctgctgagcgccccctacagccactaccacctgggcctgctgcccgacagcgagatgaccagccacagccagcacagcaccgccaccagacagcccagcatgaccctgcagagagccgtgagcctggagggcgagcccagaaaggtggtgctgcacaagggcagcaccggcctgggcttcaacatcgtgggcggcgaggacggcgagggcatcttcgtgagcttcatcctggccggcggccccgccgacctgagcggcgagctgcagagaggcgaccagatcctgagcgtgaacggcatcgacctgagaggcgccagccacgagcaggccgccgccgccctgaagggcgccggccagaccgtgaccatcatcgcccagtaccagcccgaggactacgccagattcgaggccaagatccacgacctgagagagcagatgatgaaccacagcatgagcagcggcagcggcagcctgagaaccaaccagaagagaagcctgtacgtgagagccatgttcgactacgacaagagcaaggacagcggcctgcccagccagggcctgagcttcaagtacggcgacatcctgcacgtgatcaacgccagcgacgacgagtggtggcaggccagaagagtgatgctggagggcgacagcgaggagatgggcgtgatccccagcaagagaagagtggagagaaaggagagagccagactgaagaccgtgaagttcaacgccaagcccggcgtgatcgacagcaagggcagcttcaacgacaagagaaagaagagcttcatcttcagcagaaagttccccttctacaagaacaaggagcagagcgagcaggagaccagcgaccccgagagaggccaggaggacctgatcctgagctacgagcccgtgaccagacaggagatcaactacaccagacccgtgatcatcctgggccccatgaaggacagaatcaacgacgacctgatcagcgagttccccgacaagttcggcagctgcgtgccccacaccaccagacccaagagagactacgaggtggacggcagagactaccacttcgtgatcagcagagagcagatggagaaggacatccaggagcacaagttcatcgaggccggccagtacaacgacaacctgtacggcaccagcgtgcagagcgtgagattcgtggccgagagaggcaagcactgcatcctggacgtgagcggcaacgccatcaagagactgcaggtggcccagctgtaccccatcgccatcttcatcaagcccagaagcctggagcccctgatggagatgaacaagagactgaccgaggagcaggccaagaagacctacgacagagccatcaagctggagcaggagttcggcgagtacttcaccgccatcgtgcagggcgacaccctggaggacatctacaaccagtgcaagctggtgatcgaggagcagagcggccccttcatctggatccccagcaaggagaagctgtag

SEQ ID NO: 79386 - DNA, 2550 bp, Artificial Sequence
  Description of Artificial Sequence: Synthetic coding sequence
atgcacaagcaccagcactgctgcaagtgccccgagtgctacgaggtgaccagactggccgccctgagaagactggagccccccggctacggcgactggcaggtgcccgacccctacggccccggcggcggcaacggcgccagcgccggctacggcggctacagcagccagaccctgcccagccaggccggcgccacccccacccccagaaccaaggccaagctgatccccaccggcagagacgtgggccccgtgccccccaagcccgtgcccggcaagagcacccccaagctgaacggcagcggccccagctggtggcccgagtgcacctgcaccaacagagactggtacgagcaggccagacccgcccccctgctggtgaaccccgagaccctgaagcacagcctgagcgtgaacggcagcgacggcatgttcaagtacgaggagatcgtgctggagagaggcaacagcggcctgggcttcagcatcgccggcggcatcgacaacccccacgtgcccgacgaccccggcatcttcatcaccaagatcatccccggcggcgccgccgccatggacggcagactgggcgtgaacgactgcgtgctgagagtgaacgaggtggacgtgagcgaggtggtgcacagcagagccgtggaggccctgaaggaggccggccccgtggtgagactggtggtgagaagaagacagcccccccccgagaccatcatggaggtgaacctgctgaagggccccaagggcctgggcttcagcatcgccggcggcatcggcaaccagcacatccccggcgacaacagcatctacatcaccaagatcatcgagggcggcgccgcccagaaggacggcagactgcagatcggcgacagactgctggccgtgaacaacaccaacctgcaggacgtgagacacgaggaggccgtggccagcctgaagaacaccagcgacatggtgtacctgaaggtggccaagcccggcagcctgcacctgaacgacatgtacgccccccccgactacgccagcaccttcaccgccctggccgacaaccacatcagccacaacagcagcctgggctacctgggcgccgtggagagcaaggtgagctaccccgcccccccccaggtgccccccaccagatacagccccatccccagacacatgctggccgaggaggacttcaccagagagcccagaaagatcatcctgcacaagggcagcaccggcctgggcttcaacatcgtgggcggcgaggacggcgagggcatcttcgtgagcttcatcctggccggcggccccgccgacctgagcggcgagctgagaagaggcgacagaatcctgagcgtgaacggcgtgaacctgagaaacgccacccacgagcaggccgccgccgccctgaagagagccggccagagcgtgaccatcgtggcccagtacagacccgaggagtacagcagattcgagagcaagatccacgacctgagagagcagatgatgaacagcagcatgagcagcggcagcggcagcctgagaaccagcgagaagagaagcctgtacgtgagagccctgttcgactacgacagaaccagagacagctgcctgcccagccagggcctgagcttcagctacggcgacatcctgcacgtgatcaacgccagcgacgacgagtggtggcaggccagactggtgaccccccacggcgagagcgagcagatcggcgtgatccccagcaagaagagagtggagaagaaggagagagccagactgaagaccgtgaagttccacgccagaaccggcatgatcgagagcaacagagacttccccggcctgagcgacgactactacggcgccaagaacctgaagggcgtgaccagcaacaccagcgacagcgagagcagcagcaagggccaggaggacgccatcctgagctacgagcccgtgaccagacaggagatccactacgccagacccgtgatcatcctgggccccatgaaggacagagtgaacgacgacctgatcagcgagttcccccacaagttcggcagctgcgtgccccacaccaccagacccagaagagacaacgaggtggacggccaggactaccacttcgtggtgagcagagagcagatggagaaggacatccaggacaacaagttcatcgaggccggccagttcaacgacaacctgtacggcaccagcatccagagcgtgagagccgtggccgagagaggcaagcactgcatcctggacgtgagcggcaacgccatcaagagactgcagcaggcccagctgtaccccatcgccatcttcatcaagcccaagagcatcgaggccctgatggagatgaacagaagacagacctacgagcaggccaacaagatctacgacaaggccatgaagctggagcaggagttcggcgagtacttcaccgccatcgtgcagggcgacagcctggaggagatctacaacaagatcaagcagatcatcgaggaccagagcggccactacatctgggtgcccagccccgagaagctgtag

SEQ ID NO: 79387 - DNA, 2454 bp, Artificial Sequence
  Description of Artificial Sequence: Synthetic coding sequence
atgcacaagcaccagcactgctgcaagtgccccgagtgctacgaggtgaccagactggccgccctgagaagactggagccccccggctacggcgactggcaggtgcccgacccctacggccccggcggcggcaacggcgccagcgccggctacggcggctacagcagccagaccctgcccagccaggccggcgccacccccacccccagaaccaaggccaagctgatccccaccggcagagacgtgggccccgtgccccccaagcccgtgcccggcaagagcacccccaagctgaacggcagcggccccagctggtggcccgagtgcacctgcaccaacagagactggtacgagcaggtgaacggcagcgacggcatgttcaagtacgaggagatcgtgctggagagaggcaacagcggcctgggcttcagcatcgccggcggcatcgacaacccccacgtgcccgacgaccccggcatcttcatcaccaagatcatccccggcggcgccgccgccatggacggcagactgggcgtgaacgactgcgtgctgagagtgaacgaggtggacgtgagcgaggtggtgcacagcagagccgtggaggccctgaaggaggccggccccgtggtgagactggtggtgagaagaagacagcccccccccgagaccatcatggaggtgaacctgctgaagggccccaagggcctgggcttcagcatcgccggcggcatcggcaaccagcacatccccggcgacaacagcatctacatcaccaagatcatcgagggcggcgccgcccagaaggacggcagactgcagatcggcgacagactgctggccgtgaacaacaccaacctgcaggacgtgagacacgaggaggccgtggccagcctgaagaacaccagcgacatggtgtacctgaaggtggccaagcccggcagcctgcacctgaacgacatgtacgccccccccgactacgccagcaccttcaccgccctggccgacaaccacatcagccacaacagcagcctgggctacctgggcgccgtggagagcaaggtgagctaccccgcccccccccaggtgccccccaccagatacagccccatccccagacacatgctggccgaggaggacttcaccagagagcccagaaagatcatcctgcacaagggcagcaccggcctgggcttcaacatcgtgggcggcgaggacggcgagggcatcttcgtgagcttcatcctggccggcggccccgccgacctgagcggcgagctgagaagaggcgacagaatcctgagcgtgaacggcgtgaacctgagaaacgccacccacgagcaggccgccgccgccctgaagagagccggccagagcgtgaccatcgtggcccagtacagacccgaggagtacagcagattcgagagcaagatccacgacctgagagagcagatgatgaacagcagcatgagcagcggcagcggcagcctgagaaccagcgagaagagaagcctgtacgtgagagccctgttcgactacgacagaaccagagacagctgcctgcccagccagggcctgagcttcagctacggcgacatcctgcacgtgatcaacgccagcgacgacgagtggtggcaggccagactggtgaccccccacggcgagagcgagcagatcggcgtgatccccagcaagaagagagtggagaagaaggagagagccagactgaagaccgtgaagttccacgccagaaccggcatgatcgagagcaacagagacttccccggcctgagcgacgactactacggcgccaagaacctgaagggccaggaggacgccatcctgagctacgagcccgtgaccagacaggagatccactacgccagacccgtgatcatcctgggccccatgaaggacagagtgaacgacgacctgatcagcgagttcccccacaagttcggcagctgcgtgccccacaccaccagacccagaagagacaacgaggtggacggccaggactaccacttcgtggtgagcagagagcagatggagaaggacatccaggacaacaagttcatcgaggccggccagttcaacgacaacctgtacggcaccagcatccagagcgtgagagccgtggccgagagaggcaagcactgcatcctggacgtgagcggcaacgccatcaagagactgcagcaggcccagctgtaccccatcgccatcttcatcaagcccaagagcatcgaggccctgatggagatgaacagaagacagacctacgagcaggccaacaagatctacgacaaggccatgaagctggagcaggagttcggcgagtacttcaccgccatcgtgcagggcgacagcctggaggagatctacaacaagatcaagcagatcatcgaggaccagagcggccactacatctgggtgcccagccccgagaagctgtag

SEQ ID NO: 79388 - DNA, 1101 bp, Artificial Sequence
  Description of Artificial Sequence: Synthetic coding sequence
atgatgaacagcagcatgagcagcggcagcggcagcctgagaaccagcgagaagagaagcctgtacgtgagagccctgttcgactacgacagaaccagagacagctgcctgcccagccagggcctgagcttcagctacggcgacatcctgcacgtgatcaacgccagcgacgacgagtggtggcaggccagactggtgaccccccacggcgagagcgagcagatcggcgtgatccccagcaagaagagagtggagaagaaggagagagccagactgaagaccgtgaagttccacgccagaaccggcatgatcgagagcaacagaagcatcaagaccaagagaaagaagagcttcagactgagcagaaagttccccttctacaagagcaaggagaacatggcccaggagagcagcatccaggagcagggcgtgaccagcaacaccagcgacagcgagagcagcagcaagggccaggaggacgccatcctgagctacgagcccgtgaccagacaggagatccactacgccagacccgtgatcatcctgggccccatgaaggacagagtgaacgacgacctgatcagcgagttcccccacaagttcggcagctgcgtgccccacaccaccagacccagaagagacaacgaggtggacggccaggactaccacttcgtggtgagcagagagcagatggagaaggacatccaggacaacaagttcatcgaggccggccagttcaacgacaacctgtacggcaccagcatccagagcgtgagagccgtggccgagagaggcaagcactgcatcctggacgtgagcggcaacgccatcaagagactgcagcaggcccagctgtaccccatcgccatcttcatcaagcccaagagcatcgaggccctgatggagatgaacagaagacagacctacgagcaggccaacaagatctacgacaaggccatgaagctggagcaggagttcggcgagtacttcaccgccatcgtgcagggcgacagcctggaggagatctacaacaagatcaagcagatcatcgaggaccagagcggccactacatctgggtgcccagccccgagaagctgtag

SEQ ID NO: 79389 - DNA, 2304 bp, Artificial Sequence
  Description of Artificial Sequence: Synthetic coding sequence
atgagccagagacccagagcccccagaagcgccctgtggctgctggccccccccctgctgagatgggccccccccctgctgaccgtgctgcacagcgacctgttccaggccctgctggacatcctggactactacgaggccagcctgagcgagagccagaagtacagataccaggacgaggacaccccccccctggagcacagccccgcccacctgcccaaccaggccaacagcccccccgtgatcgtgaacaccgacaccctggaggcccccggctacgagctgcaggtgaacggcaccgagggcgagatggagtacgaggagatcaccctggagagaggcaacagcggcctgggcttcagcatcgccggcggcaccgacaacccccacatcggcgacgaccccagcatcttcatcaccaagatcatccccggcggcgccgccgcccaggacggcagactgagagtgaacgacagcatcctgttcgtgaacgaggtggacgtgagagaggtgacccacagcgccgccgtggaggccctgaaggaggccggcagcatcgtgagactgtacgtgatgagaagaaagccccccgccgagaaggtgatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcagactgcagatcggcgacaagatcctggccgtgaacagcgtgggcctggaggacgtgatgcacgaggacgccgtggccgccctgaagaacacctacgacgtggtgtacctgaaggtggccaagcccagcaacgcctacctgagcgacagctacgccccccccgacatcaccaccagctacagccagcacctggacaacgagatcagccacagcagctacctgggcaccgactaccccaccgccatgacccccaccagccccagaagatacagccccgtggccaaggacctgctgggcgaggaggacatccccagagagcccagaagaatcgtgatccacagaggcagcaccggcctgggcttcaacatcgtgggcggcgaggacggcgagggcatcttcatcagcttcatcctggccggcggccccgccgacctgagcggcgagctgagaaagggcgaccagatcctgagcgtgaacggcgtggacctgagaaacgccagccacgagcaggccgccatcgccctgaagaacgccggccagaccgtgaccatcatcgcccagtacaagcccgaggagtacagcagattcgaggccaagatccacgacctgagagagcagctgatgaacagcagcctgggcagcggcaccgccagcctgagaagcaaccccaagagaggcttctacatcagagccctgttcgactacgacaagaccaaggactgcggcttcctgagccaggccctgagcttcagattcggcgacgtgctgcacgtgatcgacgccagcgacgaggagtggtggcaggccagaagagtgcacagcgacagcgagaccgacgacatcggcttcatccccagcaagagaagagtggagagaagagagtggagcagactgaaggccaaggactggggcagcagcagcggcagccagggcagagaggacagcgtgctgagctacgagaccgtgacccagatggaggtgcactacgccagacccatcatcatcctgggccccaccaaggacagagccaacgacgacctgctgagcgagttccccgacaagttcggcagctgcgtgccccacaccaccagacccaagagagagtacgagatcgacggcagagactaccacttcgtgagcagcagagagaagatggagaaggacatccaggcccacaagttcatcgaggccggccagtacaacagccacctgtacggcaccagcgtgcagagcgtgagagaggtggccgagcagggcaagcactgcatcctggacgtgagcgccaacgccgtgagaagactgcaggccgcccacctgcaccccatcgccatcttcatcagacccagaagcctggagaacgtgctggagatcaacaagagaatcaccgaggagcaggccagaaaggccttcgacagagccaccaagctggagcaggagttcaccgagtgcttcagcgccatcgtggagggcgacagcttcgaggagatctaccacaaggtgaagagagtgatcgaggacctgagcggcccctacatctgggtgcccgccagagagagactgtag

SEQ ID NO: 79390 - DNA, 2166 bp, Artificial Sequence
  Description of Artificial Sequence: Synthetic coding sequence
atggactgcctgtgcatcgtgaccaccaagaagtacagataccaggacgaggacaccccccccctggagcacagccccgcccacctgcccaaccaggccaacagcccccccgtgatcgtgaacaccgacaccctggaggcccccggctacgtgaacggcaccgagggcgagatggagtacgaggagatcaccctggagagaggcaacagcggcctgggcttcagcatcgccggcggcaccgacaacccccacatcggcgacgaccccagcatcttcatcaccaagatcatccccggcggcgccgccgcccaggacggcagactgagagtgaacgacagcatcctgttcgtgaacgaggtggacgtgagagaggtgacccacagcgccgccgtggaggccctgaaggaggccggcagcatcgtgagactgtacgtgatgagaagaaagccccccgccgagaaggtgatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcagactgcagatcggcgacaagatcctggccgtgaacagcgtgggcctggaggacgtgatgcacgaggacgccgtggccgccctgaagaacacctacgacgtggtgtacctgaaggtggccaagcccagcaacgcctacctgagcgacagctacgccccccccgacatcaccaccagctacagccagcacctggacaacgagatcagccacagcagctacctgggcaccgactaccccaccgccatgacccccaccagccccagaagatacagccccgtggccaaggacctgctgggcgaggaggacatccccagagagcccagaagaatcgtgatccacagaggcagcaccggcctgggcttcaacatcgtgggcggcgaggacggcgagggcatcttcatcagcttcatcctggccggcggccccgccgacctgagcggcgagctgagaaagggcgaccagatcctgagcgtgaacggcgtggacctgagaaacgccagccacgagcaggccgccatcgccctgaagaacgccggccagaccgtgaccatcatcgcccagtacaagcccgaggagtacagcagattcgaggccaagatccacgacctgagagagcagctgatgaacagcagcctgggcagcggcaccgccagcctgagaagcaaccccaagagaggcttctacatcagagccctgttcgactacgacaagaccaaggactgcggcttcctgagccaggccctgagcttcagattcggcgacgtgctgcacgtgatcgacgccagcgacgaggagtggtggcaggccagaagagtgcacagcgacagcgagaccgacgacatcggcttcatccccagcaagagaagagtggagagaagagagtggagcagactgaaggccaaggactggggcagcagcagcggcagccagggcagagaggacagcgtgctgagctacgagaccgtgacccagatggaggtgcactacgccagacccatcatcatcctgggccccaccaaggacagagccaacgacgacctgctgagcgagttccccgacaagttcggcagctgcgtgccccacaccaccagacccaagagagagtacgagatcgacggcagagactaccacttcgtgagcagcagagagaagatggagaaggacatccaggcccacaagttcatcgaggccggccagtacaacagccacctgtacggcaccagcgtgcagagcgtgagagaggtggccgagcagggcaagcactgcatcctggacgtgagcgccaacgccgtgagaagactgcaggccgcccacctgcaccccatcgccatcttcatcagacccagaagcctggagaacgtgctggagatcaacaagagaatcaccgaggagcaggccagaaaggccttcgacagagccaccaagctggagcaggagttcaccgagtgcttcagcgccatcgtggagggcgacagcttcgaggagatctaccacaaggtgaagagagtgatcgaggacctgagcggcccctacatctgggtgcccgccagagagagactgtag

SEQ ID NO: 79391 - DNA, 1995 bp, Artificial Sequence
  Description of Artificial Sequence: Synthetic coding sequence
atggagtacgaggagatcaccctggagagaggcaacagcggcctgggcttcagcatcgccggcggcaccgacaacccccacatcggcgacgaccccagcatcttcatcaccaagatcatccccggcggcgccgccgcccaggacggcagactgagagtgaacgacagcatcctgttcgtgaacgaggtggacgtgagagaggtgacccacagcgccgccgtggaggccctgaaggaggccggcagcatcgtgagactgtacgtgatgagaagaaagccccccgccgagaaggtgatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcagactgcagatcggcgacaagatcctggccgtgaacagcgtgggcctggaggacgtgatgcacgaggacgccgtggccgccctgaagaacacctacgacgtggtgtacctgaaggtggccaagcccagcaacgcctacctgagcgacagctacgccccccccgacatcaccaccagctacagccagcacctggacaacgagatcagccacagcagctacctgggcaccgactaccccaccgccatgacccccaccagccccagaagatacagccccgtggccaaggacctgctgggcgaggaggacatccccagagagcccagaagaatcgtgatccacagaggcagcaccggcctgggcttcaacatcgtgggcggcgaggacggcgagggcatcttcatcagcttcatcctggccggcggccccgccgacctgagcggcgagctgagaaagggcgaccagatcctgagcgtgaacggcgtggacctgagaaacgccagccacgagcaggccgccatcgccctgaagaacgccggccagaccgtgaccatcatcgcccagtacaagcccgaggagtacagcagattcgaggccaagatccacgacctgagagagcagctgatgaacagcagcctgggcagcggcaccgccagcctgagaagcaaccccaagagaggcttctacatcagagccctgttcgactacgacaagaccaaggactgcggcttcctgagccaggccctgagcttcagattcggcgacgtgctgcacgtgatcgacgccagcgacgaggagtggtggcaggccagaagagtgcacagcgacagcgagaccgacgacatcggcttcatccccagcaagagaagagtggagagaagagagtggagcagactgaaggccaaggactggggcagcagcagcggcagccagggcagagaggacagcgtgctgagctacgagaccgtgacccagatggaggtgcactacgccagacccatcatcatcctgggccccaccaaggacagagccaacgacgacctgctgagcgagttccccgacaagttcggcagctgcgtgccccacaccaccagacccaagagagagtacgagatcgacggcagagactaccacttcgtgagcagcagagagaagatggagaaggacatccaggcccacaagttcatcgaggccggccagtacaacagccacctgtacggcaccagcgtgcagagcgtgagagaggtggccgagcagggcaagcactgcatcctggacgtgagcgccaacgccgtgagaagactgcaggccgcccacctgcaccccatcgccatcttcatcagacccagaagcctggagaacgtgctggagatcaacaagagaatcaccgaggagcaggccagaaaggccttcgacagagccaccaagctggagcaggagttcaccgagtgcttcagcgccatcgtggagggcgacagcttcgaggagatctaccacaaggtgaagagagtgatcgaggacctgagcggcccctacatctgggtgcccgccagagagagactgtag

SEQ ID NO: 79392 - DNA, 2175 bp, Artificial Sequence
  Description of Artificial Sequence: Synthetic coding sequence
atggactgcctgtgcatcgtgaccaccaagaagtacagataccaggacgaggacaccccccccctggagcacagccccgcccacctgcccaaccaggccaacagcccccccgtgatcgtgaacaccgacaccctggaggcccccggctacgtgctgcaggtgaacggcaccgagggcgagatggagtacgaggagatcaccctggagagaggcaacagcggcctgggcttcagcatcgccggcggcaccgacaacccccacatcggcgacgaccccagcatcttcatcaccaagatcatccccggcggcgccgccgcccaggacggcagactgagagtgaacgacagcatcctgttcgtgaacgaggtggacgtgagagaggtgacccacagcgccgccgtggaggccctgaaggaggccggcagcatcgtgagactgtacgtgatgagaagaaagccccccgccgagaaggtgatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcagactgcagatcggcgacaagatcctggccgtgaacagcgtgggcctggaggacgtgatgcacgaggacgccgtggccgccctgaagaacacctacgacgtggtgtacctgaaggtggccaagcccagcaacgcctacctgagcgacagctacgccccccccgacatcaccaccagctacagccagcacctggacaacgagatcagccacagcagctacctgggcaccgactaccccaccgccatgacccccaccagccccagaagatacagccccgtggccaaggacctgctgggcgaggaggacatccccagagagcccagaagaatcgtgatccacagaggcagcaccggcctgggcttcaacatcgtgggcggcgaggacggcgagggcatcttcatcagcttcatcctggccggcggccccgccgacctgagcggcgagctgagaaagggcgaccagatcctgagcgtgaacggcgtggacctgagaaacgccagccacgagcaggccgccatcgccctgaagaacgccggccagaccgtgaccatcatcgcccagtacaagcccgaggagtacagcagattcgaggccaagatccacgacctgagagagcagctgatgaacagcagcctgggcagcggcaccgccagcctgagaagcaaccccaagagaggcttctacatcagagccctgttcgactacgacaagaccaaggactgcggcttcctgagccaggccctgagcttcagattcggcgacgtgctgcacgtgatcgacgccagcgacgaggagtggtggcaggccagaagagtgcacagcgacagcgagaccgacgacatcggcttcatccccagcaagagaagagtggagagaagagagtggagcagactgaaggccaaggactggggcagcagcagcggcagccagggcagagaggacagcgtgctgagctacgagaccgtgacccagatggaggtgcactacgccagacccatcatcatcctgggccccaccaaggacagagccaacgacgacctgctgagcgagttccccgacaagttcggcagctgcgtgccccacaccaccagacccaagagagagtacgagatcgacggcagagactaccacttcgtgagcagcagagagaagatggagaaggacatccaggcccacaagttcatcgaggccggccagtacaacagccacctgtacggcaccagcgtgcagagcgtgagagaggtggccgagcagggcaagcactgcatcctggacgtgagcgccaacgccgtgagaagactgcaggccgcccacctgcaccccatcgccatcttcatcagacccagaagcctggagaacgtgctggagatcaacaagagaatcaccgaggagcaggccagaaaggccttcgacagagccaccaagctggagcaggagttcaccgagtgcttcagcgccatcgtggagggcgacagcttcgaggagatctaccacaaggtgaagagagtgatcgaggacctgagcggcccctacatctgggtgcccgccagagagagactgtag

SEQ ID NO: 79393 - DNA, 2304 bp, Artificial Sequence
  Description of Artificial Sequence: Synthetic coding sequence
atgagccagagacccagagcccccagaagcgccctgtggctgctggccccccccctgctgagatgggccccccccctgctgaccgtgctgcacagcgacctgttccaggccctgctggacatcctggactactacgaggccagcctgagcgagagccagaagtacagataccaggacgaggacaccccccccctggagcacagccccgcccacctgcccaaccaggccaacagcccccccgtgatcgtgaacaccgacaccctggaggcccccggctacgtgctgcaggtgaacggcaccgagggcgagatggagtacgaggagatcaccctggagagaggcaacagcggcctgggcttcagcatcgccggcggcaccgacaacccccacatcggcgacgaccccagcatcttcatcaccaagatcatccccggcggcgccgccgcccaggacggcagactgagagtgaacgacagcatcctgttcgtgaacgaggtggacgtgagagaggtgacccacagcgccgccgtggaggccctgaaggaggccggcagcatcgtgagactgtacgtgatgagaagaaagccccccgccgagaaggtgatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcagactgcagatcggcgacaagatcctggccgtgaacagcgtgggcctggaggacgtgatgcacgaggacgccgtggccgccctgaagaacacctacgacgtggtgtacctgaaggtggccaagcccagcaacgcctacctgagcgacagctacgccccccccgacatcaccaccagctacagccagcacctggacaacgagatcagccacagcagctacctgggcaccgactaccccaccgccatgacccccaccagccccagaagatacagccccgtggccaaggacctgctgggcgaggaggacatccccagagagcccagaagaatcgtgatccacagaggcagcaccggcctgggcttcaacatcgtgggcggcgaggacggcgagggcatcttcatcagcttcatcctggccggcggccccgccgacctgagcggcgagctgagaaagggcgaccagatcctgagcgtgaacggcgtggacctgagaaacgccagccacgagcaggccgccatcgccctgaagaacgccggccagaccgtgaccatcatcgcccagtacaagcccgaggagtacagcagattcgaggccaagatccacgacctgagagagcagctgatgaacagcagcctgggcagcggcaccgccagcctgagaagcaaccccaagagaggcttctacatcagagccctgttcgactacgacaagaccaaggactgcggcttcctgagccaggccctgagcttcagattcggcgacgtgctgcacgtgatcgacgccagcgacgaggagtggtggcaggccagaagagtgcacagcgacagcgagaccgacgacatcggcttcatccccagcaagagaagagtggagagaagagagtggagcagactgaaggccaaggactggggcagcagcagcggcagccagggcagagaggacagcgtgctgagctacgagaccgtgacccagatggaggtgcactacgccagacccatcatcatcctgggccccaccaaggacagagccaacgacgacctgctgagcgagttccccgacaagttcggcagctgcgtgccccacaccaccagacccaagagagagtacgagatcgacggcagagactaccacttcgtgagcagcagagagaagatggagaaggacatccaggcccacaagttcatcgaggccggccagtacaacagccacctgtacggcaccagcgtgcagagcgtgagagaggtggccgagcagggcaagcactgcatcctggacgtgagcgccaacgccgtgagaagactgcaggccgcccacctgcaccccatcgccatcttcatcagacccagaagcctggagaacgtgctggagatcaacaagagaatcaccgaggagcaggccagaaaggccttcgacagagccaccaagctggagcaggagttcaccgagtgcttcagcgccatcgtggagggcgacagcttcgaggagatctaccacaaggtgaagagagtgatcgaggacctgagcggcccctacatctgggtgcccgccagagagagactgtag

SEQ ID NO: 79394 - DNA, 2004 bp, Artificial Sequence
  Description of Artificial Sequence: Synthetic coding sequence
atgagccagagacccagagcccccagaagcgccctgtggctgctggccccccccctgctgagatgggccccccccctgctgaccgtgctgcacagcgacctgttccaggccctgctggacatcctggactactacgaggccagcctgagcgagagccagaagtacagataccaggacgaggacaccccccccctggagcacagccccgcccacctgcccaaccaggccaacagcccccccgtgatcgtgaacaccgacaccctggaggcccccggctacgagctgcaggtgaacggcaccgagggcgagatggagtacgaggagatcaccctggagagaggcaacagcggcctgggcttcagcatcgccggcggcaccgacaacccccacatcggcgacgaccccagcatcttcatcaccaagatcatccccggcggcgccgccgcccaggacggcagactgagagtgaacgacagcatcctgttcgtgaacgaggtggacgtgagagaggtgacccacagcgccgccgtggaggccctgaaggaggccggcagcatcgtgagactgtacgtgatgagaagaaagccccccgccgagaaggtgatggagatcaagctgatcaagggccccaagggcctgggcttcagcatcgccggcggcgtgggcaaccagcacatccccggcgacaacagcatctacgtgaccaagatcatcgagggcggcgccgcccacaaggacggcagactgcagatcggcgacaagatcctggccgtgaacagcgtgggcctggaggacgtgatgcacgaggacgccgtggccgccctgaagaacacctacgacgtggtgtacctgaaggtggccaagcccagcaacgcctacctgagcgacagctacgccccccccgacatcaccaccagctacagccagcacctggacaacgagatcagccacagcagctacctgggcaccgactaccccaccgccatgacccccaccagccccagaagatacagccccgtggccaaggacctgctgggcgaggaggacatccccagagagcccagaagaatcgtgatccacagaggcagcaccggcctgggcttcaacatcgtgggcggcgaggacggcgagggcatcttcatcagcttcatcctggccggcggccccgccgacctgagcggcgagctgagaaagggcgaccagatcctgagcgtgaacggcgtggacctgagaaacgccagccacgagcaggccgccatcgccctgaagaacgccggccagaccgtgaccatcatcgcccagtacaagcccgaggagtacagcagattcgaggccaagatccacgacctgagagagcagctgatgaacagcagcctgggcagcggcaccgccagcctgagaagcaaccccaagagaggcttctacatcagagccctgttcgactacgacaagaccaaggactgcggcttcctgagccaggccctgagcttcagattcggcgacgtgctgcacgtgatcgacgccagcgacgaggagtggtggcaggccagaagagtgcacagcgacagcgagaccgacgacatcggcttcatccccagcaagagaagagtggagagaagagagtggagcagactgaaggccaaggactggggcagcagcagcggcagccagggcagagaggacagcgtgctgagctacgagaccgtgacccagatggaggtgcactacgccagacccatcatcatcctgggccccaccaaggacagagccaacgacgacctgctgagcgagttccccgacaagttcggcagctgcgtgccccacaccaccagacccaagagagagtacgagatcgacggcagagactaccacttcgtgagcagcagagagaagatggagaaggacatccaggcccacaagttcatcgaggccggccagtacaacagccacctgtacggcaccagcgtgcagagcgtgagagaggtggccgagcagagagactag

SEQ ID NO: 79395 - DNA, 4740 bp, Artificial Sequence
  Description of Artificial Sequence: Synthetic coding sequence
atggagccccagagaagagagctgctggcccagtgccagcagagcctggcccaggccatgaccgaggtggaggccgtgctgggcctgctggaggccgccggcgccctgagccccggcgagagaagacagctggacgaggaggccggcggcgccaaggccgagctgctgctgaagctgctgctggccaaggagagagaccacttccaggacctgagagccgccctggagaagacccagccccacctgctgcccatcctgtacctgaacggcgtggtgggccccccccagcccgccgagggcgccggcagcacctacagcgtgctgagcaccatgcccagcgacagcgagagcagcagcagcctgagcagcgtgggcaccaccggcaaggcccccagccccccccccctgctgaccgaccagcaggtgaacgagaaggtggagaacctgagcatccagctgagactgatgaccagagagagaaacgagctgagaaagagactggccttcgccacccacggcaccgccttcgacaagagaccctaccacagactgaaccccgactacgagagactgaagatccagtgcgtgagagccatgagcgacctgcagagcctgcagaaccagcacaccaacgccctgaagagatgcgaggaggtggccaaggagaccgacttctaccacaccctgcacagcagactgctgagcgaccagaccagactgaaggacgacgtggacatgctgagaagagagaacggccagctgctgagagagagaaacctgctgcagcagagctgggaggacatgaagagactgcacgaggaggaccagaaggagatcggcgacctgagagcccagcagcagcaggtgctgaagcacaacggcagcagcgagatcctgaacaagctgtacgacaccgccatggacaagctggaggtggtgaagaaggactacgacgccctgagaaagagatacagcgagaaggtggccatccacaacgccgacctgagcagactggagcagctgggcgaggagaaccagagactgctgaagcagaccgagatgctgacccagcagagagacaccgccatccagctgcagcaccagtgcgccctgagcctgagaagattcgaggccatccaccacgagctgaacaaggccaccgcccagaacaaggacctgcagtgggagatggagctgctgcagagcgagctgaccgagctgagaaccacccaggtgaagaccgccaaggagagcgagaagtacagagaggagagagacgccgtgtacagcgagtacaagctgatcatgagcgagagagaccaggtgatcagcgagctggacaagctgcagaccgaggtggagctggccgagagcaagctgaagagcagcaccagcgagaagaaggccgccaacgaggagatggaggccctgagacagatcaaggacaccgtgaccatggacgccggcagagccaacaaggaggtggagatcctgagaaagcagtgcaaggccctgtgccaggagctgaaggaggccctgcaggaggccgacgtggccaagtgcagaagagactgggccttccaggagagagacaagatcgtggccgagagagacagcatcagaaccctgtgcgacaacctgagaagagagagagacagagccgtgagcgagctggccgaggccctgagaagcctggacgacaccagaaagcagaagaacgacgtgagcagagagctgaaggagctgaaggagcagatggagagccagctggagaaggaggccagattcagacagctgatggcccacagcagccacgacagcgccatcgacaccgacagcatggagtgggagaccgaggtggtggagttcgagagagagaccgaggacatcgacctgaaggccctgggcttcgacatggccgagggcgtgaacgagccctgcttccccggcgactgcggcatcttcgtgaccaaggtggacaagggcagcatcgccgacggcagactgagagtgaacgactggctgctgagaatcaacgacgtggacctgatcaacaaggacaagaagcaggccatcaaggccctgctgaacggcgagggcgccatcaacatggtggtgagaagaagaaagagcctgggcggcaaggtggtgacccccctgcacatcaacctgagcggccagaaggacagcggcatcagcctggagaacggcgtgtacgccgccgccgtgctgcccggcagccccgccgccaaggagggcagcctggccgtgggcgacagaatcgtggccatcaacggcatcgccctggacaacaagagcctgaacgagtgcgagagcctgctgagaagctgccaggacagcctgaccctgagcctgctgaaggagcagaagtgcgtgcccgccagcggcgagctgagccccgagctgcaggagtgggccccctacagccccggccacagcagcagacacagcaacccccccctgtaccccagcagacccagcgtgggcaccgtgcccagaagcctgacccccagcaccaccgtgagcagcatcctgagaaaccccatctacaccgtgagaagccacagagtgggcccctgcagcagcccccccgccgccagagacgccggcccccagggcctgcaccccagcgtgcagcaccagggcagactgagcctggacctgagccacagaacctgcagcgactacagcgagatgagagccacccacggcagcaacagcctgcccagcagcgccagactgggcagcagcagcaacctgcagttcaaggccgagagaatcaagatccccagcacccccagataccccagaagcgtggtgggcagcgagagaggcagcgtgagccacagcgagtgcagcacccccccccagagccccctgaacatcgacaccctgagcagctgcagccagagccagaccagcgccagcaccctgcccagaatcgccgtgaaccccgccagcctgggcgagagaagaaaggacagaccctacgtggaggagcccagacacgtgaaggtgcagaagggcagcgagcccctgggcatcagcatcgtgagcggcgagaagggcggcatctacgtgagcaaggtgaccgtgggcagcatcgcccaccaggccggcctggagtacggcgaccagctgctggagttcaacggcatcaacctgagaagcgccaccgagcagcaggccagactgatcatcggccagcagtgcgacaccatcaccatcctggcccagtacaacccccacgtgcaccagctgagcagccacagcagaagcagcagccacctggaccccgccggcacccacagcaccctgcagggcagcggcaccaccacccccgagcaccccagcgtgatcgaccccctgatggagcaggacgagggccccagcaccccccccgccaagcagagcagcagcagaatcgccggcgacgccaacaagaagaccctggagcccagagtggtgttcatcaagaagagccagctggagctgggcgtgcacctgtgcggcggcaacctgcacggcgtgttcgtggccgaggtggaggacgacagccccgccaagggccccgacggcctggtgcccggcgacctgatcctggagtacggcagcctggacgtgagaaacaagaccgtggaggaggtgtacgtggagatgctgaagcccagagacggcgtgagactgaaggtgcagtacagacccgaggagttcaccaaggccaagggcctgcccggcgacagcttctacatcagagccctgtacgacagactggccgacgtggagcaggagctgagcttcaagaaggacgacatcctgtacgtggacgacaccctgccccagggcaccttcggcagctggatggcctggcagctggacgagaacgcccagaagatccagagaggccagatccccagcaagtacgtgatggaccaggagttcagcagaagactgagcatgagcgaggtgaaggacgacaacagcgccaccaagaccctgagcgccgccgccagaagaagcttcttcagaagaaagcacaagcacaagagaagcggcagcaaggacggcaaggacctgctggccctggacgccttcagcagcgacagcatccccctgttcgaggacagcgtgagcctggcctaccagagagtgcagaaggtggactgcaccgccctgagacccgtgctgatcctgggccccctgctggacgtggtgaaggagatgctggtgaacgaggcccccggcaagttctgcagatgccccctggaggtgatgaaggccagccagcaggccatcgagagaggcgtgaaggactgcctgttcgtggactacaagagaagaagcggccacttcgacgtgaccaccgtggccagcatcaaggagatcaccgagaagaacagacactgcctgctggacatcgccccccacgccatcgagagactgcaccacatgcacatctaccccatcgtgatcttcatccactacaagagcgccaagcacatcaaggagcagagagaccccatctacctgagagacaaggtgacccagagacacagcaaggagcagttcgaggccgcccagaagctggagcaggagtacagcagatacttcaccggcgtgatccagggcggcgccctgagcagcatctgcacccagatcctggccatggtgaaccaggagcagaacaaggtgctgtggatccccgcctgccccctgtag

SEQ ID NO: 79396 - DNA, 5760 bp, Artificial Sequence
  Description of Artificial Sequence: Synthetic coding sequence
atggagccccagagaagagagctgctggcccagtgccagcagagcctggcccaggccatgaccgaggtggaggccgtgctgggcctgctggaggccgccggcgccctgagccccggcgagagaagacagctggacgaggaggccggcggcgccaaggccgagctgctgctgaagctgctgctggccaaggagagagaccacttccaggacctgagagccgccctggagaagacccagccccacctgctgcccatcctgtacctgaacggcgtggtgggccccccccagcccgccgagggcgccggcagcacctacagcgtgctgagcaccatgcccagcgacagcgagagcagcagcagcctgagcagcgtgggcaccaccggcaaggcccccagccccccccccctgctgaccgaccagcaggtgaacgagaaggtggagaacctgagcatccagctgagactgatgaccagagagagaaacgagctgagaaagagactggccttcgccacccacggcaccgccttcgacaagagaccctaccacagactgaaccccgactacgagagactgaagatccagtgcgtgagagccatgagcgacctgcagagcctgcagaaccagcacaccaacgccctgaagagatgcgaggaggtggccaaggagaccgacttctaccacaccctgcacagcagactgctgagcgaccagaccagactgaaggacgacgtggacatgctgagaagagagaacggccagctgctgagagagagaaacctgctgcagcagagctgggaggacatgaagagactgcacgaggaggaccagaaggagatcggcgacctgagagcccagcagcagcaggtgctgaagcacaacggcagcagcgagatcctgaacaagctgtacgacaccgccatggacaagctggaggtggtgaagaaggactacgacgccctgagaaagagatacagcgagaaggtggccatccacaacgccgacctgagcagactggagcagctgggcgaggagaaccagagactgctgaagcagaccgagatgctgacccagcagagagacaccgccatccagctgcagcaccagtgcgccctgagcctgagaagattcgaggccatccaccacgagctgaacaaggccaccgcccagaacaaggacctgcagtgggagatggagctgctgcagagcgagctgaccgagctgagaaccacccaggtgaagaccgccaaggagagcgagaagtacagagaggagagagacgccgtgtacagcgagtacaagctgatcatgagcgagagagaccaggtgatcagcgagctggacaagctgcagaccgaggtggagctggccgagagcaagctgaagagcagcaccagcgagaagaaggccgccaacgaggagatggaggccctgagacagatcaaggacaccgtgaccatggacgccggcagagccaacaaggaggtggagatcctgagaaagcagtgcaaggccctgtgccaggagctgaaggaggccctgcaggaggccgacgtggccaagtgcagaagagactgggccttccaggagagagacaagatcgtggccgagagagacagcatcagaaccctgtgcgacaacctgagaagagagagagacagagccgtgagcgagctggccgaggccctgagaagcctggacgacaccagaaagcagaagaacgacgtgagcagagagctgaaggagctgaaggagcagatggagagccagctggagaaggaggccagattcagacagctgatggcccacagcagccacgacagcgccatcgacaccgacagcatggagtgggagaccgaggtggtggagttcgagagagagaccgaggacatcgacctgaaggccctgggcttcgacatggccgagggcgtgaacgagccctgcttccccggcgactgcggcatcttcgtgaccaaggtggacaagggcagcatcgccgacggcagactgagagtgaacgactggctgctgagaatcaacgacgtggacctgatcaacaaggacaagaagcaggccatcaaggccctgctgaacggcgagggcgccatcaacatggtggtgagaagaagaaagagcctgggcggcaaggtggtgacccccctgcacatcaacctgagcggccagaaggacagcggcatcagcctggagaacggcgtgtacgccgccgccgtgctgcccggcagccccgccgccaaggagggcagcctggccgtgggcgacagaatcgtggccatcaacggcatcgccctggacaacaagagcctgaacgagtgcgagagcctgctgagaagctgccaggacagcctgaccctgagcctgctgaaggtgttcccccagagcagcagctggagcggccagaacatcttcgagaacatcaaggacagcgacaagatgctgagcttcagagcccacggccccgaggtgcaggcccacaacaagagaaacctgatccagcacaacaacagcacccagaccgacatcttctacaccgacagactggaggacagaaaggagcccggcccccccggcggcagcagcagcttcctgcacaagcccttccccggcggccccctgcaggtgtgcccccaggcctgccccagcgccagcgagagaagcctgagcagcttcagaagcgacgccagcggcgacagaggcttcggcctggtggacgtgagaggcagaagacccctgctgcccttcgagaccgaggtgggcccctgcggcgtgggcgaggccagcctggacaaggccgacagcgagggcagcaacagcggcggcacctggcccaaggccatgctgagcagcaccgccgtgcccgagaagctgagcgtgtacaagaagcccaagcagagaaagagcatcttcgaccccaacaccttcaagagaccccagaccccccccaagatcgactacctgctgcccggccccggccccgcccacagcccccagcccagcaagagagccggccccctgaccccccccaagccccccagaagaagcgacagcatcaagttccagcacagactggagaccagcagcgagagcgaggccaccctggtgggcagcagccccagcaccagcccccccagcgccctgccccccgacgtggaccccggcgagcccatgcacgccagcccccccagaaaggccagagtgagaatcgccagcagctactaccccgagggcgacggcgacagcagccacctgcccgccaagaagagctgcgacgaggacctgaccagccagaaggtggacgagctgggccagaagagaagaagacccaagagcgcccccagcttcagacccaagctggcccccgtggtgatccccgcccagttcctggaggagcagaagtgcgtgcccgccagcggcgagctgagccccgagctgcaggagtgggccccctacagccccggccacagcagcagacacagcaacccccccctgtaccccagcagacccagcgtgggcaccgtgcccagaagcctgacccccagcaccaccgtgagcagcatcctgagaaaccccatctacaccgtgagaagccacagagtgggcccctgcagcagcccccccgccgccagagacgccggcccccagggcctgcaccccagcgtgcagcaccagggcagactgagcctggacctgagccacagaacctgcagcgactacagcgagatgagagccacccacggcagcaacagcctgcccagcagcgccagactgggcagcagcagcaacctgcagttcaaggccgagagaatcaagatccccagcacccccagataccccagaagcgtggtgggcagcgagagaggcagcgtgagccacagcgagtgcagcacccccccccagagccccctgaacatcgacaccctgagcagctgcagccagagccagaccagcgccagcaccctgcccagaatcgccgtgaaccccgccagcctgggcgagagaagaaaggacagaccctacgtggaggagcccagacacgtgaaggtgcagaagggcagcgagcccctgggcatcagcatcgtgagcggcgagaagggcggcatctacgtgagcaaggtgaccgtgggcagcatcgcccaccaggccggcctggagtacggcgaccagctgctggagttcaacggcatcaacctgagaagcgccaccgagcagcaggccagactgatcatcggccagcagtgcgacaccatcaccatcctggcccagtacaacccccacgtgcaccagctgagcagccacagcagaagcagcagccacctggaccccgccggcacccacagcaccctgcagggcagcggcaccaccacccccgagcaccccagcgtgatcgaccccctgatggagcaggacgagggccccagcaccccccccgccaagcagagcagcagcagaatcgccggcgacgccaacaagaagaccctggagcccagagtggtgttcatcaagaagagccagctggagctgggcgtgcacctgtgcggcggcaacctgcacggcgtgttcgtggccgaggtggaggacgacagccccgccaagggccccgacggcctggtgcccggcgacctgatcctggagtacggcagcctggacgtgagaaacaagaccgtggaggaggtgtacgtggagatgctgaagcccagagacggcgtgagactgaaggtgcagtacagacccgaggagttcaccaaggccaagggcctgcccggcgacagcttctacatcagagccctgtacgacagactggccgacgtggagcaggagctgagcttcaagaaggacgacatcctgtacgtggacgacaccctgccccagggcaccttcggcagctggatggcctggcagctggacgagaacgcccagaagatccagagaggccagatccccagcaagtacgtgatggaccaggagttcagcagaagactgagcatgagcgaggtgaaggacgacaacagcgccaccaagaccctgagcgccgccgccagaagaagcttcttcagaagaaagcacaagcacaagagaagcggcagcaaggacggcaaggacctgctggccctggacgccttcagcagcgacagcatccccctgttcgaggacagcgtgagcctggcctaccagagagtgcagaaggtggactgcaccgccctgagacccgtgctgatcctgggccccctgctggacgtggtgaaggagatgctggtgaacgaggcccccggcaagttctgcagatgccccctggaggtgatgaaggccagccagcaggccatcgagagaggcgtgaaggactgcctgttcgtggactacaagagaagaagcggccacttcgacgtgaccaccgtggccagcatcaaggagatcaccgagaagaacagacactgcctgctggacatcgccccccacgccatcgagagactgcaccacatgcacatctaccccatcgtgatcttcatccactacaagagcgccaagcacatcaaggagcagagagaccccatctacctgagagacaaggtgacccagagacacagcaaggagcagttcgaggccgcccagaagctggagcaggagtacagcagatacttcaccggcgtgatccagggcggcgccctgagcagcatctgcacccagatcctggccatggtgaaccaggagcagaacaaggtgctgtggatccccgcctgccccctgtag

SEQ ID NO: 79397 - DNA, 2052 bp, Artificial Sequence
  Description of Artificial Sequence: Synthetic coding sequence
atggagccccagagaagagagctgctggcccagtgccagcagagcctggcccaggccatgaccgaggtggaggccgtgctgggcctgctggaggccgccggcgccctgagccccggcgagagaagacagctggacgaggaggccggcggcgccaaggccgagctgctgctgaagctgctgctggccaaggagagagaccacttccaggacctgagagccgccctggagaagacccagccccacctgctgcccatcctgtacctgaacggcgtggtgggccccccccagcccgccgagggcgccggcagcacctacagcgtgctgagcaccatgcccagcgacagcgagagcagcagcagcctgagcagcgtgggcaccaccgtgaagcacctgagagagcagatggagagccagctggagaaggaggccagattcagacagctgatggcccacagcagccacgacagcgccatcgacaccgacagcatggagtgggagaccgaggtggtggagttcgagagagagaccgaggacatcgacctgaaggccctgggcttcgacatggccgagggcgtgaacgagccctgcttccccggcgactgcggcatcttcgtgaccaaggtggacaagggcagcatcgccgacggcagactgagagtgaacgactggctgctgagaatcaacgacgtggacctgatcaacaaggacaagaagcaggccatcaaggccctgctgaacggcgagggcgccatcaacatggtggtgagaagaagaaagagcctgggcggcaaggtggtgacccccctgcacatcaacctgagcggccagaaggacagcggcatcagcctggagaacggcgtgtacgccgccgccgtgctgcccggcagccccgccgccaaggagggcagcctggccgtgggcgacagaatcgtggccatcaacggcatcgccctggacaacaagagcctgaacgagtgcgagagcctgctgagaagctgccaggacagcctgaccctgagcctgctgaaggtgttcccccagagcagcagctggagcggccagaacatcttcgagaacatcaaggacagcgacaagatgctgagcttcagagcccacggccccgaggtgcaggcccacaacaagagaaacctgatccagcacaacaacagcacccagaccgacatcttctacaccgacagactggaggacagaaaggagcccggcccccccggcggcagcagcagcttcctgcacaagcccttccccggcggccccctgcaggtgtgcccccaggcctgccccagcgccagcgagagaagcctgagcagcttcagaagcgacgccagcggcgacagaggcttcggcctggtggacgtgagaggcagaagacccctgctgcccttcgagaccgaggtgggcccctgcggcgtgggcgaggccagcctggacaaggccgacagcgagggcagcaacagcggcggcacctggcccaaggccatgctgagcagcaccgccgtgcccgagaagctgagcgtgtacaagaagcccaagcagagaaagagcatcttcgaccccaacaccttcaagagaccccagaccccccccaagatcgactacctgctgcccggccccggccccgcccacagcccccagcccagcaagagagccggccccctgaccccccccaagccccccagaagaagcgacagcatcaagttccagcacagactggagaccagcagcgagagcgaggccaccctggtgggcagcagccccagcaccagcccccccagcgccctgccccccgacgtggaccccggcgagcccatgcacgccagcccccccagaaaggccagagtgagaatcgccagcagctactaccccgagggcgacggcgacagcagccacctgcccgccaagaagagctgcgacgaggacctgaccagccagaaggtggacgagctgggccagaagagaagaagacccaagagcgcccccagcttcagacccaagctggcccccgtggtgatccccgcccagttcctggagtag

SEQ ID NO: 79398 - DNA, 2643 bp, Artificial Sequence
  Description of Artificial Sequence: Synthetic coding sequence
ggcgccatcaacatggtggtgagaagaagaaagagcctgggcggcaaggtggtgacccccctgcacatcaacctgagcggccagaaggacagcggcatcagcctggagaacggcgtgtacgccgccgccgtgctgcccggcagccccgccgccaaggagggcagcctggccgtgggcgacagaatcgtggccatcaacggcatcgccctggacaacaagagcctgaacgagtgcgagagcctgctgagaagctgccaggacagcctgaccctgagcctgctgaaggagcagaagtgcgtgcccgccagcggcgagctgagccccgagctgcaggagtgggccccctacagccccggccacagcagcagacacagcaacccccccctgtaccccagcagacccagcgtgggcaccgtgcccagaagcctgacccccagcaccaccgtgagcagcatcctgagaaaccccatctacaccgtgagaagccacagagtgggcccctgcagcagcccccccgccgccagagacgccggcccccagggcctgcaccccagcgtgcagcaccagggcagactgagcctggacctgagccacagaacctgcagcgactacagcgagatgagagccacccacggcagcaacagcctgcccagcagcgccagactgggcagcagcagcaacctgcagttcaaggccgagagaatcaagatccccagcacccccagataccccagaagcgtggtgggcagcgagagaggcagcgtgagccacagcgagtgcagcacccccccccagagccccctgaacatcgacaccctgagcagctgcagccagagccagaccagcgccagcaccctgcccagaatcgccgtgaaccccgccagcctgggcgagagaagaaaggacagaccctacgtggaggagcccagacacgtgaaggtgcagaagggcagcgagcccctgggcatcagcatcgtgagcggcgagaagggcggcatctacgtgagcaaggtgaccgtgggcagcatcgcccaccaggccggcctggagtacggcgaccagctgctggagttcaacggcatcaacctgagaagcgccaccgagcagcaggccagactgatcatcggccagcagtgcgacaccatcaccatcctggcccagtacaacccccacgtgcaccagctgagcagccacagcagaagcagcagccacctggaccccgccggcacccacagcaccctgcagggcagcggcaccaccacccccgagcaccccagcgtgatcgaccccctgatggagcaggacgagggccccagcaccccccccgccaagcagagcagcagcagaatcgccggcgacgccaacaagaagaccctggagcccagagtggtgttcatcaagaagagccagctggagctgggcgtgcacctgtgcggcggcaacctgcacggcgtgttcgtggccgaggtggaggacgacagccccgccaagggccccgacggcctggtgcccggcgacctgatcctggagtacggcagcctggacgtgagaaacaagaccgtggaggaggtgtacgtggagatgctgaagcccagagacggcgtgagactgaaggtgcagtacagacccgaggagttcaccaaggccaagggcctgcccggcgacagcttctacatcagagccctgtacgacagactggccgacgtggagcaggagctgagcttcaagaaggacgacatcctgtacgtggacgacaccctgccccagggcaccttcggcagctggatggcctggcagctggacgagaacgcccagaagatccagagaggccagatccccagcaagtacgtgatggaccaggagttcagcagaagactgagcatgagcgaggtgaaggacgacaacagcgccaccaagaccctgagcgccgccgccagaagaagcttcttcagaagaaagcacaagcacaagagaagcggcagcaaggacggcaaggacctgctggccctggacgccttcagcagcgacagcatccccctgttcgaggacagcgtgagcctggcctaccagagagtgcagaaggtggactgcaccgccctgagacccgtgctgatcctgggccccctgctggacgtggtgaaggagatgctggtgaacgaggcccccggcaagttctgcagatgccccctggaggtgatgaaggccagccagcaggccatcgagagaggcgtgaaggactgcctgttcgtggactacaagagaagaagcggccacttcgacgtgaccaccgtggccagcatcaaggagatcaccgagaagaacagacactgcctgctggacatcgccccccacgccatcgagagactgcaccacatgcacatctaccccatcgtgatcttcatccactacaagagcgccaagcacatcaaggagcagagagaccccatctacctgagagacaaggtgacccagagacacagcaaggagcagttcgaggccgcccagaagctggagcaggagtacagcagatacttcaccggcgtgatccagggcggcgccctgagcagcatctgcacccagatcctggccatggtgaaccaggagcagaacaaggtgctgtggatccccgcctgccccctgtag

SEQ ID NO: 79399 - DNA, 3237 bp, Artificial Sequence
  Description of Artificial Sequence: Synthetic coding sequence
atggcccccagaaagagaggcggcagaggcatcagcttcatcttctgctgcttcagaaacaacgaccaccccgagatcacctacagactgagaaacgacagcaacttcgccctgcagaccatggagcccgccctgcccatgccccccgtggaggagctggacgtgatgttcagcgagctggtggacgagctggacctgaccgacaagcacagagaggccatgttcgccctgcccgccgagaagaagtggcagatctactgcagcaagaagaaggaccaggaggagaacaagggcgccaccagctggcccgagttctacatcgaccagctgaacagcatggccgccagaaagagcctgctggccctggagaaggaggaggaggaggagagaagcaagaccatcgagagcctgaagaccgccctgagaaccaagcccatgagattcgtgaccagattcatcgacctggacggcctgagctgcatcctgaacttcctgaagaccatggactacgagaccagcgagagcagaatccacaccagcctgatcggctgcatcaaggccctgatgaacaacagccagggcagagcccacgtgctggcccacagcgagagcatcaacgtgatcgcccagagcctgagcaccgagaacatcaagaccaaggtggccgtgctggagatcctgggcgccgtgtgcctggtgcccggcggccacaagaaggtgctgcaggccatgctgcactaccagaagtacgccagcgagagaaccagattccagaccctgatcaacgacctggacaagagcaccggcagatacagagacgaggtgagcctgaagaccgccatcatgagcttcatcaacgccgtgctgagccagggcgccggcgtggagagcctggacttcagactgcacctgagatacgagttcctgatgctgggcatccagcccgtgatcgacaagctgagagagcacgagaacagcaccctggacagacacctggacttcttcgagatgctgagaaacgaggacgagctggagttcgccaagagattcgagctggtgcacatcgacaccaagagcgccacccagatgttcgagctgaccagaaagagactgacccacagcgaggcctacccccacttcatgagcatcctgcaccactgcctgcagatgccctacaagagaagcggcaacaccgtgcagtactggctgctgctggacagaatcatccagcagatcgtgatccagaacgacaagggccaggaccccgacagcacccccctggagaacttcaacatcaagaacgtggtgagaatgctggtgaacgagaacgaggtgaagcagtggaaggagcaggccgagaagatgagaaaggagcacaacgagctgcagcagaagctggagaagaaggagagagagtgcgacgccaagacccaggagaaggaggagatgatgcagaccctgaacaagatgaaggagaagctggagaaggagaccaccgagcacaagcaggtgaagcagcaggtggccgacctgaccgcccagctgcacgagctgagcagaagagccgtgtgcgccagcatccccggcggccccagccccggcgcccccggcggccccttccccagcagcgtgcccggcagcctgctgcccccccccccccccccccccctgcccggcggcatgctgccccccccccccccccccctgccccccggcggccccccccccccccccggccccccccccctgggcgccatcatgcccccccccggcgcccccatgggcctggccctgaagaagaagagcatcccccagcccaccaacgccctgaagagcttcaactggagcaagctgcccgagaacaagctggagggcaccgtgtggaccgagatcgacgacaccaaggtgttcaagatcctggacctggaggacctggagagaaccttcagcgcctaccagagacagcaggacttcttcgtgaacagcaacagcaagcagaaggaggccgacgccatcgacgacaccctgagcagcaagctgaaggtgaaggagctgagcgtgatcgacggcagaagagcccagaactgcaacatcctgctgagcagactgaagctgagcaacgacgagatcaagagagccatcctgaccatggacgagcaggaggacctgcccaaggacatgctggagcagctgctgaagttcgtgcccgagaagagcgacatcgacctgctggaggagcacaagcacgagctggacagaatggccaaggccgacagattcctgttcgagatgagcagaatcaaccactaccagcagagactgcagagcctgtacttcaagaagaagttcgccgagagagtggccgaggtgaagcccaaggtggaggccatcagaagcggcagcgaggaggtgttcagaagcggcgccctgaagcagctgctggaggtggtgctggccttcggcaactacatgaacaagggccagagaggcaacgcctacggcttcaagatcagcagcctgaacaagatcgccgacaccaagagcagcatcgacaagaacatcaccctgctgcactacctgatcaccatcgtggagaacaagtaccccagcgtgctgaacctgaacgaggagctgagagacatcccccaggccgccaaggtgaacatgaccgagctggacaaggagatcagcaccctgagaagcggcctgaaggccgtggagaccgagctggagtaccagaagagccagcccccccagcccggcgacaagttcgtgagcgtggtgagccagttcatcaccgtggccagcttcagcttcagcgacgtggaggacctgctggccgaggccaaggacctgttcaccaaggccgtgaagcacttcggcgaggaggccggcaagatccagcccgacgagttcttcggcatcttcgaccagttcctgcaggccgtgagcgaggccaagcaggagaacgagaacatgagaaagaagaaggaggaggaggagagaagagccagaatggaggcccagctgaaggagcagagagagagagagagaaagatgagaaaggccaaggagaacagcgaggagagcggcgagttcgacgacctggtgagcgccctgagaagcggcgaggtgttcgacaaggacctgagcaagctgaagagaaacagaaagagaatcaccaaccagatgaccgacagcagcagagagagacccatcaccaagctgaacttctag

SEQ ID NO: 79400 - DNA, 2649 bp, Artificial Sequence
  Description of Artificial Sequence: Synthetic coding sequence
atggcccccagaaagagaggcggcagaggcatcagcttcatcttctgctgcttcagaaacaacgaccaccccgagatcacctacagactgagaaacgacagcaacttcgccctgcagaccatggagcccgccctgcccatgccccccgtggaggagctggacgtgatgttcagcgagctggtggacgagctggacctgaccgacaagcacagagaggccatgttcgccctgcccgccgagaagaagtggcagatctactgcagcaagaagaaggaccaggaggagaacaagggcgccaccagctggcccgagttctacatcgaccagctgaacagcatggccgccagaaagagcctgctggccctggagaaggaggaggaggaggagagaagcaagaccatcgagagcctgaagaccgccctgagaaccaagcccatgagattcgtgaccagattcatcgacctggacggcctgagctgcatcctgaacttcctgaagaccatggactacgagaccagcgagagcagaatccacaccagcctgatcggctgcatcaaggccctgatgaacaacagccagggcagagcccacgtgctggcccacagcgagagcatcaacgtgatcgcccagagcctgagcaccgagaacatcaagaccaaggtggccgtgctggagatcctgggcgccgtgtgcctggtgcccggcggccacaagaaggtgctgcaggccatgctgcactaccagaagtacgccagcgagagaaccagattccagaccctgatcaacgacctggacaagagcaccggcagatacagagacgaggtgagcctgaagaccgccatcatgagcttcatcaacgccgtgctgagccagggcgccggcgtggagagcctggacttcagactgcacctgagatacgagttcctgatgctgggcatccagcccgtgatcgacaagctgagagagcacgagaacagcaccctggacagacacctggacttcttcgagatgctgagaaacgaggacgagctggagttcgccaagagattcgagctggtgcacatcgacaccaagagcgccacccagatgttcgagctgaccagaaagagactgacccacagcgaggcctacccccacttcatgagcatcctgcaccactgcctgcagatgccctacaagagaagcggcaacaccgtgcagtactggctgctgctggacagaatcatccagcagatcgtgatccagaacgacaagggccaggaccccgacagcacccccctggagaacttcaacatcaagaacgtggtgagaatgctggtgaacgagaacgaggtgaagcagtggaaggagcaggccgagaagatgagaaaggagcacaacgagctgcagcagaagctggagaagaaggagagagagtgcgacgccaagacccaggagaaggaggagatgatgcagaccctgaacaagatgaaggagaagctggagaaggagaccaccgagcacaagcaggtgaagcagcaggtggccgacctgaccgcccagctgcacgagctgagcagaagagccgtgtgcgccagcatccccggcggccccagccccggcgcccccggcggccccttccccagcagcgtgcccggcagcctgctgcccccccccccccccccccccctgcccggcggcatgctgccccccccccccccccccctgccccccggcggccccccccccccccccggccccccccccctgggcgccatcatgcccccccccggcgcccccatgggcctggccctgaagaagaagagcatcccccagcccaccaacgccctgaagagcttcaactggagcaagctgcccgagaacaagctggagggcaccgtgtggaccgagatcgacgacaccaaggtgttcaagatcctggacctggaggacctggagagaaccttcagcgcctaccagagacagcaggacttcttcgtgaacagcaacagcaagcagaaggaggccgacgccatcgacgacaccctgagcagcaagctgaaggtgaaggagctgagcgtgatcgacggcagaagagcccagaactgcaacatcctgctgagcagactgaagctgagcaacgacgagatcaagagagccatcctgaccatggacgagcaggaggacctgcccaaggacatgctggagcagctgctgaagttcgtgcccgagaagagcgacatcgacctgctggaggagcacaagcacgagctggacagaatggccaaggccgacagattcctgttcgagatgagcagaatcaaccactaccagcagagactgcagagcctgtacttcaagaagaagttcgccgagagagtggccttcggcaactacatgaacaagggccagagaggcaacgcctacggcttcaagatcagcagcctgaacaagatcgccgacaccaagagcagcatcgacaagaacatcaccctgctgcactacctgatcaccatcgtggagaacaagtaccccagcgtgctgaacctgaacgaggagctgagagacatcccccaggccgccaaggtgaagagctggaacatcagaagcctgagcccccacagccccgagatcagcctgtgcctgctgagcgccagcagcagccagtag

SEQ ID NO: 79401 - DNA, 3207 bp, Artificial Sequence
  Description of Artificial Sequence: Synthetic coding sequence
atggcccccagaaagagaggcggcagaggcatcagcttcatcttctgctgcttcagaaacaacgaccaccccgagatcacctacagactgagaaacgacagcaacttcgccctgcagaccatggagcccgccctgcccatgccccccgtggaggagctggacgtgatgttcagcgagctggtggacgagctggacctgaccgacaagcacagagaggccatgttcgccctgcccgccgagaagaagtggcagatctactgcagcaagaagaaggaccaggaggagaacaagggcgccaccagctggcccgagttctacatcgaccagctgaacagcatggccgccagaaagagcctgctggccctggagaaggaggaggaggaggagagaagcaagaccatcgagagcctgaagaccgccctgagaaccaagcccatgagattcgtgaccagattcatcgacctggacggcctgagctgcatcctgaacttcctgaagaccatggactacgagaccagcgagagcagaatccacaccagcctgatcggctgcatcaaggccctgatgaacaacagccagggcagagcccacgtgctggcccacagcgagagcatcaacgtgatcgcccagagcctgagcaccgagaacatcaagaccaaggtggccgtgctggagatcctgggcgccgtgtgcctggtgcccggcggccacaagaaggtgctgcaggccatgctgcactaccagaagtacgccagcgagagaaccagattccagaccctgatcaacgacctggacaagagcaccggcagatacagagacgaggtgagcctgaagaccgccatcatgagcttcatcaacgccgtgctgagccagggcgccggcgtggagagcctggacttcagactgcacctgagatacgagttcctgatgctgggcatccagcccgtgatcgacaagctgagagagcacgagaacagcaccctggacagacacctggacttcttcgagatgctgagaaacgaggacgagctggagttcgccaagagattcgagctggtgcacatcgacaccaagagcgccacccagatgttcgagctgaccagaaagagactgacccacagcgaggcctacccccacttcatgagcatcctgcaccactgcctgcagatgccctacaagagaagcggcaacaccgtgcagtactggctgctgctggacagaatcatccagcagatcgtgatccagaacgacaagggccaggaccccgacagcacccccctggagaacttcaacatcaagaacgtggtgagaatgctggtgaacgagaacgaggtgaagcagtggaaggagcaggccgagaagatgagaaaggagcacaacgagctgcagcagaagctggagaagaaggagagagagtgcgacgccaagacccaggagaaggaggagatgatgcagaccctgaacaagatgaaggagaagctggagaaggagaccaccgagcacaagcaggtgaagcagcaggtggccgacctgaccgcccagctgcacgagctgagcagaagagccgtgtgcgccagcatccccggcggccccagccccggcgcccccggcggccccttccccagcagcgtgcccggcagcctgctgcccccccccccccccccccccctgcccggcggcatgctgccccccccccccccccccctgccccccggcggccccccccccccccccggccccccccccctgggcgccatcatgcccccccccggcgcccccatgggcctggccctgaagaagaagagcatcccccagcccaccaacgccctgaagagcttcaactggagcaagctgcccgagaacaagctggagggcaccgtgtggaccgagatcgacgacaccaaggtgttcaagatcctggacctggaggacctggagagaaccttcagcgcctaccagagacagcagaaggaggccgacgccatcgacgacaccctgagcagcaagctgaaggtgaaggagctgagcgtgatcgacggcagaagagcccagaactgcaacatcctgctgagcagactgaagctgagcaacgacgagatcaagagagccatcctgaccatggacgagcaggaggacctgcccaaggacatgctggagcagctgctgaagttcgtgcccgagaagagcgacatcgacctgctggaggagcacaagcacgagctggacagaatggccaaggccgacagattcctgttcgagatgagcagaatcaaccactaccagcagagactgcagagcctgtacttcaagaagaagttcgccgagagagtggccgaggtgaagcccaaggtggaggccatcagaagcggcagcgaggaggtgttcagaagcggcgccctgaagcagctgctggaggtggtgctggccttcggcaactacatgaacaagggccagagaggcaacgcctacggcttcaagatcagcagcctgaacaagatcgccgacaccaagagcagcatcgacaagaacatcaccctgctgcactacctgatcaccatcgtggagaacaagtaccccagcgtgctgaacctgaacgaggagctgagagacatcccccaggccgccaaggtgaacatgaccgagctggacaaggagatcagcaccctgagaagcggcctgaaggccgtggagaccgagctggagtaccagaagagccagcccccccagcccggcgacaagttcgtgagcgtggtgagccagttcatcaccgtggccagcttcagcttcagcgacgtggaggacctgctggccgaggccaaggacctgttcaccaaggccgtgaagcacttcggcgaggaggccggcaagatccagcccgacgagttcttcggcatcttcgaccagttcctgcaggccgtgagcgaggccaagcaggagaacgagaacatgagaaagaagaaggaggaggaggagagaagagccagaatggaggcccagctgaaggagcagagagagagagagagaaagatgagaaaggccaaggagaacagcgaggagagcggcgagttcgacgacctggtgagcgccctgagaagcggcgaggtgttcgacaaggacctgagcaagctgaagagaaacagaaagagaatcaccaaccagatgaccgacagcagcagagagagacccatcaccaagctgaacttctag

SEQ ID NO: 79402 - DNA, 3237 bp, Artificial Sequence; identical to SEQ ID NO: 79399
  Description of Artificial Sequence: Synthetic coding sequence

SEQ ID NO: 79403 - DNA, 3207 bp, Artificial Sequence
  Description of Artificial Sequence: Synthetic coding sequence
atggcccccagaaagagaagccaccacggcctgggcttcctgtgctgcttcggcggcagcgacatccccgagatcaacctgagagacaaccaccccctgcagttcatggagttcagcagccccatccccaacgccgaggagctgaacatcagattcgccgagctggtggacgagctggacctgaccgacaagaacagagaggccatgttcgccctgccccccgagaagaagtggcagatctactgcagcaagaagaaggagcaggaggaccccaacaagctggccaccagctggcccgactactacatcgacagaatcaacagcatggccgccatgcagagcctgtacgccttcgacgaggaggagaccgagatgagaaaccaggtggtggaggacctgaagaccgccctgagaacccagcccatgagattcgtgaccagattcatcgagctggagggcctgacctgcctgctgaacttcctgagaagcatggaccacgccacctgcgagagcagaatccacaccagcctgatcggctgcatcaaggccctgatgaacaacagccagggcagagcccacgtgctggcccagcccgaggccatcagcaccatcgcccagagcctgagaaccgagaacagcaagaccaaggtggccgtgctggagatcctgggcgccgtgtgcctggtgcccggcggccacaagaaggtgctgcaggccatgctgcactaccaggtgtacgccgccgagagaaccagattccagaccctgctgaacgagctggacagaagcctgggcagatacagagacgaggtgaacctgaagaccgccatcatgagcttcatcaacgccgtgctgaacgccggcgccggcgaggacaacctggagttcagactgcacctgagatacgagttcctgatgctgggcatccagcccgtgatcgacaagctgagacagcacgagaacgccatcctggacaagcacctggacttcttcgagatggtgagaaacgaggacgacctggagctggccagaagattcgacatggtgcacatcgacaccaagagcgccagccagatgttcgagctgatccacaagaagctgaagtacaccgaggcctacccctgcctgctgagcgtgctgcaccactgcctgcagatgccctacaagagaaacggcggctacttccagcagtggcagctgctggacagaatcctgcagcagatcgtgctgcaggacgagagaggcgtggaccccgacctggcccccctggagaacttcaacgtgaagaacatcgtgaacatgctgatcaacgagaacgaggtgaagcagtggagagaccaggccgagaagttcagaaaggagcacatggagctggtgagcagactggagagaaaggagagagagtgcgagaccaagaccctggagaaggaggagatgatgagaaccctgaacaagatgaaggacaagctggccagagagagccaggagctgagacaggccagaggccaggtggccgagctggtggcccagctgagcgagctgagcaccggccccgtgagcagcccccccccccccggcggccccctgaccctgagcagcagcatgaccaccaacgacctgccccccccccccccccccctgcccttcgcctgctgccccccccccccccccccccccctgccccccggcggcccccccaccccccccggcgcccccccctgcctgggcatgggcctgcccctgccccaggacccctaccccagcagcgacgtgcccctgagaaagaagagagtgccccagcccagccaccccctgaagagcttcaactgggtgaagctgaacgaggagagagtgcccggcaccgtgtggaacgagatcgacgacatgcaggtgttcagaatcctggacctggaggacttcgagaagatgttcagcgcctaccagagacaccagaaggagctgggcagcaccgaggacatctacctggccagcagaaaggtgaaggagctgagcgtgatcgacggcagaagagcccagaactgcatcatcctgctgagcaagctgaagctgagcaacgaggagatcagacaggccatcctgaagatggacgagcaggaggacctggccaaggacatgctggagcagctgctgaagttcatccccgagaagagcgacatcgacctgctggaggagcacaagcacgagatcgagagaatggccagagccgacagattcctgtacgagatgagcagaatcgaccactaccagcagagactgcaggccctgttcttcaagaagaagttccaggagagactggccgaggccaagcccaaggtggaggccatcctgctggccagcagagagctggtgagaagcaagagactgagacagatgctggaggtgatcctggccatcggcaacttcatgaacaagggccagagaggcggcgcctacggcttcagagtggccagcctgaacaagatcgccgacaccaagagcagcatcgacagaaacatcagcctgctgcactacctgatcatgatcctggagaagcacttccccgacatcctgaacatgcccagcgagctgcagcacctgcccgaggccgccaaggtgaacctggccgagctggagaaggaggtgggcaacctgagaagaggcctgagagccgtggaggtggagctggagtaccagagaagacaggtgagagagcccagcgacaagttcgtgcccgtgatgagcgacttcatcaccgtgagcagcttcagcttcagcgagctggaggaccagctgaacgaggccagagacaagttcgccaaggccctgatgcacttcggcgagcacgacagcaagatgcagcccgacgagttcttcggcatcttcgacaccttcctgcaggccttcagcgaggccagacaggacctggaggccatgagaagaagaaaggaggaggaggagagaagagccagaatggaggccatgctgaaggagcagagagagagagagagatggcagagacagagaaaggtgctggccgccggcagcagcctggaggagggcggcgagttcgacgacctggtgagcgccctgagaagcggcgaggtgttcgacaaggacctgtgcaagctgaagagaagcagaaagagaagcggcagccaggccctggaggtgaccagagagagagccatcaacagactgaactactag

SEQ ID NO: 79404 - DNA, 3207 bp, Artificial Sequence; identical to SEQ ID NO: 79403
  Description of Artificial Sequence: Synthetic coding sequence

SEQ ID NO: 79405 - DNA, 399 bp, Artificial Sequence
  Description of Artificial Sequence: Synthetic coding sequence
atggcccccagaaagagaagccaccacggcctgggcttcctgtgctgcttcggcggcagcgacatccccgagatcaacctgagagacaaccaccccctgcagttcatggagttcagcagccccatccccaacgccgaggagctgaacatcagattcgccgagctggtggacgagctggacctgaccgacaagaacagagaggccatgttcgccctgccccccgagaagaagtggcagatctactgcagcaagaagaaggtgcccagcctgacccccctggccaccagccagggcagctggcacggcgtggccctggccgccctggcctgcagctgcatccacctgatgttcatcacctgccagccctgcagcagatgctggagaaacaacagcgagtag

SEQ ID NO: 79406 - DNA, 3204 bp, Artificial Sequence
  Description of Artificial Sequence: Synthetic coding sequence
atggcccccagaaagagaagccaccacggcctgggcttcctgtgctgcttcggcggcagcgacatccccgagatcaacctgagagacaaccaccccctgcagttcatggagttcagcagccccatccccaacgccgaggagctgaacatcagattcgccgagctggtggacgagctggacctgaccgacaagaacagagaggccatgttcgccctgccccccgagaagaagtggcagatctactgcagcaagaagaaggagcaggaggaccccaacaagctggccaccagctggcccgactactacatcgacagaatcaacagcatggccgccatgcagagcctgtacgccttcgacgaggaggagaccgagatgagaaaccaggtggtggaggacctgaagaccgccctgagaacccagcccatgagattcgtgaccagattcatcgagctggagggcctgacctgcctgctgaacttcctgagaagcatggaccacgccacctgcgagagcagaatccacaccagcctgatcggctgcatcaaggccctgatgaacaacagccagggcagagcccacgtgctggcccagcccgaggccatcagcaccatcgcccagagcctgagaaccgagaacagcaagaccaaggtggccgtgctggagatcctgggcgccgtgtgcctggtgcccggcggccacaagaaggtgctgcaggccatgctgcactaccaggtgtacgccgccgagagaaccagattccagaccctgctgaacgagctggacagaagcctgggcagatacagagacgaggtgaacctgaagaccgccatcatgagcttcatcaacgccgtgctgaacgccggcgccggcgaggacaacctggagttcagactgcacctgagatacgagttcctgatgctgggcatccagcccgtgatcgacaagctgagacagcacgagaacgccatcctggacaagcacctggacttcttcgagatggtgagaaacgaggacgacctggagctggccagaagattcgacatggtgcacatcgacaccaagagcgccagccagatgttcgagctgatccacaagaagctgaagtacaccgaggcctacccctgcctgctgagcgtgctgcaccactgcctgcagatgccctacaagagaaacggcggctacttccagcagtggcagctgctggacagaatcctgcagcagatcgtgctgcaggacgagagaggcgtggaccccgacctggcccccctggagaacttcaacgtgaagaacatcgtgaacatgctgatcaacgagaacgaggtgaagcagtggagagaccaggccgagaagttcagaaaggagcacatggagctggtgagcagactggagagaaaggagagagagtgcgagaccaagaccctggagaaggaggagatgatgagaaccctgaacaagatgaaggacaagctggccagagagagccaggagctgagacaggccagaggccaggtggccgagctggtggcccagctgagcgagctgagcaccggccccgtgagcagcccccccccccccggcggccccctgaccctgagcagcagcatgaccaccaacgacctgccccccccccccccccccctgcccttcgcctgctgccccccccccccccccccccccctgccccccggcggcccccccaccccccccggcgcccccccctgcctgggcatgggcctgcccctgccccaggacccctaccccagcagcgacgtgcccctgagaaagaagagagtgccccagcccagccaccccctgaagagcttcaactgggtgaagctgaacgaggagagagtgcccggcaccgtgtggaacgagatcgacgacatgcaggtgttcagaatcctggacctggaggacttcgagaagatgttcagcgcctaccagagacaccagaaggagctgggcagcaccgaggacatctacctggccagcagaaaggtgaaggagctgagcgtgatcgacggcagaagagcccagaactgcatcatcctgctgagcaagctgaagctgagcaacgaggagatcagacaggccatcctgaagatggacgagcaggaggacctggccaaggacatgctggagcagctgctgaagttcatccccgagaagagcgacatcgacctgctggaggagcacaagcacgagatcgagagaatggccagagccgacagattcctgtacgagatgagcagaatcgaccactaccagcagagactgcaggccctgttcttcaagaagaagttccaggagagactggccgaggccaagcccaaggtggaggccatcctgctggccagcagagagctggtgagaagcaagagactgagacagatgctggaggtgatcctggccatcggcaacttcatgaacaagggccagagaggcggcgcctacggcttcagagtggccagcctgaacaagatcgccgacaccaagagcagcatcgacagaaacatcagcctgctgcactacctgatcatgatcctggagaagcacttccccgacatcctgaacatgcccagcgagctgcagcacctgcccgaggccgccaaggtgaacctggccgagctggagaaggaggtgggcaacctgagaagaggcctgagagccgtggaggtgctggagtaccagagaagacaggtgagagagcccagcgacaagttcgtgcccgtgatgagcgacttcatcaccgtgagcagcttcagcttcagcgagctggaggaccagctgaacgaggccagagacaagttcgccaaggccctgatgcacttcggcgagcacgacagcaagatgcagcccgacgagttcttcggcatcttcgacaccttcctgcaggccttcagcgaggccagacaggacctggaggccatgagaagaagaaaggaggaggaggagagaagagccagaatggaggccatgctgaaggagcagagagagagagagagatggcagagacagagaaaggtgctggccgccggcagcagcctggaggagggcggcgagttcgacgacctggtgagcgccctgagaagcggcgaggtgttcgacaaggacctgtgcaagctgaagagaagcagaaagagaagcggcagccaggccctggaggtgaccagagagagagccatcaacagactgaactactag

SEQ ID NO: 79407 - DNA, 1062 bp, Artificial Sequence
  Description of Artificial Sequence: Synthetic coding sequence
atgggcgccctgctgtgcgaccacagaagctgcagacccatcagcctgaccgtggccaagtgctgggaccccacccccagaagctacttcaccgtgcccagagccgaccccgtgagacccatcgaccccgccgcctggctgagccacaccgccgccctgaccggcgccctgcccagatacgagctggaggaggcccccctgaccgtgaagagcgacatgagcgccgtggtgagagtgatgcagctgcccgacagcggcctggagatcagagacagaatgtggctgaagatcaccatcgccaacgccgtgatcggcgccgacgtggtggactggctgtacacccacgtggagggcttcaaggagagaagagaggccagaaagtacgccagcagcctgctgaagcacggcttcctgagacacaccgtgaacaagatcaccttcagcgagcagtgctactacgtgttcggcgacctgtgcagcaacctggccaccctgaacctgaacagcggcagcagcggcaccagcgaccaggacaccctggcccccctgccccaccccgccgccccctggcccctgggccagggctacccctaccagtaccccggcccccccccctgcttcccccccgcctaccaggaccccggcttcagctacggcagcggcagcaccggcagccagcagagcgagggcagcaagagcagcggcagcaccagaagcagcagaagagcccccggcagagagaaggagagaagagccgccggcgccggcggcagcggcagcgagagcgaccacaccgcccccagcggcgtgggcagcagctggagagagagacccgccggccagctgagcagaggcagcagccccagaagccaggccagcgccaccgcccccggcctgccccccccccaccccaccaccaaggcctacaccgtggtgggcggcccccccggcggcccccccgtgagagagctggccgccgtgccccccgagctgaccggcagcagacagagcttccagaaggccatgggcaacccctgcgagttcttcgtggacatcatgtag

SEQ ID NO: 79408 - DNA, 1335 bp, Artificial Sequence
  Description of Artificial Sequence: Synthetic coding sequence
atggccgagaccaagatcatctaccacatggacgaggaggagaccccctacctggtgaagctgcccgtggcccccgagagagtgaccctggccgacttcaagaacgtgctgagcaacagacccgtgcacgcctacaagttcttcttcaagagcatggaccaggacttcggcgtggtgaaggaggagatcttcgacgacaacgccaagctgccctgcttcaacggcagagtggtgagctggctggtgctggccgagggcgcccacagcgacgccggcagccagggcaccgacagccacaccgacctgcccccccccctggagagaaccggcggcatcggcgacagcagaccccccagcttccaccccaacgtggccagcagcagagacggcatggacaacgagaccggcaccgagagcatggtgagccacagaagagagagagccagaagaagaaacagagaggaggccgccagaaccaacggccaccccagaggcgacagaagaagagacgtgggcctgccccccgacagcgccagcaccgccctgagcagcgagctggagagcagcagcttcgtggacagcgacgaggacggcagcaccagcagactgagcagcagcaccgagcagagcaccagcagcagactgatcagaaagtacgccagcagcctgctgaagcacggcttcctgagacacaccgtgaacaagatcaccttcagcgagcagtgctactacgtgttcggcgacctgtgcagcaacctggccaccctgaacctgaacagcggcagcagcggcaccagcgaccaggacaccctggcccccctgccccaccccgccgccccctggcccctgggccagggctacccctaccagtaccccggcccccccccctgcttcccccccgcctaccaggaccccggcttcagctacggcagcggcagcaccggcagccagcagagcgagggcagcaagagcagcggcagcaccagaagcagcagaagagcccccggcagagagaaggagagaagagccgccggcgccggcggcagcggcagcgagagcgaccacaccgcccccagcggcgtgggcagcagctggagagagagacccgccggccagctgagcagaggcagcagccccagaagccaggccagcgccaccgcccccggcctgccccccccccaccccaccaccaaggcctacaccgtggtgggcggcccccccggcggcccccccgtgagagagctggccgccgtgccccccgagctgaccggcagcagacagagcttccagaaggccatgggcaacccctgcgagttcttcgtggacatcatgtag

SEQ ID NO: 79409 - DNA, 2088 bp, Artificial Sequence
  Description of Artificial Sequence: Synthetic coding sequence
atggccgagaccaagatcatctaccacatggacgaggaggagaccccctacctggtgaagctgcccgtggcccccgagagagtgaccctggccgacttcaagaacgtgctgagcaacagacccgtgcacgcctacaagttcttcttcaagagcatggaccaggacttcggcgtggtgaaggaggagatcttcgacgacaacgccaagctgccctgcttcaacggcagagtggtgagctggctggtgctggccgagggcgcccacagcgacgccggcagccagggcaccgacagccacaccgacctgcccccccccctggagagaaccggcggcatcggcgacagcagaccccccagcttccaccccaacgtggccagcagcagagacggcatggacaacgagaccggcaccgagagcatggtgagccacagaagagagagagccagaagaagaaacagagaggaggccgccagaaccaacggccaccccagaggcgacagaagaagagacgtgggcctgccccccgacagcgccagcaccgccctgagcagcgagctggagagcagcagcttcgtggacagcgacgaggacggcagcaccagcagactgagcagcagcaccgagcagagcaccagcagcagactgatcagaaagcacaagagaagaagaagaaagcagagactgagacaggccgacagagccagcagcttcagcagcatcaccgacagcaccatgagcctgaacatcgtgaccgtgaccctgaacatggagagacaccacttcctgggcatcagcatcgtgggccagagcaacgacagaggcgacggcggcatctacatcggcagcatcatgaagggcggcgccgtggccgccgacggcagaatcgagcccggcgacatgctgctgcaggtgaacgacgtgaacttcgagaacatgagcaacgacgacgccgtgagagtgctgagagagatcgtgagccagaccggccccatcagcctgaccgtggccaagtgctgggaccccacccccagaagctacttcaccgtgcccagagccgaccccgtgagacccatcgaccccgccgcctggctgagccacaccgccgccctgaccggcgccctgcccagatacggcaccagcccctgcagcagcgccgtgaccagaaccagcagcagcagcctgaccagcagcgtgcccggcgccccccagctggaggaggcccccctgaccgtgaagagcgacatgagcgccgtggtgagagtgatgcagctgcccgacagcggcctggagatcagagacagaatgtggctgaagatcaccatcgccaacgccgtgatcggcgccgacgtggtggactggctgtacacccacgtggagggcttcaaggagagaagagaggccagaaagtacgccagcagcctgctgaagcacggcttcctgagacacaccgtgaacaagatcaccttcagcgagcagtgctactacgtgttcggcgacctgtgcagcaacctggccaccctgaacctgaacagcggcagcagcggcaccagcgaccaggacaccctggcccccctgccccaccccgccgccccctggcccctgggccagggctacccctaccagtaccccggcccccccccctgcttcccccccgcctaccaggaccccggcttcagctacggcagcggcagcaccggcagccagcagagcgagggcagcaagagcagcggcagcaccagaagcagcagaagagcccccggcagagagaaggagagaagagccgccggcgccggcggcagcggcagcgagagcgaccacaccgcccccagcggcgtgggcagcagctggagagagagacccgccggccagctgagcagaggcagcagccccagaagccaggccagcgccaccgcccccggcctgccccccccccaccccaccaccaaggcctacaccgtggtgggcggcccccccggcggcccccccgtgagagagctggccgccgtgccccccgagctgaccggcagcagacagagcttccagaaggccatgggcaacccctgcgagttcttcgtggacatcatgtag

SEQ ID NO: 79410 - DNA, 2013 bp, Artificial Sequence
  Description of Artificial Sequence: Synthetic coding sequence
atggccgagaccaagatcatctaccacatggacgaggaggagaccccctacctggtgaagctgcccgtggcccccgagagagtgaccctggccgacttcaagaacgtgctgagcaacagacccgtgcacgcctacaagttcttcttcaagagcatggaccaggacttcggcgtggtgaaggaggagatcttcgacgacaacgccaagctgccctgcttcaacggcagagtggtgagctggctggtgctggccgagggcgcccacagcgacgccggcagccagggcaccgacagccacaccgacctgcccccccccctggagagaaccggcggcatcggcgacagcagaccccccagcttccaccccaacgtggccagcagcagagacggcatggacaacgagaccggcaccgagagcatggtgagccacagaagagagagagccagaagaagaaacagagaggaggccgccagaaccaacggccaccccagaggcgacagaagaagagacgtgggcctgccccccgacagcgccagcaccgccctgagcagcgagctggagagcagcagcttcgtggacagcgacgaggacggcagcaccagcagactgagcagcagcaccgagcagagcaccagcagcagactgatcagaaagcacaagagaagaagaagaaagcagagactgagacaggccgacagagccagcagcttcagcagcatcaccgacagcaccatgagcctgaacatcgtgaccgtgaccctgaacatggagagacaccacttcctgggcatcagcatcgtgggccagagcaacgacagaggcgacggcggcatctacatcggcagcatcatgaagggcggcgccgtggccgccgacggcagaatcgagcccggcgacatgctgctgcaggtgaacgacgtgaacttcgagaacatgagcaacgacgacgccgtgagagtgctgagagagatcgtgagccagaccggccccatcagcctgaccgtggccaagtgctgggaccccacccccagaagctacttcaccgtgcccagagccgaccccgtgagacccatcgaccccgccgcctggctgagccacaccgccgccctgaccggcgccctgcccagatacgagctggaggaggcccccctgaccgtgaagagcgacatgagcgccgtggtgagagtgatgcagctgcccgacagcggcctggagatcagagacagaatgtggctgaagatcaccatcgccaacgccgtgatcggcgccgacgtggtggactggctgtacacccacgtggagggcttcaaggagagaagagaggccagaaagtacgccagcagcctgctgaagcacggcttcctgagacacaccgtgaacaagatcaccttcagcgagcagtgctactacgtgttcggcgacctgtgcagcaacctggccaccctgaacctgaacagcggcagcagcggcaccagcgaccaggacaccctggcccccctgccccaccccgccgccccctggcccctgggccagggctacccctaccagtaccccggcccccccccctgcttcccccccgcctaccaggaccccggcttcagctacggcagcggcagcaccggcagccagcagagcgagggcagcaagagcagcggcagcaccagaagcagcagaagagcccccggcagagagaaggagagaagagccgccggcgccggcggcagcggcagcgagagcgaccacaccgcccccagcggcgtgggcagcagctggagagagagacccgccggccagctgagcagaggcagcagccccagaagccaggccagcgccaccgcccccggcctgccccccccccaccccaccaccaaggcctacaccgtggtgggcggcccccccggcggcccccccgtgagagagctggccgccgtgccccccgagctgaccggcagcagacagagcttccagaaggccatgggcaacccctgcgagttcttcgtggacatcatgtag

SEQ ID NO: 79411 - DNA, 2151 bp, Artificial Sequence
  Description of Artificial Sequence: Synthetic coding sequence
atgggcgagaccaagatcatctaccacctggacggccaggagaccccctacctggtgaagctgcccctgcccgccgagagagtgaccctggccgacttcaagggcgtgctgcagagacccagctacaagttcttcttcaagagcatggacgacgacttcggcgtggtgaaggaggagatcagcgacgacaacgccaagctgccctgcttcaacggcagagtggtgagctggctggtgagcgccgagggcagccaccccgaccccgcccccttctgcgccgacaaccccagcgagctgcccccccccatggagagaaccggcggcatcggcgacagcagaccccccagcttccacccccacgccggcggcggcagccaggagaacctggacaacgacaccgagaccgacagcctggtgagcgcccagagagagagacccagaagaagagacggccccgagcacgccaccagactgaacggcaccgccaagggcgagagaagaagagagcccggcggctacgacagcagcagcaccctgatgagcagcgagctggagaccaccagcttcttcgacagcgacgaggacgacagcaccagcagattcagcagcagcaccgagcagagcagcgccagcagactgatgagaagacacaagagaagaagaagaaagcagaaggtgagcagaatcgagagaagcagcagcttcagcagcatcaccgacagcaccatgagcctgaacatcatcaccgtgaccctgaacatggagaagtacaacttcctgggcatcagcatcgtgggccagagcaacgagagaggcgacggcggcatctacatcggcagcatcatgaagggcggcgccgtggccgccgacggcagaatcgagcccggcgacatgctgctgcaggtgaacgagatcaacttcgagaacatgagcaacgacgacgccgtgagagtgctgagagagatcgtgcacaagcccggccccatcaccctgaccgtggccaagtgctgggaccccagccccagaggctgcttcaccctgcccagaagcgagcccatcagacccatcgaccccgccgcctgggtgagccacaccgccgccatgaccggcaccttccccgcctacggcatgagccccagcctgagcaccatcaccagcaccagcagcagcatcaccagcagcatccccgacaccgagagactggacgacttccacctgagcatccacagcgacatggccgccatcgtgaaggccatggccagccccgagagcggcctggaggtgagagacagaatgtggctgaagatcaccatccccaacgccttcatcggcagcgacgtggtggactggctgtaccacaacgtggagggcttcaccgacagaagagaggccagaaagtacgccagcaacctgctgaaggccggcttcatcagacacaccgtgaacaagatcaccttcagcgagcagtgctactacatcttcggcgacctgtgcggcaacatggccaacctgagcctgcacgaccacgacggcagcagcggcgccagcgaccaggacaccctggcccccctgccccaccccggcgccgccccctggcccatggccttcccctaccagtaccccccccccccccacccctacaacccccaccccggcttccccgagctgggctacagctacggcggcggcagcgccagcagccagcacagcgagggcagcagaagcagcggcagcaacagaagcggcagcgacagaagaaaggagaaggaccccaaggccggcgacagcaagagcggcggcagcggcagcgagagcgaccacaccaccagaagcagcctgagaggccccagagagagagcccccagcgagagaagcggccccgccgccagcgagcacagccacagaagccaccacagcctggccagcagcctgagaagccaccacacccaccccagctacggcccccccggcgtgccccccctgtacggcccccccatgctgatgatgccccccccccccgccgccatgggcccccccggcgccccccccggcagagacctggccagcgtgccccccgagctgaccgccagcagacagagcttcagaatggccatgggcaaccccagcgagttcttcgtggacgtgatgtag

SEQ ID NO: 79412 - DNA, 2172 bp, Artificial Sequence
  Description of Artificial Sequence: Synthetic coding sequence
atgggcgagaccaagatcatctaccacctggacggccaggagaccccctacctggtgaagctgcccctgcccgccgagagagtgaccctggccgacttcaagggcgtgctgcagagacccagctacaagttcttcttcaagagcatggacgacgacttcggcgtggtgaaggaggagatcagcgacgacaacgccaagctgccctgcttcaacggcagagtggtgagctggctggtgagcgccgagggcagccaccccgaccccgcccccttctgcgccgacaaccccagcgagctgcccccccccatggagagaaccggcggcatcggcgacagcagaccccccagcttccacccccacgccggcggcggcagccaggagaacctggacaacgacaccgagaccgacagcctggtgagcgcccagagagagagacccagaagaagagacggccccgagcacgccaccagactgaacggcaccgccaagggcgagagaagaagagagcccggcggctacgacagcagcagcaccctgatgagcagcgagctggagaccaccagcttcttcgacagcgacgaggacgacagcaccagcagattcagcagcagcaccgagcagagcagcgccagcagactgatgagaagacacaagagaagaagaagaaagcagaaggtgagcagaatcgagagaagcagcagcttcagcagcatcaccgacagcaccatgagcctgaacatcatcaccgtgaccctgaacatggagaagtacaacttcctgggcatcagcatcgtgggccagagcaacgagagaggcgacggcggcatctacatcggcagcatcatgaagggcggcgccgtggccgccgacggcagaatcgagcccggcgacatgctgctgcaggtgaacgagatcaacttcgagaacatgagcaacgacgacgccgtgagagtgctgagagagatcgtgcacaagcccggccccatcaccctgaccgtggccaagtgctgggaccccagccccagaggctgcttcaccctgcccagaagcgagcccatcagacccatcgaccccgccgcctgggtgagccacaccgccgccatgaccggcaccttccccgcctacggcatgagccccagcctgagcaccatcaccagcaccagcagcagcatcaccagcagcatccccgacaccgagagactggacgacttccacctgagcatccacagcgacatggccgccatcgtgaaggccatggccagccccgagagcggcctggaggtgagagacagaatgtggctgaagatcaccatccccaacgccttcatcggcagcgacgtggtggactggctgtaccacaacgtggagggcttcaccgacagaagagaggccagaaagtacgccagcaacctgctgaaggccggcttcatcagacacaccgtgaacaagatcaccttcagcgagcagtgctactacatcttcggcgacctgtgcggcaacatggccaacctgagcctgcacgaccacgacggcagcagcggcgccagcgaccaggacaccctggcccccctgccccaccccggcgccgccccctggcccatggccttcccctaccagtaccccccccccccccacccctacaacccccaccccggcttccccgagctgggctacagctacggcggcggcagcgccagcagccagcacagcgagggcagcagaagcagcggcagcaacagaagcggcagcgacagaagaaaggagaaggaccccaaggccggcgacagcaagagcggcggcagcggcagcgagagcgaccacaccaccagaagcagcctgagaggccccagagagagagcccccagcgagagaagcggccccgccgccagcgagcacagccacagaagccaccacagcctggccagcagcctgagaagccaccacacccaccccagctacggcccccccggcgtgccccccctgtacggcccccccatgctgatgatgccccccccccccgccgccatgggcccccccggcgccccccccggcagagacctggccagcgtgccccccgagctgaccgccagcagacagagcttcagaatggccatgggcaaccccagcgagttcttcgtggacgtgatggtgctgagaggctggggcgcctag

SEQ ID NO: 79413 - DNA, 2100 bp, Artificial Sequence
  Description of Artificial Sequence: Synthetic coding sequence
atgggcgagaccaagatcatctaccacctggacggccaggagaccccctacctggtgaagctgcccctgcccgccgagagagtgaccctggccgacttcaagggcgtgctgcagagacccagctacaagttcttcttcaagagcatggacgacgacttcggcgtggtgaaggaggagatcagcgacgacaacgccaagctgccctgcttcaacggcagagtggtgagctggctggtgagcgccgagggcagccaccccgaccccgcccccttctgcgccgacaaccccagcgagctgcccccccccatggagagaaccggcggcatcggcgacagcagaccccccagcttccacccccacgccggcggcggcagccaggagaacctggacaacgacaccgagaccgacagcctggtgagcgcccagagagagagacccagaagaagagacggccccgagcacgccaccagactgaacggcaccgccaagggcgagagaagaagagagcccggcggctacgacagcagcagcaccctgatgagcagcgagctggagaccaccagcttcttcgacagcgacgaggacgacagcaccagcagattcagcagcagcaccgagcagagcagcgccagcagactgatgagaagacacaagagaagaagaagaaagcagaaggtgagcagaatcgagagaagcagcagcttcagcagcatcaccgacagcaccatgagcctgaacatcatcaccgtgaccctgaacatggagaagtacaacttcctgggcatcagcatcgtgggccagagcaacgagagaggcgacggcggcatctacatcggcagcatcatgaagggcggcgccgtggccgccgacggcagaatcgagcccggcgacatgctgctgcaggtgaacgagatcaacttcgagaacatgagcaacgacgacgccgtgagagtgctgagagagatcgtgcacaagcccggccccatcaccctgaccgtggccaagtgctgggaccccagccccagaggctgcttcaccctgcccagaaccatgaccggcaccttccccgcctacggcatgagccccagcctgagcaccatcaccagcaccagcagcagcatcaccagcagcatccccgacaccgagagactggacgacttccacctgagcatccacagcgacatggccgccatcgtgaaggccatggccagccccgagagcggcctggaggtgagagacagaatgtggctgaagatcaccatccccaacgccttcatcggcagcgacgtggtggactggctgtaccacaacgtggagggcttcaccgacagaagagaggccagaaagtacgccagcaacctgctgaaggccggcttcatcagacacaccgtgaacaagatcaccttcagcgagcagtgctactacatcttcggcgacctgtgcggcaacatggccaacctgagcctgcacgaccacgacggcagcagcggcgccagcgaccaggacaccctggcccccctgccccaccccggcgccgccccctggcccatggccttcccctaccagtaccccccccccccccacccctacaacccccaccccggcttccccgagctgggctacagctacggcggcggcagcgccagcagccagcacagcgagggcagcagaagcagcggcagcaacagaagcggcagcgacagaagaaaggagaaggaccccaaggccggcgacagcaagagcggcggcagcggcagcgagagcgaccacaccaccagaagcagcctgagaggccccagagagagagcccccagcgagagaagcggccccgccgccagcgagcacagccacagaagccaccacagcctggccagcagcctgagaagccaccacacccaccccagctacggcccccccggcgtgccccccctgtacggcccccccatgctgatgatgccccccccccccgccgccatgggcccccccggcgccccccccggcagagacctggccagcgtgccccccgagctgaccgccagcagacagagcttcagaatggccatgggcaaccccagcgagttcttcgtggacgtgatgtag

SEQ ID NO: 79414 - DNA, 315 bp, Artificial Sequence
  Description of Artificial Sequence: Synthetic coding sequence
atgcccgaggcccacatgcagcccgccaagctgcagaccagcctgcccaccaccgaccacggcagcaagaagcccgtgagctgctacctgccccccctgagcaacgcccaccccatgtgcatcgaggtgcagaacgcccagaactgcagcagcgccgccgccaccctggagcccagcatcatcagcgacacctgcttctacaagcccatcaccaaggaccagctgagcagcagaagcgagctgaacaccgtgagactgaagtgcctgaacagcctgagaggctggaagatcctgaaccagctgagcctgacctag

SEQ ID NO: 79415 - DNA, 1437 bp, Artificial Sequence
  Description of Artificial Sequence: Synthetic coding sequence
atgggcagcagatggagcagcgaggaggagagacagcccctgctgggccccggcctgggccccggcctgggcgccagctggagaagcagagaggccgccgccgccgccctgcccgccgccgtgcccggccccggcagagtgtacggcagaagatggctggtgctgctgctgttcagcctgctggccttcgtgcagggcctggtgtggaacacctggggccccatccagaacagcgccagacaggcctacggcttcagcagctgggacatcgccctgctggtgctgtggggccccatcggcttcctgccctgcttcgccttcatgtggctgctggacaagagaggcctgagaatcaccgtgctgctgaccagcttcctgatggtgctgggcaccggcctgagatgcatccccatcagcgacctgatcctgaagagaagactgatccacggcggccagatgctgaacggcctggccggccccaccgtgatgaacgccgcccccttcctgagcaccacctggttcagcgccgacgagagagccaccgccaccgccatcgccagcatgctgagctacctgggcggcgcctgcgccttcctggtgggccccctggtggtgcccgcccccaacggcaccagccccctgctggccgccgagagcagcagagcccacatcaaggacagaatcgaggccgtgctgtacgccgagttcggcgtggtgtgcctgatcttcagcgccaccctggcctacttcccccccagaccccccctgccccccagcgtggccgccgccagccagagactgagctacagaagaagcgtgtgcagactgctgagcaacttcagattcctgatgatcgccctggcctacgccatccccctgggcgtgttcgccggctggagcggcgtgctggacctgatcctgacccccgcccacgtgagccaggtggacgccggctggatcggcttctggagcatcgtgggcggctgcgtggtgggcatcgccatggccagattcgccgacttcatcagaggcatgctgaagctgatcctgctgctgctgttcagcggcgccaccctgagcagcacctggttcaccctgacctgcctgaacagcatcacccacctgcccctgaccaccgtgaccctgtacgccagctgcatcctgctgggcgtgttcctgaacagcagcgtgcccatcttcttcgagctgttcgtggagaccgtgtaccccgtgcccgagggcatcacctgcggcgtggtgaccttcctgagcaacatgttcatgggcgtgctgctgttcttcctgaccttctaccacaccgagctgagctggttcaactggtgcctgcccggcagctgcctgctgagcctgctgctgatcctgtgcttcagagagagctacgacagactgtacctggacgtggtggtgagcgtgtag

SEQ ID NO: 79416 - DNA, 1644 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcaggccagcggcgacgacacccacacccccctgagaatggagcccagactgctggagcccaccgcccaggacagcctgcacgtgagcatcaccagaagagactggctgctgcaggagaagcagcagctgcagaaggagatcgaggccctgcaggccagaatgttcgtgctggaggccaaggaccagcagctgagaagagagatcgaggagcaggagcagcagctgcagtggcagggctgcgacctgacccccctggtgggccagctgagcctgggccagctgcaggaggtgagcaaggccctgcaggacaccctggccagcgccggccagatccccttccacgccgagccccccgagaccatcagaagatgcgtgtag

SEQ ID NO: 79417 - DNA, 1110 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggagctggagcccatcgccctggaccccccctggaagcccagacaccccgagcccaacagctactag

SEQ ID NO: 79418 - DNA, 717 bp, Artificial Sequence
  Description of Artificial Sequence: Synthetic coding sequence
atggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccggcaccaactgcttcggcagcaccatggaggccagcaccagctag

SEQ ID NO: 79419 - DNA, 2268 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcaggccagcggcgacgacacccacacccccctgagaatggagcccagactgctggagcccaccgcccaggacagcctgcacgtgagcatcaccagaagagactggctgctgcaggagaagcagcagctgcagaaggagatcgaggccctgcaggccagaatgttcgtgctggaggccaaggaccagcagctgagaagagagatcgaggagcaggagcagcagctgcagtggcagggctgcgacctgacccccctggtgggccagctgagcctgggccagctgcaggaggtgagcaaggccctgcaggacaccctggccagcgccggccagatccccttccacgccgagccccccgagaccatcagaagcctgcaggagagaatcaagagcctgaacctgagcctgaaggagatcaccaccaaggtgtgcatgagcgagaagttctgcagcaccctgagaaagaaggtgaacgacatcgagacccagctgcccgccctgctggaggccaagatgcacgccatcagcggcaaccacttctggaccgccaaggacctgaccgaggagatcagaagcctgaccagcgagagagagggcctggagggcctgctgagcaagctgctggtgctgagcagcagaaacgtgaagaagctgggcagcgtgaaggaggactacaacagactgagaagagaggtggagcaccaggagaccgcctacgacggcgtgagcctgtgcagacccgtgtggagcgccgtggtgagaagctgcagcctgcagcccctgccccccgagttcaagcagttcagctgcctgagcctgagaagcagctgggactacagatgcccccccccctgcctggccaacttcgtgttcctggtggagatgggcttctaccacgtggaccagaccggcctgaagctgctgaccagcagcgacccccccagcagcgccagccagagcgccggcatcaccgacatgagccactgcgcctggcccctgcagtag

SEQ ID NO: 79420 - DNA, 2037 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcaggccagcggcgacgacacccacacccccctgagaatggagcccagactgctggagcccaccgcccaggacagcctgcacgtgagcatcaccagaagagactggctgctgcaggagaagcagcagctgcagaaggagatcgaggccctgcaggccagaatgttcgtgctggaggccaaggaccagcagctgagaagagagatcgaggagcaggagcagcagctgcagtggcagggctgcgacctgacccccctggtgggccagctgagcctgggccagctgcaggaggtgagcaaggccctgcaggacaccctggccagcgccggccagatccccttccacgccgagccccccgagaccatcagaagcctgcaggagagaatcaagagcctgaacctgagcctgaaggagatcaccaccaaggtgtgcatgagcgagaagttctgcagcaccctgagaaagaaggtgaacgacatcgagacccagctgcccgccctgctggaggccaagatgcacgccatcagcggcaaccacttctggaccgccaaggacctgaccgaggagatcagaagcctgaccagcgagagagagggcctggagggcctgctgagcaagctgctggtgctgagcagcagaaacgtgaagaagctgggcagcgtgaaggaggactacaacagactgagaagagaggtggagcaccaggagaccgcctacggctacaagtactgcgacgccgagagctggacccagagaagccagcagctggcctag

SEQ ID NO: 79421 - DNA, 2499 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcaggccagcggcgacgacacccacacccccctgagaatggagcccagactgctggagcccaccgcccaggacagcctgcacgtgagcatcaccagaagagactggctgctgcaggagaagcagcagctgcagaaggagatcgaggccctgcaggccagaatgttcgtgctggaggccaaggaccagcagctgagaagagagatcgaggagcaggagcagcagctgcagtggcagggctgcgacctgacccccctggtgggccagctgagcctgggccagctgcaggaggtgagcaaggccctgcaggacaccctggccagcgccggccagatccccttccacgccgagccccccgagaccatcagaagcctgcaggagagaatcaagagcctgaacctgagcctgaaggagatcaccaccaaggtgtgcatgagcgagaagttctgcagcaccctgagaaagaaggtgaacgacatcgagacccagctgcccgccctgctggaggccaagatgcacgccatcagcggcaaccacttctggaccgccaaggacctgaccgaggagatcagaagcctgaccagcgagagagagggcctggagggcctgctgagcaagctgctggtgctgagcagcagaaacgtgaagaagctgggcagcgtgaaggaggactacaacagactgagaagagaggtggagcaccaggagaccgcctacgagaccagcgtgaaggagaacaccatgaagtacatggagaccctgaagaacaagctgtgcagctgcaagtgccccctgctgggcaaggtgtgggaggccgacctggaggcctgcagactgctgatccagagcctgcagctgcaggaggccagaggcagcctgagcgtggaggacgagagacagatggacgacctggagggcgccgccccccccatcccccccagactgcacagcgaggacaagagaaagacccccctgaaggagagctacatcctgagcgccgagctgggcgagaagtgcgaggacatcggcaagaagctgctgtacctggaggaccagctgcacaccgccatccacagccacgacgaggacctgatccacagcctgagaagagagctgcagatggtgaaggagaccctgcaggccatgatcctgcagctgcagcccgccaaggaggccggcgagagagaggccgccgccagctgcatgaccgccggcgtgcacgaggcccaggcctag

SEQ ID NO: 79422 - DNA, 2661 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggtggagaccggcttccactacgtgggccaggccggcctggagctgctgaccagcagcaacccccccgccagcgccagccagagcgccggcatcaccgccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcaggccagcggcgacgacacccacacccccctgagaatggagcccagactgctggagcccaccgcccaggacagcctgcacgtgagcatcaccagaagagactggctgctgcaggagaagcagcagctgcagaaggagatcgaggccctgcaggccagaatgttcgtgctggaggccaaggaccagcagctgagaagagagatcgaggagcaggagcagcagctgcagtggcagggctgcgacctgacccccctggtgggccagctgagcctgggccagctgcaggaggtgagcaaggccctgcaggacaccctggccagcgccggccagatccccttccacgccgagccccccgagaccatcagaagcctgcaggagagaatcaagagcctgaacctgagcctgaaggagatcaccaccaaggtgtgcatgagcgagaagttctgcagcaccctgagaaagaaggtgaacgacatcgagacccagctgcccgccctgctggaggccaagatgcacgccatcagcggcaaccacttctggaccgccaaggacctgaccgaggagatcagaagcctgaccagcgagagagagggcctggagggcctgctgagcaagctgctggtgctgagcagcagaaacgtgaagaagctgggcagcgtgaaggaggactacaacagactgagaagagaggtggagcaccaggagaccgcctacgagaccagcgtgaaggagaacaccatgaagtacatggagaccctgaagaacaagctgtgcagctgcaagtgccccctgctgggcaaggtgtgggaggccgacctggaggcctgcagactgctgatccagagcctgcagctgcaggaggccagaggcagcctgagcgtggaggacgagagacagatggacgacctggagggcgccgccccccccatcccccccagactgcacagcgaggacaagagaaagacccccctgaaggtgctggaggagtggaagacccacctgatccccagcctgcactgcgccggcggcgagcagaaggaggagagctacatcctgagcgccgagctgggcgagaagtgcgaggacatcggcaagaagctgctgtacctggaggaccagctgcacaccgccatccacagccacgacgaggacctgatccacagcctgagaagagagctgcagatggtgaaggagaccctgcaggccatgatcctgcagctgcagcccgccaaggaggccggcgagagagaggccgccgccagctgcatgaccgccggcgtgcacgaggcccaggcctag

SEQ ID NO: 79423 - DNA, 621 bp, Artificial Sequence
  Description of Artificial Sequence: Synthetic coding sequence
tgaaaccacttctggaccgccaaggacctgaccgaggagatcagaagcctgaccagcgagagagagggcctggagggcctgctgagcaagctgctggtgctgagcagcagaaacgtgaagaagctgggcagcgtgaaggaggactacaacagactgagaagagaggtggagcaccaggagaccgcctacgagaccagcgtgaaggagaacaccatgaagtacatggagaccctgaagaacaagctgtgcagctgcaagtgccccctgctgggcaaggtgtgggaggccgacctggaggcctgcagactgctgatccagagcctgcagctgcaggaggccagaggcagcctgagcgtggaggacgagagacagatggacgacctggagggcgccgccccccccatcccccccagactgcacagcgaggacaagagaaagacccccctgaaggtgctggaggagtggaagacccacctgatccccagcctgcactgcgccggcggcgagcagaaggaggtgtgccccttccacatggccagcagaggcgacccctacagcaagggctgcttcggcaccatgctgcagatgggcaccatcaacatcggcaaggccagccactag

SEQ ID NO: 79424 - DNA, 279 bp, Artificial Sequence
  Description of Artificial Sequence: Synthetic coding sequence
atgaagtacatggagaccctgaagaacaagctgtgcagctgcaagtgccccctgctgggcaaggtgtgggaggccgacctggaggcctgcagactgctgatccagagcctgcagctgcaggaggccagaggcagcctgagcgtggaggacgagagacagatggacgacctggagggcgccgccccccccatcccccccagactgcacagcgaggacaagagaaagacccccctgaaggtgctggaggagtggaagacccacctgatccccagcctgtag

SEQ ID NO: 79425 - DNA, 2565 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcaggccagcggcgacgacacccacacccccctgagaatggagcccagactgctggagcccaccgcccaggacagcctgcacgtgagcatcaccagaagagactggctgctgcaggagaagcagcagctgcagaaggagatcgaggccctgcaggccagaatgttcgtgctggaggccaaggaccagcagctgagaagagagatcgaggagcaggagcagcagctgcagtggcagggctgcgacctgacccccctggtgggccagctgagcctgggccagctgcaggaggtgagcaaggccctgcaggacaccctggccagcgccggccagatccccttccacgccgagccccccgagaccatcagaagcctgcaggagagaatcaagagcctgaacctgagcctgaaggagatcaccaccaaggtgtgcatgagcgagaagttctgcagcaccctgagaaagaaggtgaacgacatcgagacccagctgcccgccctgctggaggccaagatgcacgccatcagcggcaaccacttctggaccgccaaggacctgaccgaggagatcagaagcctgaccagcgagagagagggcctggagggcctgctgagcaagctgctggtgctgagcagcagaaacgtgaagaagctgggcagcgtgaaggaggactacaacagactgagaagagaggtggagcaccaggagaccgcctacgagaccagcgtgaaggagaacaccatgaagtacatggagaccctgaagaacaagctgtgcagctgcaagtgccccctgctgggcaaggtgtgggaggccgacctggaggcctgcagactgctgatccagagcctgcagctgcaggaggccagaggcagcctgagcgtggaggacgagagacagatggacgacctggagggcgccgccccccccatcccccccagactgcacagcgaggacaagagaaagacccccctgaaggtgctggaggagtggaagacccacctgatccccagcctgcactgcgccggcggcgagcagaaggaggagagctacatcctgagcgccgagctgggcgagaagtgcgaggacatcggcaagaagctgctgtacctggaggaccagctgcacaccgccatccacagccacgacgaggacctgatccacagcctgagaagagagctgcagatggtgaaggagaccctgcaggccatgatcctgcagctgcagcccgccaaggaggccggcgagagagaggccgccgccagctgcatgaccgccggcgtgcacgaggcccaggcctag

SEQ ID NO: 79426 - DNA, 2199 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcacctgcaggagagaatcaagagcctgaacctgagcctgaaggagatcaccaccaaggtgtgcatgagcgagaagttctgcagcaccctgagaaagaaggtgaacgacatcgagacccagctgcccgccctgctggaggccaagatgcacgccatcagcggcaaccacttctggaccgccaaggacctgaccgaggagatcagaagcctgaccagcgagagagagggcctggagggcctgctgagcaagctgctggtgctgagcagcagaaacgtgaagaagctgggcagcgtgaaggaggactacaacagactgagaagagaggtggagcaccaggagaccgcctacgagaccagcgtgaaggagaacaccatgaagtacatggagaccctgaagaacaagctgtgcagctgcaagtgccccctgctgggcaaggtgtgggaggccgacctggaggcctgcagactgctgatccagagcctgcagctgcaggaggccagaggcagcctgagcgtggaggacgagagacagatggacgacctggagggcgccgccccccccatcccccccagactgcacagcgaggacaagagaaagacccccctgaaggtgctggaggagtggaagacccacctgatccccagcctgcactgcgccggcggcgagcagaaggaggagagctacatcctgagcgccgagctgggcgagaagtgcgaggacatcggcaagaagctgctgtacctggaggaccagctgcacaccgccatccacagccacgacgaggacctgatccacagcctgagaagagagctgcagatggtgaaggagaccctgcaggccatgatcctgcagctgcagcccgccaaggaggccggcgagagagaggccgccgccagctgcatgaccgccggcgtgcacgaggcccaggcctag

SEQ ID NO: 79427 - DNA, 1830 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcaggccagcggcgacgacacccacacccccctgagaatggagcccagactgctggagcccaccgcccaggacagcctgcacgtgagcatcaccagaagagactggctgctgcaggagaagcagcagctgcagaaggagatcgaggccctgcaggccagaatgttcgtgctggaggccaaggaccagcagctgagaagagagatcgaggagcaggagcagcagctgcagtggcagggctgcgacctgacccccctggtgggccagctgagcctgggccagctgcaggaggtgagcaaggccctgcaggacaccctggccagcgccggccagatccccttccacgccgagccccccgagaccatcagaagagaggtgagacaccagaccgccccctgcagaaaccaccagctggagaagcccgtgatcaacatctgggccttccacctgagaagaaagatctgcctgttccaggccgacggcctgcagcacggcagcgccgaggtgaagcacctgaaggagaccagcgtggagcccgccggcagcaccgccagcagaaaggagtag

SEQ ID NO: 79428 - DNA, 2088 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcaggccagcggcgacgacacccacacccccctgagaatggagcccagactgctggagcccaccgcccaggacagcctgcacgtgagcatcaccagaagagactggctgctgcaggagaagcagcagctgcagaaggagatcgaggccctgcaggccagaatgttcgtgctggaggccaaggaccagcagctgagaagagagatcgaggagcaggagcagcagctgcagtggcagggctgcgacctgacccccctggtgggccagctgagcctgggccagctgcaggaggtgagcaaggccctgcaggacaccctggccagcgccggccagatccccttccacgccgagccccccgagaccatcagaagcctgcaggagagaatcaagagcctgaacctgagcctgaaggagatcaccaccaaggtgtgcatgagcgagaagttctgcagcaccctgagaaagaaggtgaacgacatcgagacccagctgcccgccctgctggaggccaagatgcacgccatcagcggcaaccacttctggaccgccaaggacctgaccgaggagatcagaagcctgaccagcgagagagagggcctggagggcctgctgagcaagctgctggtgctgagcagcagaaacgtgaagaagctgggcagcgtgaaggaggactacaacagactgagaagagaggtggagcaccaggagaccgcctacgccgccagcgtgcactgcctgggcaagtgcggcaagctgacctggaagctggtggactgcctgagcagagcctacagcagcagaaagcccggcgaggcctgcctgtag

SEQ ID NO: 79429 - DNA, 1680 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcaggccagcggcgacgacacccacacccccctgagaatggagcccagactgctggagcccaccgcccaggacagcctgcacgtgagcatcaccagaagagactggctgctgcaggagaagcagcagctgcagaaggagatcgaggccctgcaggccagaatgttcgtgctggaggccaaggaccagcagctgagaagagagatcgaggagcaggagcagcagctgcagtggcagggctgcgacctgacccccctggtgggccagctgagcctgggccagctgcaggaggtgagcaaggccctgcaggacaccctggccagcgccggccagatccccttccacgccgagccccccgagaccatcagaagaaacaagtgcgagggcaagtactacgaggtgcacggcaacacctag

SEQ ID NO: 79430 - DNA, 1740 bp, Artificial Sequence
  Description of Artificial Sequence: Synthetic coding sequence
atgcccggcggcggcccccagggcgcccccgccgccgccggcggcggcggcgtgagccacagagccggcagcagagactgcctgccccccgccgcctgcttcagaagaagaagactggccagaagacccggctacatgagaagcagcaccggccccggcatcggcttcctgagccccgccgtgggcaccctgttcagattccccggcggcgtgagcggcgaggagagccaccacagcgagagcagagccagacagtgcggcctggacagcagaggcctgctggtgagaagccccgtgagcaagagcgccgccgcccccaccgtgaccagcgtgagaggcaccagcgcccacttcggcatccagctgagaggcggcaccagactgcccgacagactgagctggccctgcggccccggcagcgccggctggcagcaggagttcgccgccatggacagcagcgagaccctggacgccagctgggaggccgcctgcagcgacggcgccagaagagtgagagccgccggcagcctgcccagcgccgagctgagcagcaacagctgcagccccggctgcggccccgaggtgccccccaccccccccggcagccacagcgccttcaccagcagcttcagcttcatcagactgagcctgggcagcgccggcgagagaggcgaggccgagggctgcccccccagcagagaggccgagagccactgccagagcccccaggagatgggcgccaaggccgccagcctggacggcccccacgaggaccccagatgcctgagcagacccttcagcctgctggccaccagagtgagcgccgacctggcccaggccgccagaaacagcagcagacccgagagagacatgcacagcctgcccgacatggaccccggcagcagcagcagcctggaccccagcctggccggctgcggcggcgacggcagcagcggcagcggcgacgcccacagctgggacaccctgctgagaaagtgggagcccgtgctgagagactgcctgctgagaaacagaagacagatggaggtgatcagcctgagactgaagctgcagaagctgcaggaggacgccgtggagaacgacgactacgacaaggccgagaccctgcagcagagactggaggacctggagcaggagaagatcagcctgcacttccagctgcccagcagacagcccgccctgagcagcttcctgggccacctggccgcccaggtgcaggccgccctgagaagaggcgccacccagcaggccagcggcgacgacacccacacccccctgagaatggagcccagactgctggagcccaccgcccaggacagcctgcacgtgagcatcaccagaagagactggctgctgcaggagaagcagcagctgcagaaggagatcgaggccctgcaggccagaatgttcgtgctggaggccaaggaccagcagctgagaagagagatcgaggagcaggagcagcagctgcagtggcagggctgcgacctgacccccctggtgggccagctgagcctgggccagctgcaggaggtgagcaaggccctgcaggacaccctggccagcgccggccagatccccttccacgccgagccccccgagaccatcagaagcctgcaggagagaatcaagagcctgaacctgagcctgaaggagatcaccaccaaggagaccatcagcggcagactgaagaccagccccagaagactggaccactag

SEQ ID NO: 79431 - DNA, 390 bp, Artificial Sequence
  Description of Artificial Sequence: Synthetic coding sequence
atgaccatgaccaccatgcccgagagcctgaacagccccgtgagcggcaaggccgtgttcatggagttcggcccccccaaccagcagatgagccccagccccatgagccacggccactacagcatgcactgcctgcacagcgccggccacagccagcccgacggcgcctacagcagcgccagcagcttcagcagacccctgggctacccctacgtgaacagcgtgagcagccacgccagcagcccctacatcagcagcgtgcagagctaccccggcagcgccagcctggcccagagcagactggaggaccccggccaggacctggtgcccaagcaggccatccaggtgcaggaggccgacgaggccggctggggcggcagcggcggctag

SEQ ID NO: 79432 - DNA, 516 bp, Artificial Sequence
  Description of Artificial Sequence: Synthetic coding sequence
atgaccatgaccaccatgcccgagagcctgaacagccccgtgagcggcaaggccgtgttcatggagttcggcccccccaaccagcagatgagccccagccccatgagccacggccactacagcatgcactgcctgcacagcgccggccacagccagcccgacggcgcctacagcagcgccagcagcttcagcagacccctgggctacccctacgtgaacagcgtgagcagccacgccagcagcccctacatcagcagcgtgcagagctaccccggcagcgccagcctggcccagagcagactggaggaccccggcgccgacagcgagaagagcaccgtggtggagggcggcgaggtgagattcaacggcaagggcaagaagatcagaaagcccagaaccatctacagcagcctgcagctgcaggccctgaacagaagattccagcagacccagtacctggccctgcccgagagagccgagctggccgccagcctgggcctgacccagacccagtag

SEQ ID NO: 79433 - DNA, 768 bp, Artificial Sequence
  Description of Artificial Sequence: Synthetic coding sequence
atgaccatgaccaccatgcccgagagcctgaacagccccgtgagcggcaaggccgtgttcatggagttcggcccccccaaccagcagatgagccccagccccatgagccacggccactacagcatgcactgcctgcacagcgccggccacagccagcccgacggcgcctacagcagcgccagcagcttcagcagacccctgggctacccctacgtgaacagcgtgagcagccacgccagcagcccctacatcagcagcgtgcagagctaccccggcagcgccagcctggcccagagcagactggaggaccccggcgccgacagcgagaagagcaccgtggtggagggcggcgaggtgagattcaacggcaagggcaagaagatcagaaagcccagaaccatctacagcagcctgcagctgcaggccctgaacagaagattccagcagacccagtacctggccctgcccgagagagccgagctggccgccagcctgggcctgacccagacccaggtgaagatctggttccagaacaagagaagcaagttcaagaagctgatgaagcagggcggcgccgccctggagggcagcgccctggccaacggcagagccctgagcgccggcagcccccccgtgccccccggctggaaccccaacagcagcagcggcaagggcagcggcggcaacgccggcagctacatccccagctacaccagctggtaccccagcgcccaccaggaggccatgcagcagccccagctgatgtag

SEQ ID NO: 79434 - DNA, 564 bp, Artificial Sequence
  Description of Artificial Sequence: Synthetic coding sequence
atgaccatgaccaccatgcccgagagcctgaacagccccgtgagcggcaaggccgtgttcatggagttcggcccccccaaccagcagatgagccccagccccatgagccacggccactacagcatgcactgcctgcacagcgccggccacagccagcccgacggcgcctacagcagcgccagcagcttcagcagacccctgggctacccctacgtgaacagcgtgagcagccacgccagcagcccctacatcagcagcgtgcagagctaccccggcagcgccagcctggcccagagcagactggaggaccccggcgccgacagcgagaagagcaccgtggtggagggcggcgaggtgagattcaacggcaagggcaagaagatcagaaagcccagaaccatctacagcagcctgcagctgcaggccctgaacagaagattccagcagacccagtacctggccctgcccgagagagccgagctggccgccagcctgggcctgacccagacccaggtgaagatctggttccagaacaagagaagcaagttcaagaagctgatgtag

SEQ ID NO: 79435 - DNA, 1722 bp, Artificial Sequence
  Description of Artificial Sequence: Synthetic coding sequence
atgggcaagtgcctgagctgctgcaaggaggaccagagcttccagagatgcagccccgaggaccaggtgagcaccgacgcccagcacagaggcgccagcagcatcagccagcccagcatcagcctgggccacaagaccagctacagccccgtgacccacaaggtgaacgccgccaaggccagcagaagactgctgagcgtgagcagccccagcttcagcgagagaagatacagcctgttcgtgggcttccagaagagaaacgccagcccctactggcagcagagcagagccaacttcgacagcgaggaggacaccggcttcaccgacatcaagagcagcagcgaccactgcggcagcttcatcagcagaagaagaagattcagcagcagaaagctgagcatcgtgagctactacaagagcgccatcttcttcgacccccaggccagcggccagaacgtgttcaacctgaacgagatcgagatcttcagcaagaccagcagcaacaccgacgccaagaagcacatcaccatcagcgcccccgagtacaacaccaagaacttcaagaacttcgagaccaacaccaccagccccgccttcggcaacaccatcgacaccgccagctaccagcagagcaccagcagcttcttcagcctggccagcgacatcagcagccccgaccagcagaacggcatcgccaacgacatccagcagagaggccagctgtgcaaggacctgaaggacttcctgcaccccagacccgagagctacagcaccggccacagccccatcatgatcccccagcaccccagccagagcggcaccttccccttcctgcacaaggccggcttcagcagcagctacaagaacagcggctgcttcatccccccccagagcgagctgaccagcggcctgttcgaggacgaggacttcgccgtgctgttccaggacgaggacagaagcagccccatcgagatccccaagatcagatacatcaccgccaacaccgacaccgaggagcagagcttccccgtgcccaaggccttcaacaccagagtggaggagctgaacctggacgtgctgctgcagaaggtggaccacctgagaatgagcgagagcggcaagagcgagagcttcgagctgctgagagaccacaaggagaagttcagagacgagatcgagttcatgtggagattcgccagagcctacggcgacatgtacgagctgagcaccaacacccaggagaagaagcactacgccaacatcggcaagaccctgagcgagagagccatcaacagagcccccatgaacggccactgccacctgtggtacgccgtgctgtgcggctacgtgagcgagttcgagggcctgcagaacaagatcaactacggccacctgttcaaggagcacctggacatcgccatcaagctgctgcccgaggagcccttcctgtactacctgaagggcagatactgctacaccgtgagcaagctgagctggatcgagaagaagatggccgccaccctgttcggcaagatccccagcagcaccgtgcaggaggccctgcacaacttcctgaaggccgaggagctgtgccccggctacagcaaccccaactacatgtacctggccaagtgctacaccgacctggaggagaaccagaacgccctgaagttctgcaacctggccctgctgctgcccaccgtgaccaaggaggagctgtag

SEQ ID NO: 79436 - DNA, 654 bp, Artificial Sequence
  Description of Artificial Sequence: Synthetic coding sequence
atgaccggcgtgttcgacagcctggtggccgacatgcacagcacccagatcgccgccagcagcacctaccaccagcaccagcagccccccagcggcggcggcgccggccccggcggcaacagcagcagcagcagcagcctgcacaagccccaggagagccccaccctgcccgtgagcaccgccaccgacagcagctactacaccaaccagcagcaccccgccggcggcggcggcggcggcggcagcccctacgcccacatgggcagctaccagtaccaggccagcggcctgaacaacgtgccctacagcgccaagagcagctacgacctgggctacaccgccgcctacaccagctacgccccctacggcaccagcagcagccccgccaacaacgagcccgagaaggaggacctggagcccgagatcagaatcgtgaacggcaagcccaagaaggtgagaaagcccagaaccatctacagcagcttccagctggccgccctgcagagaagattccagaagacccagtacctggccctgcccgagagagccgagctggccgccagcctgggcctgacccagacccaggtgggcctggccccctgcagaggcgaggagagcgccggcctgagatggctgggcagcagaagagtgtag

SEQ ID NO: 79437 - DNA, 864 bp, Artificial Sequence
  Description of Artificial Sequence: Synthetic coding sequence
atgagcggcagcttcgacagaaagctgagcagcatcctgaccgacatcagcagcagcctgagctgccacgccggcagcaaggacagccccaccctgcccgagagcagcgtgaccgacctgggctactacagcgccccccagcacgactactacagcggccagccctacggccagaccgtgaacccctacacctaccaccaccagttcaacctgaacggcctggccggcaccggcgcctacagccccaagagcgagtacacctacggcgccagctacagacagtacggcgcctacagagagcagcccctgcccgcccaggaccccgtgagcgtgaaggaggagcccgaggccgaggtgagaatggtgaacggcaagcccaagaaggtgagaaagcccagaaccatctacagcagctaccagctggccgccctgcagagaagattccagaaggcccagtacctggccctgcccgagagagccgagctggccgcccagctgggcctgacccagacccaggtgaagatctggttccagaacagaagaagcaagttcaagaagctgtacaagaacggcgaggtgcccctggagcacagccccaacaacagcgacagcatggcctgcaacagcccccccagccccgccctgtgggacaccagcagccacagcacccccgcccccgccagaagccagctgcccccccccctgccctacagcgccagccccagctacctggacgaccccaccaacagctggtaccacgcccagaacctgagcggcccccacctgcagcagcagcccccccagcccgccaccctgcaccacgccagccccggccccccccccaaccccggcgccgtgtactag

SEQ ID NO: 79438 - DNA, 723 bp, Artificial Sequence
  Description of Artificial Sequence: Synthetic coding sequence
atgaccagcctgccctgccccctgcccggcagagacgccagcaaggccgtgttccccgacctggcccccgtgcccagcgtggccgccgcctaccccctgggcctgagccccaccaccgccgccagccccaacctgagctacagcagaccctacggccacctgctgagctacccctacaccgagcccgccaaccccggcgacagctacctgagctgccagcagcccgccgccctgagccagcccctgtgcggccccgccgagcacccccaggagctggaggccgacagcgagaagcccagactgagccccgagcccagcgagagaagaccccaggcccccgccaagaagctgagaaagcccagaaccatctacagcagcctgcagctgcagcacctgaaccagagattccagcacacccagtacctggccctgcccgagagagcccagctggccgcccagctgggcctgacccagacccaggtgaagatctggttccagaacaagagaagcaagtacaagaagctgctgaagcagaacagcggcggccaggagggcgacttccccggcagaaccttcagcgtgagcccctgcagcccccccctgcccagcctgtgggacctgcccaaggccggcaccctgcccaccagcggctacggcaacagcttcggcgcctggtaccagcaccacagcagcgacgtgctggccagcccccagatgatgtag

SEQ ID NO: 79439 - DNA, 507 bp, Artificial Sequence
  Description of Artificial Sequence: Synthetic coding sequence
atgaagctgagcgtgctgccccccagaagcctgctggccccctacaccgtgctgtgctgcccccccgacagcgagaagcccagactgagccccgagcccagcgagagaagaccccaggcccccgccaagaagctgagaaagcccagaaccatctacagcagcctgcagctgcagcacctgaaccagagattccagcacacccagtacctggccctgcccgagagagcccagctggccgcccagctgggcctgacccagacccaggtgaagatctggttccagaacaagagaagcaagtacaagaagctgctgaagcagaacagcggcggccaggagggcgacttccccggcagaaccttcagcgtgagcccctgcagcccccccctgcccagcctgtgggacctgcccaaggccggcaccctgcccaccagcggctacggcaacagcttcggcgcctggtaccagcaccacagcagcgacgtgctggccagcccccagatgatgtag

SEQ ID NO: 79440 - DNA, 1473 bp, Artificial Sequence
  Description of Artificial Sequence: Synthetic coding sequence
atggaccacaccgacaacgagctgcagggcaccaacagcagcggcagcctgggcggcctggacgtgagaagaagaatccccatcaagctgatcagcaagcaggccaacaaggccaagcccgcccccagaacccagagaaccatcaacagaatgcccgccaaggccccccccggcgacgagggcttcgactacaacgaggaggagagatacgactgcaagggcggcgagctgttcgccaaccagagaagattccccggccacctgttctgggacttccagatcaacatcctgggcgagaaggacgacacccccgtgcacttctgcgacaagtgcggcctgcccatcaagatctacggcagaatgatcccctgcaagcacgtgttctgctacgactgcgccatcctgcacgagaagaagggcgacaagatgtgccccggctgcagcgaccccgtgcagagaatcgagcagtgcaccagaggcagcctgttcatgtgcagcatcgtgcagggctgcaagagaacctacctgagccagagagacctgcaggcccacatcaaccacagacacatgagagccggcaagcccgtgaccagagccagcctggagaacgtgcacccccccatcgcccccccccccaccgagatccccgagagattcatcatgccccccgacaagcaccacatgagccacatcccccccaagcagcacatcatgatgccccccccccccctgcagcacgtgccccacgagcactacaaccagccccacgaggacatcagagccccccccgccgagctgagcatggccccccccccccccagaagcgtgagccaggagaccttcagaatcagcaccagaaagcacagcaacctgatcaccgtgcccatccaggacgacagcaacagcggcgccagagagccccccccccccgcccccgcccccgcccaccaccaccccgagtaccagggccagcccgtggtgagccacccccaccacatcatgcccccccagcagcactacgccccccccccccccccccccccccccatcagccaccccatgccccaccccccccaggccgccggcaccccccacctggtgtacagccaggccccccccccccccatgaccagcgcccccccccccatcacccccccccccggccacatcatcgcccagatgcccccctacatgaaccaccccccccccggccccccccccccccagcacggcggcccccccgtgaccgccccccccccccaccactacaaccccaacagcctgccccagttcaccgaggaccagggcaccctgagcccccccttcacccagcccggcggcatgagccccggcatctggcccgcccccagaggccccccccccccccccagactgcagggcccccccagccagacccccctgcccggcccccaccaccccgaccagaccagatacagaccctactaccagtag

SEQ ID NO: 79441 - DNA, 798 bp, Artificial Sequence
  Description of Artificial Sequence: Synthetic coding sequence
atgatgaccatgaccaccatggccgacggcctggagggccaggacagcagcaagagcgccttcatggagttcggccagcagcagcagcagcagcacagccccgccatggccggcgcccactaccccctgcactgcctgcacagcgccgccgccgccgccgccgccggcagccaccaccaccaccaccaccagcaccaccaccacggcagcccctacgccagcggcggcggcaacagctacaaccacagaagcctggccgcctacccctacatgagccacagccagcacagcccctacctgcagagctaccacaacagcagcgccgccgcccagaccagaggcgacgacaccgaccagcagaagaccaccgtgatcgagaacggcgagatcagattcaacggcaagggcaagaagatcagaaagcccagaaccatctacagcagcctgcagctgcaggccctgaaccacagattccagcagacccagtacctggccctgcccgagagagccgagctggccgccagcctgggcctgacccagacccaggtgaagatctggttccagaacaagagaagcaagttcaagaagctgctgaagcagggcagcaacccccacgagagcgaccccctgcagggcagcgccgccctgagccccagaagccccgccctgccccccgtgtgggacgtgagcgccagcgccaagggcgtgagcatgccccccaacagctacatgcccggctacagccactggtacagcagcccccaccaggacaccatgcagagaccccagatgatgtag

SEQ ID NO: 79442 - DNA, 882 bp, Artificial Sequence
  Description of Artificial Sequence: Synthetic coding sequence
atgatgaccatgaccaccatggccgacggcctggagggccaggacagcagcaagagcgccttcatggagttcggccagcagcagcagcagcagcagcagcagcagcagcagcagcagcagcagcagcagcagccccccccccccccccccccccccccccagccccacagccagcagagcagccccgccatggccggcgcccactaccccctgcactgcctgcacagcgccgccgccgccgccgccgccggcagccaccaccaccaccaccaccagcaccaccaccacggcagcccctacgccagcggcggcggcaacagctacaaccacagaagcctggccgcctacccctacatgagccacagccagcacagcccctacctgcagagctaccacaacagcagcgccgccgcccagaccagaggcgacgacaccgaccagcagaagaccaccgtgatcgagaacggcgagatcagattcaacggcaagggcaagaagatcagaaagcccagaaccatctacagcagcctgcagctgcaggccctgaaccacagattccagcagacccagtacctggccctgcccgagagagccgagctggccgccagcctgggcctgacccagacccaggtgaagatctggttccagaacaagagaagcaagttcaagaagctgctgaagcagggcagcaacccccacgagagcgaccccctgcagggcagcgccgccctgagccccagaagccccgccctgccccccgtgtgggacgtgagcgccagcgccaagggcgtgagcatgccccccaacagctacatgcccggctacagccactggtacagcagcccccaccaggacaccatgcagagaccccagatgatgtag

SEQ ID NO: 79443 - DNA, 9084 bp, Artificial Sequence
  Description of Artificial Sequence: Synthetic coding sequence
atgaacctgcaccaggtgctgaccggcgccgtgaaccccggcgaccactgcttcagcgtgggcagcatcggcgaccagagattcaccgcctacgccagcggctgcgacatcgtgatcctgggcagcgacttcgagagactgcagatcatccccggcgccaagcacggcaacatccaggtgggctgcgtggactgcagcatgcagcagggcaagatcgccgccagctacggcaacgtgatcagcatcttcgagcccgtgaacctgcccaagcagaagaagaacctggagctgtacagccagtggcagaagagcggccagttcttcctggagagcatcgcccacaacatcacctgggaccccaccggcagcagactgctgaccggcagcagctacctgcagctgtggagcaacaccaacctggagaagcccaccgaggacgagaacctgaacaagaccgacctgaacttcggcgactggaagtgcatctggcactgcaagaccgccagccaggtgcacctgatgaagttcagccccgacggcgagttcttcgccaccgccggcaaggacgactgcctgctgaaggtgtggtacaacgtggagaactggagaaccgccgtgaccagccccgacggcagcagcgagaagcagagccagggcgagatcgacttcagcttcgtgtacctggcccaccccagagccgtgaacggcttcagctggagaaagaccagcaagtacatgcccagagccagcgtgtgcaacgtgctgctgacctgctgcaaggacaacgtgtgcagactgtgggtggagaccttcctgcccaacgactgcctgctgtacggcggcgactgcagccactggaccgagagcatcaacctgaccaacaacttcaagagaaacgccagcagcaaggagagagtgcagaacgccctggaggtgaacctgagacacttcagaagaggcagaagaagaagcctggccctggtggcccacaccggctacctgccccaccagcaggacccccaccacgtgcacagaaacacccccctgcacgccaacgccctgtgccacttccacatcgccgccagcatcaaccccgccaccgacatccccctgctgcccagcatcaccagcctgagcctgaacgagaacgaggagaagaccggccccttcgtggtgcactggctgaacaacaaggagctgcacttcaccctgagcatggaggtgttcctgcagcagctgagaaagagcttcgagcagcccagcagcgaggccagcgtggaggacagcaaccaggccgacgtgaagagcgacgaggagaccgacgacggcgtggacgacctgaagatcaaccccgagaagaaggagctgggctgcgacaagatggtgcccaacagcagcttcaccagcctgagcagcgccgccatcgaccaccagatcgaggtgctgctgagcgagtggagcaagaacgccgacatgctgttcagcatccaccccatggacggcagcctgctggtgtggcacgtggactggctggacgagtaccagcccggcatgttcagacaggtgcaggtgagcttcgtgagcagaatccccgtggccttccccaccggcgacgccaacagcctgtgcaagagcatcatgatgtacgcctgcaccaagaacgtggacctggccatccagcagggcaagcagaagcccagcggcctgaccagaagcaccagcatgctgatcagcagcggccacaacaagagcagcaacagcctgaagctgagcatcttcacccccaacgtgatgatgatcagcaagcacgccgacggcagcctgaaccagtggctggtgagcttcgccgaggagagcgccttcagcaccgtgctgagcatcagccacaagagcagatactgcggccacagattccacctgaacgacctggcctgccacagcgtgctgcccctgctgctgaccaccagccaccacaacgccctgagaacccccgacgtggacaaccccgagcagcccttcgacgccctgaacatcgaggagtgcagcctgacccagcagaacaagagcaccgtggacgtggccttccaggaccccagcgccgtgtacagcgagctgatcctgtggagagtggaccccgtgggccccctgagcttcagcggcggcgtgagcgagctggccagaatcaacagcctgcacgtgagcgccttcagcaacgtggcctggctgcccaccctgatccccagctactgcctgggcgcctactgcaacagccccagcgcctgcttcgtggccagcgacggccagtacctgagactgtacgaggccgtgatcgacgccaagaagctgctgagcgagctgagcaaccccgagatcagcaagtacgtgggcgaggtgttcaacatcgtgagccagcagagcaccgccagacccggctgcatcatcgccctggaccccatcaccaagctgcacggcagaaagacccagctgctgcacgtgttcgaggaggacttcatcctgaacaacctggagaagaagagcctgggcaaggacagcatcctgagcaacgccggcagcagccccaacggcttcagcgagaagttctacctgatcgtgatcgagtgcacccaggacaacagaagcctgctgcacatgtggaacctgcacctgaagagcatccccgtgagcctggacgagaaggtggacaccaagctgagcgaggccgtgtggcagcccgaggagcactacagcagcagccccgagaagatcctgagccccttcagccagaagtaccaggcctgcagagccaacctgcagagcaccagcagactgaccctgttcagcgagatggtgtacagccaggagctgcacctgcccgagggcgtggagatcatcagcatcaagcccagcgccggccacctgagcagcagcagcatctaccccgcctgcagcgccccctacctgctggccaccagctgcagcgacgagaaggtgagattctggagatgcagagtgaccgacggcgagagcgccaccagcaagaacggcaagatcgacctggcctacatctgggaggagtggcccctgctgatcgaggacggcctgcagagcaacagcagcatcaccgtgcccggcagacccgtggaggtgagctgcgcccacaccaacagactggccgtggcctacaagcagcccgccagcaacagcagaagcagccaggacttcgtgatgcacgtgagcatcttcgagtgcgagagcaccggcggcagctgctgggtgctggagcagaccatccacctggacgagctgagcaccgtgctggacagcggcatcagcgtggacagcaacctggtggcctacaacaagcaggacatgtacctgagcagcaaggagaacatcaccagcaacaccaagcacctggtgcacctggactggatgagcagagaggacggcagccacatcctgaccgtgggcatcggcagcaagctgttcatgtacggccccctggccggcaaggtgcaggaccagaccggcaaggagaccctggccttccccctgtgggagagcaccaaggtggtgcccctgagcaagttcgtgctgctgagaagcgtggacctggtgagcagcgtggacggcagcccccccttccccgtgagcctgagctgggtgagagacggcatcctggtggtgggcatggactgcgagatgcacgtgtactgccagtggcagcccagcagcaagcaggagcccgtgatcaccgacagctacagcggcagcacccccagcatcaccagcctgatcaagcagagcaacagcagcagcggcctgcacccccccaagaagaccctgaccagaagcatgaccagcctggcccagaagatctgcggcaagaagaccgccttcgaccccagcgtggacatggaggacagcggcctgttcgaggccgcccacgtgctgagccccaccctgccccagtaccaccccctgcagctgctggagctgatggacctgggcaaggtgagaagagccaaggccatcctgagccacctggtgaagtgcatcgccggcgaggtggtggccctgaacgaggccgagagcaaccacgagagaagactgagaagcctgaccatcagcgccagcggcagcaccaccagagacccccaggccttcaacaaggccgagaacaccgactacaccgagatcgacagcgtgccccccctgcccctgtacgccctgctggccgccgacgacgacagctgctacagcagcctggagaagagcagcaacgagagcaccctgagcaagagcaaccagctgagcaaggagagctacgacgagctgttccagacccagctgctgatgaccgacacccacatgctggagaccgacgaggagaacaccaagcccagagtgatcgacctgagccagtacagccccacctacttcggccccgagcacgcccaggtgctgagcggccacctgctgcacagcagcctgcccggcctgagcagaatggagcagatgagcctgatggccctggccgacaccatcgccaccaccagcaccgacatcggcgagagcagagacagaagccagggcggcgagaccctggacgagtgcggcctgaagttcctgctggccgtgagactgcacaccttcctgaccaccagcctgcccgcctacagagcccagctgctgcaccagggcctgagcaccagccacttcgcctgggccttccacagcgtggccgaggaggagctgctgaacatgctgcccgccatgcagaaggacgaccccacctggagcgagctgagagccatgggcgtgggctggtgggtgagaaacaccagaatcctgagaaagtgcatcgagaaggtggccaaggccgccttctacagaaagaacgaccccctggacgccgccatcttctacctggccatgaagaagaaggccgtgatctggggcctgtacagagccgagaagaacaccagaatgacccagttcttcggccacaacttcgaggacgagagatggagaaaggccgccctgaagaacgccttcagcctgctgggcaagcagagattcgagcacagcgccgccttcttcctgctggccggctgcctgagagacgccatcgaggtgtgcctggagaagctgaacgacatccagctggccctggtgatcgccagactgtacgagagcgagttcgacaccagcgccgcctacaagagcatcctgagaaagaaggtgctgggcatcgacagccccgtgagcgagctgtgcagcctgaacatcaacatgcaccacgaccccttcctgagaagcatggcctactggatcctggaggactacagcggcgccctggagaccctgatcaagcagcccatcagagagaacgacgaccaggtgctgagcgccagcaaccccaccgtgttcaacttctacaactacctgagaacccaccccctgctgctgagaagacacttcggcagcagcgacaccttcagcacccacatgagcctgaccggcaagagcggcctggccggcaccatcaacctgagcgagagaagactgttcttcaccaccgccagcgcccacctgaaggccggctgccccatgctggccctggaggtgctgagcaagatgcccaaggtgatcaagaagaccagacccttctacagagccagcagcttcctggacaccagcaaggactgcagccccagcagccccctgaagctggacgccagagaggacaagagcagcgccgtggactggagccagagcctgatcaacggcttcggcagcagcagcgagggcagcagcgagaagcagagcaacagcaccctgagcttcgactggagccagcccagcgtggtgttccaggacgacagcctggagctgaagtgggacagcgacaacgacgaggagaacgaggacgtgcccatcagcatgaaggagctgaagcccctgcagagaaagaccgacaagaagctggacgacatcagcagcaactacaccgagagcttcagcaccctggacgagaacgacctgctgaaccccagcgaggacatcatcgccgtgcagctgaagttcagagcctgcctgaagatcctgaccgtggagctgagaaccctgagcaccggctacgagatcgacggcggcaagctgagataccagctgtaccactggctggagaaggaggtgatcgccctgcagagaacctgcgacttctgcagcgacgccgaggagctgcagagcgccttcggcagaaacgaggacgagttcggcctgaacgaggacgccgaggacctgccccaccagaccaaggtgaagcagctgagagagaacttccaggagaagagacagtggctgctgaagtaccagagcctgctgagaatgttcctgagctactgcatcctgcacggcagccacggcggcggcctggccagcgtgagaatggagctgatcctgctgctgcaggagagccagcaggagaccagcgagcccctgttcagcagccccctgagcgagcagaccagcgtgcccctgctgttcgcctgcaccgccaacgccaagaccgtggtggccaaccccctgctgcacctgagcaacctgacccacgacatcctgcacgccatcatcaacttcgacagccccccccaccccgacatccagagcaacaaggtgtacgtgatgcacaccctggccgccagcctgagcgcctgcatctaccagtgcctgtgcggcagccacaactacagcagcttccagaccaaccagttcaccggcatggtgtaccagaccgtgctgctgccccacagacccagcctgaagaccggcagcctggacgaggccctgacccccaacaccagccccgcccagtggcccggcatcacctgcctgatcagactgctgaacagcagcggcgaggaggcccagagcggcctgaccgtgctgctgtgcgagatcctgaccgccgtgtacctgagcctgttcatccacggcctggccacccacagcagcaacgagctgttcagaatcgtggcccaccccctgaacgagaagatgtggagcgccgtgttcggcggcggcgcccacgtgcccagcaaggagcagacccacagcaagaccctgcccgtgagcagcctggtggaggagggcgagaagcagaacaagagattcagacccagcaagatgagctgcagagagagcgcccccctgacccccagcagcgcccccgtgagccaggagagcctggccgtgaaggagaagttcatcccccccgagctgagcatctgggactacttcatcgccaagcccttcctgcccagcagccagagcagagccgagtacgacagcgaggagagcctgggcagcgacgacgacgacaacgacgacgacgacgacgtgctggccagcgacttccacctgcaggagcacagcaacagcaacagctacagctggagcctgatgagactggccatggtgcagctggtgctgaacaacctgaagaccttctaccccttcgccggccacgacctggccgagctgcccgtgagcagccccctgtgccacgccgtgctgaagaccctgcagtgctgggagcaggtgctgctgagaagactggagatccacggcggccccccccagaactacatcgccagccacaccgccgaggagagcctgagcgccggccccgccatcctgagacacaaggccctgctggagcccaccaacacccccttcaagagcaagcaccacctggccctgagcgtgaagagactgtggcagtacctggtgaagcaggaggagatccaggagaccttcatcaagaacatcttcaccaagaagagatgcctgaacgagatcgaggccgacctgggctaccccggcggcaaggccagaatcatccacaaggagagcgacatcatcaccgccttcgccgtgaacaaggccaacagaaactgcatcgccatcgccagcagccacgacgtgcaggagctggacgtgagcggcatcctggccacccaggtgtacacctgggtggacgacgacatcgaggtggagaccaagggcagcgaggacttcctggtgatccacgccagagacgacctgaccgccgtgcagggcaccaccccctacacccacagcaaccccggcacccccatcaacatgccctggctgggcagcacccagaccggcagaggcgccagcgtgatgatcaagaaggccatcaacaacgtgagaagaatgaccagccaccccaccctgccctactacctgaccggcgcccaggacggcagcgtgagaatgttcgagtggggccacagccagcagatcacctgcttcagaagcggcggcaacagcagagtgaccagaatgagattcaactaccagggcaacaagttcggcatcgtggacgccgacggctacctgagcctgtaccagaccaactggaagtgctgccccgtgaccggcagcatgcccaagccctacctgacctggcagtgccacaacaagaccgccaacgacttcgtgttcgtgagcagcagcagcctgatcgccaccgccggcctgagcaccgacaacagaaacgtgtgcctgtgggacaccctggtggcccccgccaacagcctggtgcacgccttcacctgccacgacagcggcgccaccgtgctggcctacgcccccaagcaccagctgctgatcagcggcggcagaaagggcttcacctacgtgttcgacctgtgccagagacagcagagacagctgttccagagccacgacagccccgtgaaggccgtggccgtggaccccaccgaggagtacttcgtgaccggcagcgccgagggcaacatcaagatctggagcctgagcaccttcggcctgctgcacaccttcgtgagcgagcacgccagacagagcatcttcagaaacatcggcaccggcgtgatgcagatcgagaccggccccgccaaccacatcttcagctgcggcgccgacggcaccatgaagatgagaatcctgcccgaccagttcagccccctgaacgaggtgctgaagaacgacgtgaagttcatgctgtag

SEQ ID NO: 79444 - DNA, 1770 bp, Artificial Sequence
  Description of Artificial Sequence: Synthetic coding sequence
atgaacctgcaccaggtgctgaccggcgccgtgaaccccggcgaccactgcttcagcgtgggcagcatcggcgaccagagattcaccgcctacgccagcggctgcgacatcgtgatcctgggcagcgacttcgagagactgcagatcatccccggcgccaagcacggcaacatccaggtgggctgcgtggactgcagcatgcagcagggcaagatcgccgccagctacggcaacgtgatcagcatcttcgagcccgtgaacctgcccaagcagaagaagaacctggagctgtacagccagtggcagaagagcggccagttcttcctggagagcatcgcccacaacatcacctgggaccccaccggcagcagactgctgaccggcagcagctacctgcagctgtggagcaacaccaacctggagaagcccaccgaggacgagaacctgaacaagaccgacctgaacttcggcgactggaagtgcatctggcactgcaagaccgccagccaggtgcacctgatgaagttcagccccgacggcgagttcttcgccaccgccggcaaggacgactgcctgctgaaggtgtggtacaacgtggagaactggagaaccgccgtgaccagccccgacggcagcagcgagaagcagagccagggcgagatcgacttcagcttcgtgtacctggcccaccccagagccgtgaacggcttcagctggagaaagaccagcaagtacatgcccagagccagcgtgtgcaacgtgctgctgacctgctgcaaggacaacgtgtgcagactgtgggtggagaccttcctgcccaacgactgcctgctgtacggcggcgactgcagccactggaccgagagcatcaacctgaccaacaacttcaagagaaacgccagcagcaaggagagagtgcagaacgccctggaggtgaacctgagacacttcagaagaggcagaagaagaagcctggccctggtggcccacaccggctacctgccccaccagcaggacccccaccacgtgcacagaaacacccccctgcacgccaacgccctgtgccacttccacatcgccgccagcatcaaccccgccaccgacatccccctgctgcccagcatcaccagcctgagcctgaacgagaacgaggagaagaccggccccttcgtggtgcactggctgaacaacaaggagctgcacttcaccctgagcatggaggtgttcctgcagcagctgagaaagagcttcgagcagcccagcagcgaggccagcgtggaggacagcaaccaggccgacgtgaagagcgacgaggagaccgacgacggcgtggacgacctgaagatcaaccccgagaagaaggagctgggctgcgacaagatggtgcccaacagcagcttcaccagcctgagcagcgccgccatcgaccaccagatcgaggtgctgctgagcgagtggagcaagaacgccgacatgctgttcagcatccaccccatggacggcagcctgctggtgtggcacgtggactggctggacgagtaccagcccggcatgttcagacaggtgcaggtgagcttcgtgagcagaatccccgtggccttccccaccggcgacgccaacagcctgtgcaagagcatcatgatgtacgcctgcaccaagaacgtggacctggccatccagcagggcaagcagaagcccagcggcctgaccagaagcaccagcatgctgatcagcagcggccacaacaagagcagcaacagcctgaagtag

SEQ ID NO: 79445 - DNA, 9147 bp, Artificial Sequence
  Description of Artificial Sequence: Synthetic coding sequence
atgaacctgcaccaggtgctgaccggcgccgtgaaccccggcgaccactgcttcagcgtgggcagcatcggcgaccagagattcaccgcctacgccagcggctgcgacatcgtgatcctgggcagcgacttcgagagactgcagatcatccccggcgccaagcacggcaacatccaggtgggctgcgtggactgcagcatgcagcagggcaagatcgccgccagctacggcaacgtgatcagcatcttcgagcccgtgaacctgcccaagcagaagaagaacctggagctgtacagccagtggcagaagagcggccagttcttcctggagagcatcgcccacaacatcacctgggaccccaccggcagcagactgctgaccggcagcagctacctgcagctgtggagcaacaccaacctggagaagcccaccgaggacgagaacctgaacaagaccgacctgaacttcggcgactggaagtgcatctggcactgcaagaccgccagccaggtgcacctgatgaagttcagccccgacggcgagttcttcgccaccgccggcaaggacgactgcctgctgaaggtgtggtacaacgtggagaactggagaaccgccgtgaccagccccgacggcagcagcgagaagcagagccagggcgagatcgacttcagcttcgtgtacctggcccaccccagagccgtgaacggcttcagctggagaaagaccagcaagtacatgcccagagccagcgtgtgcaacgtgctgctgacctgctgcaaggacaacgtgtgcagactgtgggtggagaccttcctgcccaacgactgcctgctgtacggcggcgactgcagccactggaccgagagcatcaacctgaccaacaacttcaagagaaacgccagcagcaaggagagagtgcagaacgccctggaggtgaacctgagacacttcagaagaggcagaagaagaagcctggccctggtggcccacaccggctacctgccccaccagcaggacccccaccacgtgcacagaaacacccccctgcacgccaacgccctgtgccacttccacatcgccgccagcatcaaccccgccaccgacatccccctgctgcccagcatcaccagcctgagcctgaacgagaacgaggagaagaccggccccttcgtggtgcactggctgaacaacaaggagctgcacttcaccctgagcatggaggtgttcctgcagcagctgagaaagagcttcgagcagcccagcagcgaggccagcgtggaggacagcaaccaggccgacgtgaagagcgacgaggagaccgacgacggcgtggacgacctgaagatcaaccccgagaagaaggagctgggctgcgacaagatggtgcccaacagcagcttcaccagcctgagcagcgccgccatcgaccaccagatcgaggtgctgctgagcgagtggagcaagaacgccgacatgctgttcagcatccaccccatggacggcagcctgctggtgtggcacgtggactggctggacgagtaccagcccggcatgttcagacaggtgcaggtgagcttcgtgagcagaatccccgtggccttccccaccggcgacgccaacagcctgtgcaagagcatcatgatgtacgcctgcaccaagaacgtggacctggccatccagcagggcaagcagaagcccagcggcctgaccagaagcaccagcatgctgatcagcagcggccacaacaagagcagcaacagcctgaagctgagcatcttcacccccaacgtgatgatgatcagcaagcacgccgacggcagcctgaaccagtggctggtgagcttcgccgaggagagcgccttcagcaccgtgctgagcatcagccacaagagcagatactgcggccacagattccacctgaacgacctggcctgccacagcgtgctgcccctgctgctgaccaccagccaccacaacgccctgagaacccccgacgtggacaaccccgagcagcccttcgacgccctgaacatcgaggagtgcagcctgacccagcagaacaagagcaccgtggacgtggccttccaggaccccagcgccgtgtacagcgagctgatcctgtggagagtggaccccgtgggccccctgagcttcagcggcggcgtgagcgagctggccagaatcaacagcctgcacgtgagcgccttcagcaacgtggcctggctgcccaccctgatccccagctactgcctgggcgcctactgcaacagccccagcgcctgcttcgtggccagcgacggccagtacctgagactgtacgaggccgtgatcgacgccaagaagctgctgagcgagctgagcaaccccgagatcagcaagtacgtgggcgaggtgttcaacatcgtgagccagcagagcaccgccagacccggctgcatcatcgccctggaccccatcaccaagctgcacggcagaaagacccagctgctgcacgtgttcgaggaggacttcatcctgaacaacctggagaagaagagcctgggcaaggacagcatcctgagcaacgccggcagcagccccaacggcttcagcgagaagttctacctgatcgtgatcgagtgcacccaggacaacagaagcctgctgcacatgtggaacctgcacctgaagagcatccccgtgagcctggacgagaaggtggacaccaagctgagcgaggccgtgtggcagcccgaggagcactacagcagcagccccgagaagatcctgagccccttcagccagaagtaccaggcctgcagagccaacctgcagagcaccagcagactgaccctgttcagcgagatggtgtacagccaggagctgcacctgcccgagggcgtggagatcatcagcatcaagcccagcgccggccacctgagcagcagcagcatctaccccgcctgcagcgccccctacctgctggccaccagctgcagcgacgagaaggtgagattctggagatgcagagtgaccgacggcgagagcgccaccagcaagaacggcaagatcgacctggcctacatctgggaggagtggcccctgctgatcgaggacggcctgcagagcaacagcagcatcaccgtgcccggcagacccgtggaggtgagctgcgcccacaccaacagactggccgtggcctacaagcagcccgccagcaacagcagaagcagccaggacttcgtgatgcacgtgagcatcttcgagtgcgagagcaccggcggcagctgctgggtgctggagcagaccatccacctggacgagctgagcaccgtgctggacagcggcatcagcgtggacagcaacctggtggcctacaacaagcaggacatgtacctgagcagcaaggagaacatcaccagcaacaccaagcacctggtgcacctggactggatgagcagagaggacggcagccacatcctgaccgtgggcatcggcagcaagctgttcatgtacggccccctggccggcaaggtgcaggaccagaccggcaaggagaccctggccttccccctgtgggagagcaccaaggtggtgcccctgagcaagttcgtgctgctgagaagcgtggacctggtgagcagcgtggacggcagcccccccttccccgtgagcctgagctgggtgagagacggcatcctggtggtgggcatggactgcgagatgcacgtgtactgccagtggcagcccagcagcaagcaggagcccgtgatcaccgacagctacagcggcagcacccccagcatcaccagcctgatcaagcagagcaacagcagcagcggcctgcacccccccaagaagaccctgaccagaagcatgaccagcctggcccagaagatctgcggcaagaagaccgccttcgaccccagcgtggacatggaggacagcggcctgttcgaggccgcccacgtgctgagccccaccctgccccagtaccaccccctgcagctgctggagctgatggacctgggcaaggtgagaagagccaaggccatcctgagccacctggtgaagtgcatcgccggcgaggtggtggccctgaacgaggccgagagcaaccacgagagaagactgagaagcctgaccatcagcgccagcggcagcaccaccagagacccccaggccttcaacaaggccgagaacaccgactacaccgagatcgacagcgtgccccccctgcccctgtacgccctgctggccgccgacgacgacagctgctacagcagcctggagaagagcagcaacgagagcaccctgagcaagagcaaccagctgagcaaggagagctacgacgagctgttccagacccagctgctgatgaccgacacccacatgctggagaccgacgaggagaacaccaagcccagagtgatcgacctgagccagtacagccccacctacttcggccccgagcacgcccaggtgctgagcggccacctgctgcacagcagcctgcccggcctgagcagaatggagcagatgagcctgatggccctggccgacaccatcgccaccaccagcaccgacatcggcgagagcagagacagaagccagggcggcgagaccctggacgagtgcggcctgaagttcctgctggccgtgagactgcacaccttcctgaccaccagcctgcccgcctacagagcccagctgctgcaccagggcctgagcaccagccacttcgcctgggccttccacagcgtggccgaggaggagctgctgaacatgctgcccgccatgcagaaggacgaccccacctggagcgagctgagagccatgggcgtgggctggtgggtgagaaacaccagaatcctgagaaagtgcatcgagaaggtggccaaggccgccttctacagaaagaacgaccccctggacgccgccatcttctacctggccatgaagaagaaggccgtgatctggggcctgtacagagccgagaagaacaccagaatgacccagttcttcggccacaacttcgaggacgagagatggagaaaggccgccctgaagaacgccttcagcctgctgggcaagcagagattcgagcacagcgccgccttcttcctgctggccggctgcctgagagacgccatcgaggtgtgcctggagaagctgaacgacatccagctggccctggtgatcgccagactgtacgagagcgagttcgacaccagcgccgcctacaagagcatcctgagaaagaaggtgctgggcatcgacagccccgtgagcgagctgtgcagcctgaacatcaacatgcaccacgaccccttcctgagaagcatggcctactggatcctggaggactacagcggcgccctggagaccctgatcaagcagcccatcagagagaacgacgaccaggtgctgagcgccagcaaccccaccgtgttcaacttctacaactacctgagaacccaccccctgctgctgagaagacacttcggcagcagcgacaccttcagcacccacatgagcctgaccggcaagagcggcctggccggcaccatcaacctgagcgagagaagactgttcttcaccaccgccagcgcccacctgaaggccggctgccccatgctggccctggaggtgctgagcaagatgcccaaggtgatcaagaagaccagacccttctacagagccagcagcttcctggacaccagcaaggactgcagccccagcagccccctgaagctggacgccagagaggacaagagcagcgccgtggactggagccagagcctgatcaacggcttcggcagcagcagcgagggcagcagcgagaagcagagcaacagcaccctgagcttcgactggagccagcccagcgtggtgttccaggacgacagcctggagctgaagtgggacagcgacaacgacgaggagaacgaggacgtgcccatcagcatgaaggagctgaagcccctgcagagaaagaccgacaagaagctggacgacatcagcagcaactacaccgagagcttcagcaccctggacgagaacgacctgctgaaccccagcgaggacatcatcgccgtgcagctgaagttcagagcctgcctgaagatcctgaccgtggagctgagaaccctgagcaccggctacgagatcgacggcggcaagctgagataccagctgtaccactggctggagaaggaggtgatcgccctgcagagaacctgcgacttctgcagcgacgccgaggagctgcagagcgccttcggcagaaacgaggacgagttcggcctgaacgaggacgccgaggacctgccccaccagaccaaggtgaagcagctgagagagaacttccaggagaagagacagtggctgctgaagtaccagagcctgctgagaatgttcctgagctactgcatcctgcacggcagccacggcggcggcctggccagcgtgagaatggagctgatcctgctgctgcaggagagccagcaggagaccagcgagcccctgttcagcagccccctgagcgagcagaccagcgtgcccctgctgttcgcctgcaccgccaacgccaagaccgtggtggccaaccccctgctgcacctgagcaacctgacccacgacatcctgcacgccatcatcaacttcgacagccccccccaccccgacatccagagcaacaaggtgtacgtgatgcacaccctggccgccagcctgagcgcctgcatctaccagtgcctgtgcggcagccacaactacagcagcttccagaccaaccagttcaccggcatggtgtaccagaccgtgctgctgccccacagacccagcctgaagaccggcagcctggacgaggccctgacccccaacaccagccccgcccagtggcccggcatcacctgcctgatcagactgctgaacagcagcggcgaggaggcccagagcggcctgaccgtgctgctgtgcgagatcctgaccgccgtgtacctgagcctgttcatccacggcctggccacccacagcagcaacgagctgttcagaatcgtggcccaccccctgaacgagaagatgtggagcgccgtgttcggcggcggcgcccacgtgcccagcaaggagcagacccacagcaagaccctgcccgtgagcagcctggtggaggagggcgagaagcagaacaagagattcagacccagcaagatgagctgcagagagagcgcccccctgacccccagcagcgcccccgtgagccaggagagcctggccgtgaaggagaagttcatcccccccgagctgagcatctgggactacttcatcgccaagcccttcctgcccagcagccagagcagagccgagtacgacagcgaggagagcctgggcagcgacgacgacgacaacgacgacgacgacgacgtgctggccagcgacttccacctgcaggagcacagcaacagcaacagctacagctggagcctgatgagactggccatggtgcagctggtgctgaacaacctgaagaccttctaccccttcgccggccacgacctggccgagctgcccgtgagcagccccctgtgccacgccgtgctgaagaccctgcagtgctgggagcaggtgctgctgagaagactggagatccacggcggccccccccagaactacatcgccagccacaccgccgaggagagcctgagcgccggccccgccatcctgagacacaaggccctgctggagcccaccaacacccccttcaagagcaagcaccacctggccctgagcgtgaagagactgtggcagtacctggtgaagcaggaggagatccaggagaccttcatcaagaacatcttcaccaagaagagatgcctgaacgagagcctggaggacaacagcgagaccatcaagaacagcatgatggaggagcccaacatcaacaagatcgaggccgacctgggctaccccggcggcaaggccagaatcatccacaaggagagcgacatcatcaccgccttcgccgtgaacaaggccaacagaaactgcatcgccatcgccagcagccacgacgtgcaggagctggacgtgagcggcatcctggccacccaggtgtacacctgggtggacgacgacatcgaggtggagaccaagggcagcgaggacttcctggtgatccacgccagagacgacctgaccgccgtgcagggcaccaccccctacacccacagcaaccccggcacccccatcaacatgccctggctgggcagcacccagaccggcagaggcgccagcgtgatgatcaagaaggccatcaacaacgtgagaagaatgaccagccaccccaccctgccctactacctgaccggcgcccaggacggcagcgtgagaatgttcgagtggggccacagccagcagatcacctgcttcagaagcggcggcaacagcagagtgaccagaatgagattcaactaccagggcaacaagttcggcatcgtggacgccgacggctacctgagcctgtaccagaccaactggaagtgctgccccgtgaccggcagcatgcccaagccctacctgacctggcagtgccacaacaagaccgccaacgacttcgtgttcgtgagcagcagcagcctgatcgccaccgccggcctgagcaccgacaacagaaacgtgtgcctgtgggacaccctggtggcccccgccaacagcctggtgcacgccttcacctgccacgacagcggcgccaccgtgctggcctacgcccccaagcaccagctgctgatcagcggcggcagaaagggcttcacctacgtgttcgacctgtgccagagacagcagagacagctgttccagagccacgacagccccgtgaaggccgtggccgtggaccccaccgaggagtacttcgtgaccggcagcgccgagggcaacatcaagatctggagcctgagcaccttcggcctgctgcacaccttcgtgagcgagcacgccagacagagcatcttcagaaacatcggcaccggcgtgatgcagatcgagaccggccccgccaaccacatcttcagctgcggcgccgacggcaccatgaagatgagaatcctgcccgaccagttcagccccctgaacgaggtgctgaagaacgacgtgaagttcatgctgtag

SEQ ID NO: 79446 - DNA, 9111 bp, Artificial Sequence
  Description of Artificial Sequence: Synthetic coding sequence
atgcacctgcaccaggtgctgaccggcgccgtgaaccccggcgacaactgctacagcgtgggcagcgtgggcgacgtgcccttcaccgcctacggcagcggctgcgacatcgtgatcctggccaacgacttcgagtgcgtgcagatcatccccggcgccaagcacggcaacatccaggtgagctgcgtggagtgcagcaaccagcagggcagaatcgccgccagctacggcaacgccgtgtgcatcttcgagcccctgggcatcaacagccacaagagaaactgccagctgaagtgccagtggctgaagaccggccagttcttcctgagcagcgtgacctacaacctggcctgggacccccaggacaacagactgctgaccgccaccgacagcatccagctgtgggccccccccggcgacgacatcctggaggaggaggaggagatcgacaacaccgtgccccccgtgctgaacgactggaagtgcgtgtggcagtgcaagaccagcgtgagcgtgcacctgatggagtggagccccgacggcgagtacttcgccaccgccggcaaggacgactgcctgctgaaggtgtggtaccccatgaccggctggaagagcagcatcatcccccaggaccaccacgaggtgaagagaagacagagcagcacccagttcagcttcgtgtacctggcccaccccagagccgtgaccggcttcagctggagaaagaccagcaagtacatgcccagaggcagcgtgtgcaacgtgctgctgaccagctgccacgacggcgtgtgcagactgtgggccgagaccctgctgcccgaggactgcctgctgggcgagcagatctgcgagaccaccaccagcagcatcgccagcagcctgagccacgccggcagacacaaggacagaatccagcacgccctggagaccatccaccacctgaagaacctgagaaagggccagagaagaagcagcgtgctggtgacccacgccgagctgatgcccgaccagaccgccatgcacgaggtgcagagacacatcagccaccacgccaacgccctgtgccacttccacatcgccgccagcatcaaccccgccaccgacatccccaacgtgctggtgggcaccgccttcaacgtggacgacggcaacggcggcttcgtggtgcactggctgaacaacaaggagttccacttcaccagcagcaccgaggtgttcatgcaccagctgagaaagctgagcgacaagcaggtggaccacgagaacgacgacgccgacagagaggacgaggagcacagccaggaggacagagagagaggcctgcacatgaagctggaccacgacctgagcctggacagagagagcgaggccggcaccggcagcagcgagcacgaggacggcgagagagagggcagccccagaacctacagcagactgagcgtgcccatgcccctgcccaccgtgctgctggacagaaagatcgagaccctgctgaccgagtggaacaagaaccccgacatgctgttcaccatccaccccgtggacggcaccttcctggtgtggcacgtgaagtacctggacgagtacaaccccggcatcttcagacaggtgcaggtgagcttcagcagcagaatccccgtggccttccccagcggcgacgccagcagcctgagcaagaacatcatgatgtacgcctgcatcaacgccaccaaggacagccaccacaccctgctgcaccaggagggcatgagcgtgggcagcccccacggcagccagccccacagcagaagccacagcacccacatgaacatcctggcccccaccgtgatgatgatcagcaagcacatcgacggcagcctgaaccagtgggccgtgaccttcgccgacaagagcgccttcaccaccgtgctgaccgtgagccacaagttcagatactgcggccacagattccacctgaacgacctggcctgccacagcgtgctgcccctgctgctgaccagcagccaccacaacgccctgctgacccccgagctggactgccagtgggacagcgacaacaagctgagcagactgatggaccccgtgaagcacatcaagggcagcagcaagcagcccctgagaaacgccgccaccagaaccttccacgaccccaacgccatctacagcgagctgatcctgtggagagtggaccccatcggccccctgagctacaccggcggcgtgagcgagctggccagaatcaacagcctgcacaccagcgccttcagcaacgtggcctggctgcccaccctgatccccagctactgcctgggcacctactgcaacagcgccagcgcctgcttcgtggccagcgacggcaagaacctgagactgtaccaggccgtggtggacgccagaaagctgctggacgagctgagcgaccccgagagcagcaagctgatcggcgaggtgttcaacatcgtgagccagcagagcaccgccagacccggctgcatcatcgagctggacgccatcaccaaccagtgcggcagcaacacccagctgctgcacgtgttccaggaggacttcatcatcggctacaagccccacaaggaggacatggagaagaaggagaccgagatcttcttccagcccagccagggctacagacccccccccttcagcgagaagttcttcctggtggtgatcgagaaggacagcaacaacaacagcatcctgcacatgtggcacctgcacctgaagagcgtgcaggcctgcctggccaaggccagcgagggcgccagcagcgagagcctgctgagcgtgcccggccagaagaacgtggacagcagccccgagaccagccccagcgtgagccccatgccccacagcagcagcatcgccaacctgcagaccgccagcaagctgatcctgagcagcagactggtgtacagccagcccctggacctgcccgagagcgtggaggtgatcagagccacccccagcgccggccacctgagcagcagcagcatctaccccgtgtgcctggccccctacctggtggtgaccacctgcagcgacaacaaggtgagattctggaagtgctgcatggaggccaaccccgagtgcaacaagagcgacgagaaggagatctaccactggaagagatggcccctgatgaacgacgagggcgaggacaacagcagcaccgtgagcatcgtgggcagacccgtggccgtgagctgcagctacaccggcagactggccgtggcctacaagcagcccatccaccacaacggcttcgtgagcaaggagttcagcatgcacgtgtgcatcttcgagtgcgagagcaccggcggcagcgagtgggtgctggagcagaccatccacctggacgacctggtgaaggtgggcagcgtgctggacagcagagtgagcgtggacagcaacctgttcgtgtacagcaagagcgacgccctgctgagcaaggacagatacctgatccccaacatcaagcacctggtgcacctggactgggtgagcaaggaggacggcagccacatcctgaccgtgggcgtgggcgccaacatcttcatgtacggcagactgagcggcatcgtgaccgagcagaccaacagcaaggacggcgtggccgtgatcaccctgcccctgggcggcagcatcaagcagggcgtgaagagcagatgggtgctgctgagaagcatcgacctggtgagcagcgtggacggcacccccagcctgcccgtgagcctgagctgggtgagagacggcatcctggtggtgggcatggactgcgagatgcacgtgtacgcccagtggaagcacgccgtgaagttcggcgacaccgaggccgacagcagcaacgccgaggaggccgccatgcaggaccacagcaccttcaagagcaacatgctggccagaaagagcgtggtggagggcaccgccatcagcgacgacgtgttctgcagccccaccgtgatccaggacggcggcctgttcgaggccgcccacgtgctgagccccaccctgccccagtaccaccccacccagctgctggagctgatggacctgggcaaggtgagaagagccaaggccatcctgagccacctggtgaagtgcatcgccggcgaggtggccatcgtgagagaccccgacgccggcgagggcaccaagagacacctgagcagaaccatcagcgtgagcggcagcaccgccaaggagaccgtgaccgtgggcaaggacggcaccagagactacaccgagatcgacagcatcccccccctgcccctgtacgccctgctggccgccgaccaggacaccagctacagaatcagcgaggagagcaccaagatcccccagagctacgaggaccagaccgtgagccagcccgaggaccagtacagcgagctgttccagatccaggacatccccaccgacgacatcgacctggagcccgagaagagagagaacaagagcaaggtgatcaacctgagccagtacggccccgcctacttcggccaggagcacgccagagtgctgagcagccacctgatgcacagcagcctgcccggcctgaccagactggagcagatgttcctggtggccctggccgacaccgtggccaccaccagcaccgagctggacgagagcagagacaagagctgcagcggcagagacaccctggacgagtgcggcctgagatacctgctggccatgagactgcacacctgcctgctgaccagcctgccccccctgtacagagtgcagctgctgcaccagggcgtgagcacctgccacttcgcctgggccttccacagcgaggccgaggaggagctgatcaacatgatccccgccatccagagaggcgacccccagtggagcgagctgagagccatgggcatcggctggtgggtgagaaacatcaacaccctgagaagatgcatcgagaaggtggccaaggccagcttccagagaaacaacgacgccctggacgccgccctgttctacctgagcatgaagaagaaggccgtggtgtggggcctgttcagaagccagcacgacgagaagatgaccaccttcttcagccacaacttcaacgaggacagatggagaaaggccgccctgaagaacgccttcagcctgctgggcaagcagagattcgagcagagcgccgccttcttcctgctggccggcagcctgaaggacgccatcgaggtgtgcctggagaagatggaggacatccagctggccatggtgatcgccagactgtacgagagcgagttcgagaccagcagcacctacatcagcatcctgaaccagaagatcctgggctgccagaaggacggcagcggcttcagctgcaagagactgcaccccgaccccttcctgagaagcctggcctactgggtgatgaaggactacaccagagccctggacaccctgctggagcagacccccaaggaggacgacgagcaccaggtgatcatcaagagctgcaaccccgtggccttcagcttctacaactacctgagaacccaccccctgctgatcagaagaaacctggccagccccgagggcaccctggccaccctgggcctgaagaccgagaagaacttcgtggacaagatcaacctgatcgagagaaagctgttcttcaccaccgccaacgcccacttcaaggtgggctgccccgtgctggccctggaggtgctgagcaagatccccaaggtgaccaagaccagcgccctgagcgccaagaaggaccagcccgacttcatcagccacagaatggacgacgtgcccagccacagcaaggccctgagcgacggcaacggcagcagcggcatcgagtggagcaacgtgaccagcagccagtacgactggagccagcccatcgtgaaggtggacgaggagcccctgaacctggactggggcgaggaccacgacagcgccctggacgaggaggaggacgacgccgtgggcctggtgatgaagagcaccgacgccagagagaaggacaagcagagcgaccagaaggccagcgaccccaacatgctgctgaccccccaggaggaggacgaccccgagggcgacaccgaggtggacgtgatcgccgagcagctgaagttcagagcctgcctgaagatcctgatgaccgagctgagaaccctggccaccggctacgaggtggacggcggcaagctgagattccagctgtacaactggctggagaaggagatcgccgccctgcacgagatctgcaaccacgagagcgtgatcaaggagtacagcagcaagacctacagcaaggtggagagcgacctgctggaccaggaggagatggtggacaagcccgacatcggcagctacgagagacaccagatcgagagaagaagactgcaggccaagagagagcacgccgagagaagaaagagctggctgcagaagaaccaggacctgctgagagtgttcctgagctactgcagcctgcacggcgcccagggcggcggcctggccagcgtgagaatggagctgaagttcctgctgcaggagagccagcaggagaccaccgtgaagcagctgcagagccccctgcccctgcccaccaccctgcccctgctgagcgccagcatcgccagcaccaagaccgtgatcgccaaccccgtgctgtacctgaacaaccacatccacgacatcctgtacaccatcgtgcagatgaagacccccccccaccccagcatcgaggacgtgaaggtgcacaccctgcacagcctggccgccagcctgagcgccagcatctaccaggccctgtgcgacagccacagctacagccagaccgagggcaaccagttcaccggcatggcctaccagggcctgctgctgagcgacagaagaagactgagaaccgagagcatcgaggagcacgccacccccaacagcagccccgcccagtggcccggcgtgagcagcctgatcaacctgctgagcagcgcccaggacgaggaccagcccaagctgaacatcctgctgtgcgaggccgtggtggccgtgtacctgagcctgctgatccacgccctggccaccaacagcagcagcgagctgttcagactggccgcccaccccctgaacaacagaatgtgggccgccgtgttcggcggcggcgtgaagctggtggtgaagcccagaagacagagcgagaacatcagcgccccccccgtgctgagcgaggacatcgacaagcacagaagaagattcaacatgagaatgctggtgcccggcagacccgtgaaggacgccacccccccccccgtgcccgccgagagacccagctacaaggagaagttcatcccccccgagctgagcatgtgggactacttcgtggccaagcccttcctgcccctgagcgacagcggcgtgatctacgacagcgacgagagcatccacagcgacgaggaggacgacgccttcttcagcgacacccagatccaggagcaccaggaccccaacagctacagctgggccctgctgcacctgaccatggtgaagctggccctgcacaacgtgaagaacttcttccccatcgccggcctggagttcagcgagctgcccgtgaccagccccctgggcatcgccgtgatcaagaacctggagaactgggagcagatcctgcaggagaagatggaccagttcgagggccccccccccaactacatcaacacctaccccaccgacctgagcgtgggcgccggccccgccatcctgagaaacaaggccatgctggagcccgagaacacccccttcaagagcagagacagcagcgccttccccgtgaagagactgtggcacttcctggtgaagcaggaggtgctgcaggagaccttcatcagatacatcttcaccaagaagagaaagcagagcgaggtggaggccgacctgggctaccccggcggcaaggccaaggtgatccacaaggagagcgacatgatcatggccttcagcgtgaacaaggccaactgcaacgagatcgtgctggccagcacccacgacgtgcaggagctggacgtgaccagcctgctggcctgccagagctacatctggatcggcgaggagtacgacagagagagcaagagcagcgacgacgtggactacagaggcagcaccaccaccctgtaccagcccagcgccaccagctacagcgccagccaggtgcacccccccagcagcctgccctggctgggcaccggccagaccagcaccggcgccagcgtgctgatgaagagaaacctgcacaacgtgaagagaatgaccagccaccccgtgcaccagtactacctgaccggcgcccaggacggcagcgtgagaatgttcgagtggaccagaccccagcagctggtgtgcttcagacaggccggcaacgccagagtgaccagactgtacttcaacagccagggcaacaagtgcggcgtggccgacggcgagggcttcctgagcatctggcaggtgaaccagaccgccagcaaccccaagccctacatgagctggcagtgccacagcaaggccaccagcgacttcgccttcatcaccagcagcagcctggtggccaccagcggccacagcaacgacaacagaaacgtgtgcctgtgggacaccctgatcagccccggcaacagcctgatccacggcttcacctgccacgaccacggcgccaccgtgctgcagtacgcccccaagcagcagctgctgatcagcggcggcagaaagggccacgtgtgcatcttcgacatcagacagagacagctgatccacaccttccaggcccacgacagcgccatcaaggccctggccctggacccctacgaggagtacttcaccaccggcagcgccgagggcaacatcaaggtgtggagactgaccggccacggcctgatccacagcttcaagagcgagcacgccaagcagagcatcttcagaaacatcggcgccggcgtgatgcagatcgacatcatccagggcaacagactgttcagctgcggcgccgacggcaccctgaagaccagagtgctgcccaacgccttcaacatccccaacagaatcctggacatcctgtag

SEQ ID NO: 79447 - DNA, 1809 bp, Artificial Sequence
  Description of Artificial Sequence: Synthetic coding sequence
atgtgggactacttcgtggccaagcccttcctgcccctgagcgacagcggcgtgatctacgacagcgacgagagcatccacagcgacgaggaggacgacgccttcttcagcgacacccagatccaggagcaccaggaccccaacagctacagctgggccctgctgcacctgaccatggtgaagctggccctgcacaacgtgaagaacttcttccccatcgccggcctggagttcagcgagctgcccgtgaccagccccctgggcatcgccgtgatcaagaacctggagaactgggagcagatcctgcaggagaagatggaccagttcgagggccccccccccaactacatcaacacctaccccaccgacctgagcgtgggcgccggccccgccatcctgagaaacaaggccatgctggagcccgagaacacccccttcaagagcagagacagcagcgccttccccgtgaagagactgtggcacttcctggtgaagcaggaggtgctgcaggagaccttcatcagatacatcttcaccaagaagagaaagcagagcgagagcatcgaggagcacgtggagcaggtgaaccagaactgcatcgccgaggactgccacatcaaggtggaggccgacctgggctaccccggcggcaaggccaaggtgatccacaaggagagcgacatgatcatggccttcagcgtgaacaaggccaactgcaacgagatcgtgctggccagcacccacgacgtgcaggagctggacgtgaccagcctgctggcctgccagagctacatctggatcggcgaggagtacgacagagagagcaagagcagcgacgacgtggactacagaggcagcaccaccaccctgtaccagcccagcgccaccagctacagcgccagccaggtgcacccccccagcagcctgccctggctgggcaccggccagaccagcaccggcgccagcgtgctgatgaagagaaacctgcacaacgtgaagagaatgaccagccaccccgtgcaccagtactacctgaccggcgcccaggacggcagcgtgagaatgttcgagtggaccagaccccagcagctggtgtgcttcagacaggccggcaacgccagagtgaccagactgtacttcaacagccagggcaacaagtgcggcgtggccgacggcgagggcttcctgagcatctggcaggtgaaccagaccgccagcaaccccaagccctacatgagctggcagtgccacagcaaggccaccagcgacttcgccttcatcaccagcagcagcctggtggccaccagcggccacagcaacgacaacagaaacgtgtgcctgtgggacaccctgatcagccccggcaacagcctgatccacggcttcacctgccacgaccacggcgccaccgtgctgcagtacgcccccaagcagcagctgctgatcagcggcggcagaaagggccacgtgtgcatcttcgacatcagacagagacagctgatccacaccttccaggcccacgacagcgccatcaaggccctggccctggacccctacgaggagtacttcaccaccggcagcgccgagggcaacatcaaggtgtggagactgaccggccacggcctgatccacagcttcaagagcgagcacgccaagcagagcatcttcagaaacatcggcgccggcgtgatgcagatcgacatcatccagggcaacagactgttcagctgcggcgccgacggcaccctgaagaccagagtgctgcccaacgccttcaacatccccaacagaatcctggacatcctgtag

SEQ ID NO: 79448 - DNA, 7203 bp, Artificial Sequence
  Description of Artificial Sequence: Synthetic coding sequence
atgcacctgcaccaggtgctgaccggcgccgtgaaccccggcgacaactgctacagcgtgggcagcgtgggcgacgtgcccttcaccgcctacggcagcggctgcgacatcgtgatcctggccaacgacttcgagtgcgtgcagatcatccccggcgccaagcacggcaacatccaggtgagctgcgtggagtgcagcaaccagcagggcagaatcgccgccagctacggcaacgccgtgtgcatcttcgagcccctgggcatcaacagccacaagagaaactgccagctgaagtgccagtggctgaagaccggccagttcttcctgagcagcgtgacctacaacctggcctgggacccccaggacaacagactgctgaccgccaccgacagcatccagctgtgggccccccccggcgacgacatcctggaggaggaggaggagatcgacaacaccgtgccccccgtgctgaacgactggaagtgcgtgtggcagtgcaagaccagcgtgagcgtgcacctgatggagtggagccccgacggcgagtacttcgccaccgccggcaaggacgactgcctgctgaaggtgtggtaccccatgaccggctggaagagcagcatcatcccccaggaccaccacgaggtgaagagaagacagagcagcacccagttcagcttcgtgtacctggcccaccccagagccgtgaccggcttcagctggagaaagaccagcaagtacatgcccagaggcagcgtgtgcaacgtgctgctgaccagctgccacgacggcgtgtgcagactgtgggccgagaccctgctgcccgaggactgcctgctgggcgagcagatctgcgagaccaccaccagcagcatcgccagcagcctgagccacgccggcagacacaaggacagaatccagcacgccctggagaccatccaccacctgaagaacctgagaaagggccagagaagaagcagcgtgctggtgacccacgccgagctgatgcccgaccagaccgccatgcacgaggtgcagagacacatcagccaccacgccaacgccctgtgccacttccacatcgccgccagcatcaaccccgccaccgacatccccaacgtgctggtgggcaccgccttcaacgtggacgacggcaacggcggcttcgtggtgcactggctgaacaacaaggagttccacttcaccagcagcaccgaggtgttcatgcaccagctgagaaagctgagcgacaagcaggtggaccacgagaacgacgacgccgacagagaggacgaggagcacagccaggaggacagagagagaggcctgcacatgaagctggaccacgacctgagcctggacagagagagcgaggccggcaccggcagcagcgagcacgaggacggcgagagagagggcagccccagaacctacagcagactgagcgtgcccatgcccctgcccaccgtgctgctggacagaaagatcgagaccctgctgaccgagtggaacaagaaccccgacatgctgttcaccatccaccccgtggacggcaccttcctggtgtggcacgtgaagtacctggacgagtacaaccccggcatcttcagacaggtgcaggtgagcttcagcagcagaatccccgtggccttccccagcggcgacgccagcagcctgagcaagaacatcatgatgtacgcctgcatcaacgccaccaaggacagccaccacaccctgctgcaccaggagggcatgagcgtgggcagcccccacggcagccagccccacagcagaagccacagcacccacatgaacatcctggcccccaccgtgatgatgatcagcaagcacatcgacggcagcctgaaccagtgggccgtgaccttcgccgacaagagcgccttcaccaccgtgctgaccgtgagccacaagttcagatactgcggccacagattccacctgaacgacctggcctgccacagcgtgctgcccctgctgctgaccagcagccaccacaacgccctgctgacccccgagctggactgccagtgggacagcgacaacaagctgagcagactgatggaccccgtgaagcacatcaagggcagcagcaagcagcccctgagaaacgccgccaccagaaccttccacgaccccaacgccatctacagcgagctgatcctgtggagagtggaccccatcggccccctgagctacaccggcggcgtgagcgagctggccagaatcaacagcctgcacaccagcgccttcagcaacgtggcctggctgcccaccctgatccccagctactgcctgggcacctactgcaacagcgccagcgcctgcttcgtggccagcgacggcaagaacctgagactgtaccaggccgtggtggacgccagaaagctgctggacgagctgagcgaccccgagagcagcaagctgatcggcgaggtgttcaacatcgtgagccagcagagcaccgccagacccggctgcatcatcgagctggacgccatcaccaaccagtgcggcagcaacacccagctgctgcacgtgttccaggaggacttcatcatcggctacaagccccacaaggaggacatggagaagaaggagaccgagatcttcttccagcccagccagggctacagacccccccccttcagcgagaagttcttcctggtggtgatcgagaaggacagcaacaacaacagcatcctgcacatgtggcacctgcacctgaagagcgtgcaggcctgcctgggcagagacaccctggacgagtgcggcctgagatacctgctggccatgagactgcacacctgcctgctgaccagcctgccccccctgtacagagtgcagctgctgcaccagggcgtgagcacctgccacttcgcctgggccttccacagcgaggccgaggaggagctgatcaacatgatccccgccatccagagaggcgacccccagtggagcgagctgagagccatgggcatcggctggtgggtgagaaacatcaacaccctgagaagatgcatcgagaaggtggccaaggccagcttccagagaaacaacgacgccctggacgccgccctgttctacctgagcatgaagaagaaggccgtggtgtggggcctgttcagaagccagcacgacgagaagatgaccaccttcttcagccacaacttcaacgaggacagatggagaaaggccgccctgaagaacgccttcagcctgctgggcaagcagagattcgagcagagcgccgccttcttcctgctggccggcagcctgaaggacgccatcgaggtgtgcctggagaagatggaggacatccagctggccatggtgatcgccagactgtacgagagcgagttcgagaccagcagcacctacatcagcatcctgaaccagaagatcctgggctgccagaaggacggcagcggcttcagctgcaagagactgcaccccgaccccttcctgagaagcctggcctactgggtgatgaaggactacaccagagccctggacaccctgctggagcagacccccaaggaggacgacgagcaccaggtgatcatcaagagctgcaaccccgtggccttcagcttctacaactacctgagaacccaccccctgctgatcagaagaaacctggccagccccgagggcaccctggccaccctgggcctgaagaccgagaagaacttcgtggacaagatcaacctgatcgagagaaagctgttcttcaccaccgccaacgcccacttcaaggtgggctgccccgtgctggccctggaggtgctgagcaagatccccaaggtgaccaagaccagcgccctgagcgccaagaaggaccagcccgacttcatcagccacagaatggacgacgtgcccagccacagcaaggccctgagcgacggcaacggcagcagcggcatcgagtggagcaacgtgaccagcagccagtacgactggagccagcccatcgtgaaggtggacgaggagcccctgaacctggactggggcgaggaccacgacagcgccctggacgaggaggaggacgacgccgtgggcctggtgatgaagagcaccgacgccagagagaaggacaagcagagcgaccagaaggccagcgaccccaacatgctgctgaccccccaggaggaggacgaccccgagggcgacaccgaggtggacgtgatcgccgagcagctgaagttcagagcctgcctgaagatcctgatgaccgagctgagaaccctggccaccggctacgaggtggacggcggcaagctgagattccagctgtacaactggctggagaaggagatcgccgccctgcacgagatctgcaaccacgagagcgtgatcaaggagtacagcagcaagacctacagcaaggtggagagcgacctgctggaccaggaggagatggtggacaagcccgacatcggcagctacgagagacaccagatcgagagaagaagactgcaggccaagagagagcacgccgagagaagaaagagctggctgcagaagaaccaggacctgctgagagtgttcctgagctactgcagcctgcacggcgcccagggcggcggcctggccagcgtgagaatggagctgaagttcctgctgcaggagagccagcaggagaccaccgtgaagcagctgcagagccccctgcccctgcccaccaccctgcccctgctgagcgccagcatcgccagcaccaagaccgtgatcgccaaccccgtgctgtacctgaacaaccacatccacgacatcctgtacaccatcgtgcagatgaagacccccccccaccccagcatcgaggacgtgaaggtgcacaccctgcacagcctggccgccagcctgagcgccagcatctaccaggccctgtgcgacagccacagctacagccagaccgagggcaaccagttcaccggcatggcctaccagggcctgctgctgagcgacagaagaagactgagaaccgagagcatcgaggagcacgccacccccaacagcagccccgcccagtggcccggcgtgagcagcctgatcaacctgctgagcagcgcccaggacgaggaccagcccaagctgaacatcctgctgtgcgaggccgtggtggccgtgtacctgagcctgctgatccacgccctggccaccaacagcagcagcgagctgttcagactggccgcccaccccctgaacaacagaatgtgggccgccgtgttcggcggcggcgtgaagctggtggtgaagcccagaagacagagcgagaacatcagcgccccccccgtgctgagcgaggacatcgacaagcacagaagaagattcaacatgagaatgctggtgcccggcagacccgtgaaggacgccacccccccccccgtgcccgccgagagacccagctacaaggagaagttcatcccccccgagctgagcatgtgggactacttcgtggccaagcccttcctgcccctgagcgacagcggcgtgatctacgacagcgacgagagcatccacagcgacgaggaggacgacgccttcttcagcgacacccagatccaggagcaccaggaccccaacagctacagctgggccctgctgcacctgaccatggtgaagctggccctgcacaacgtgaagaacttcttccccatcgccggcctggagttcagcgagctgcccgtgaccagccccctgggcatcgccgtgatcaagaacctggagaactgggagcagatcctgcaggagaagatggaccagttcgagggccccccccccaactacatcaacacctaccccaccgacctgagcgtgggcgccggccccgccatcctgagaaacaaggccatgctggagcccgagaacacccccttcaagagcagagacagcagcgccttccccgtgaagagactgtggcacttcctggtgaagcaggaggtgctgcaggagaccttcatcagatacatcttcaccaagaagagaaagcagagcgaggtggaggccgacctgggctaccccggcggcaaggccaaggtgatccacaaggagagcgacatgatcatggccttcagcgtgaacaaggccaactgcaacgagatcgtgctggccagcacccacgacgtgcaggagctggacgtgaccagcctgctggcctgccagagctacatctggatcggcgaggagtacgacagagagagcaagagcagcgacgacgtggactacagaggcagcaccaccaccctgtaccagcccagcgccaccagctacagcgccagccaggtgcacccccccagcagcctgccctggctgggcaccggccagaccagcaccggcgccagcgtgctgatgaagagaaacctgcacaacgtgaagagaatgaccagccaccccgtgcaccagtactacctgaccggcgcccaggacggcagcgtgagaatgttcgagtggaccagaccccagcagctggtgtgcttcagacaggccggcaacgccagagtgaccagactgtacttcaacagccagggcaacaagtgcggcgtggccgacggcgagggcttcctgagcatctggcaggtgaaccagaccgccagcaaccccaagccctacatgagctggcagtgccacagcaaggccaccagcgacttcgccttcatcaccagcagcagcctggtggccaccagcggccacagcaacgacaacagaaacgtgtgcctgtgggacaccctgatcagccccggcaacagcctgatccacggcttcacctgccacgaccacggcgccaccgtgctgcagtacgcccccaagcagcagctgctgatcagcggcggcagaaagggccacgtgtgcatcttcgacatcagacagagacagctgatccacaccttccaggcccacgacagcgccatcaaggccctggccctggacccctacgaggagtacttcaccaccggcagcgccgagggcaacatcaaggtgtggagactgaccggccacggcctgatccacagcttcaagagcgagcacgccaagcagagcatcttcagaaacatcggcgccggcgtgatgcagatcgacatcatccagggcaacagactgttcagctgcggcgccgacggcaccctgaagaccagagtgctgcccaacgccttcaacatccccaacagaatcctggacatcctgtag

SEQ ID NO: 79449 - DNA, 9114 bp, Artificial Sequence
  Description of Artificial Sequence: Synthetic coding sequence
atgcacctgcaccaggtgctgaccggcgccgtgaaccccggcgacaactgctacagcgtgggcagcgtgggcgacgtgcccttcaccgcctacggcagcggctgcgacatcgtgatcctggccaacgacttcgagtgcgtgcagatcatccccggcgccaagcacggcaacatccaggtgagctgcgtggagtgcagcaaccagcagggcagaatcgccgccagctacggcaacgccgtgtgcatcttcgagcccctgggcatcaacagccacaagagaaactgccagctgaagtgccagtggctgaagaccggccagttcttcctgagcagcgtgacctacaacctggcctgggacccccaggacaacagactgctgaccgccaccgacagcatccagctgtgggccccccccggcgacgacatcctggaggaggaggaggagatcgacaacaccgtgccccccgtgctgaacgactggaagtgcgtgtggcagtgcaagaccagcgtgagcgtgcacctgatggagtggagccccgacggcgagtacttcgccaccgccggcaaggacgactgcctgctgaaggtgtggtaccccatgaccggctggaagagcagcatcatcccccaggaccaccacgaggtgaagagaagacagagcagcacccagttcagcttcgtgtacctggcccaccccagagccgtgaccggcttcagctggagaaagaccagcaagtacatgcccagaggcagcgtgtgcaacgtgctgctgaccagctgccacgacggcgtgtgcagactgtgggccgagaccctgctgcccgaggactgcctgctgggcgagcagatctgcgagaccaccaccagcagcatcgccagcagcctgagccacgccggcagacacaaggacagaatccagcacgccctggagaccatccaccacctgaagaacctgagaaagggccagagaagaagcagcgtgctggtgacccacgccgagctgatgcccgaccagaccgccatgcacgaggtgcagagacacatcagccaccacgccaacgccctgtgccacttccacatcgccgccagcatcaaccccgccaccgacatccccaacgtgctggtgggcaccgccttcaacgtggacgacggcaacggcggcttcgtggtgcactggctgaacaacaaggagttccacttcaccagcagcaccgaggtgttcatgcaccagctgagaaagctgagcgacaagcaggtggaccacgagaacgacgacgccgacagagaggacgaggagcacagccaggaggacagagagagaggcctgcacatgaagctggaccacgacctgagcctggacagagagagcgaggccggcaccggcagcagcgagcacgaggacggcgagagagagggcagccccagaacctacagcagactgagcgtgcccatgcccctgcccaccgtgctgctggacagaaagatcgagaccctgctgaccgagtggaacaagaaccccgacatgctgttcaccatccaccccgtggacggcaccttcctggtgtggcacgtgaagtacctggacgagtacaaccccggcatcttcagacaggtgcaggtgagcttcagcagcagaatccccgtggccttccccagcggcgacgccagcagcctgagcaagaacatcatgatgtacgcctgcatcaacgccaccaaggacagccaccacaccctgctgcaccaggagggcatgagcgtgggcagcccccacggcagccagccccacagcagaagccacagcacccacatgaacatcctggcccccaccgtgatgatgatcagcaagcacatcgacggcagcctgaaccagtgggccgtgaccttcgccgacaagagcgccttcaccaccgtgctgaccgtgagccacaagttcagatactgcggccacagattccacctgaacgacctggcctgccacagcgtgctgcccctgctgctgaccagcagccaccacaacgccctgctgacccccgagctggactgccagtgggacagcgacaacaagctgagcagactgatggaccccgtgaagcacatcaagggcagcagcaagcagcccctgagaaacgccgccaccagaaccttccacgaccccaacgccatctacagcgagctgatcctgtggagagtggaccccatcggccccctgagctacaccggcggcgtgagcgagctggccagaatcaacagcctgcacaccagcgccttcagcaacgtggcctggctgcccaccctgatccccagctactgcctgggcacctactgcaacagcgccagcgcctgcttcgtggccagcgacggcaagaacctgagactgtaccaggccgtggtggacgccagaaagctgctggacgagctgagcgaccccgagagcagcaagctgatcggcgaggtgttcaacatcgtgagccagcagagcaccgccagacccggctgcatcatcgagctggacgccatcaccaaccagtgcggcagcaacacccagctgctgcacgtgttccaggaggacttcatcatcggctacaagccccacaaggaggacatggagaagaaggagaccgagatcttcttccagcccagccagggctacagacccccccccttcagcgagaagttcttcctggtggtgatcgagaaggacagcaacaacaacagcatcctgcacatgtggcacctgcacctgaagagcgtgcaggcctgcctggccaaggccagcgagggcgccagcagcgagagcctgctgagcgtgcccggccagaagaacgtggacagcagccccgagaccagccccagcgtgagccccatgccccacagcagcagcatcgccaacctgcagaccgccagcaagctgatcctgagcagcagactggtgtacagccagcccctggacctgcccgagagcgtggaggtgatcagagccacccccagcgccggccacctgagcagcagcagcatctaccccgtgtgcctggccccctacctggtggtgaccacctgcagcgacaacaaggtgagattctggaagtgctgcatggaggccaaccccgagtgcaacaagagcgacgagaaggagatctaccactggaagagatggcccctgatgaacgacgagggcgaggacaacagcagcaccgtgagcatcgtgggcagacccgtggccgtgagctgcagctacaccggcagactggccgtggcctacaagcagcccatccaccacaacggcttcgtgagcaaggagttcagcatgcacgtgtgcatcttcgagtgcgagagcaccggcggcagcgagtgggtgctggagcagaccatccacctggacgacctggtgaaggtgggcagcgtgctggacagcagagtgagcgtggacagcaacctgttcgtgtacagcaagagcgacgccctgctgagcaaggacagatacctgatccccaacatcaagcacctggtgcacctggactgggtgagcaaggaggacggcagccacatcctgaccgtgggcgtgggcgccaacatcttcatgtacggcagactgagcggcatcgtgaccgagcagaccaacagcaaggacggcgtggccgtgatcaccctgcccctgggcggcagcatcaagcagggcgtgaagagcagatgggtgctgctgagaagcatcgacctggtgagcagcgtggacggcacccccagcctgcccgtgagcctgagctgggtgagagacggcatcctggtggtgggcatggactgcgagatgcacgtgtacgcccagtggaagcacgccgtgaagttcggcgacaccgaggccgacagcagcaacgccgaggaggccgccatgcaggaccacagcaccttcaagagcaacatgctggccagaaagagcgtggtggagggcaccgccatcagcgacgacgtgttctgcagccccaccgtgatccaggacggcggcctgttcgaggccgcccacgtgctgagccccaccctgccccagtaccaccccacccagctgctggagctgatggacctgggcaaggtgagaagagccaaggccatcctgagccacctggtgaagtgcatcgccggcgaggtggccatcgtgagagaccccgacgccggcgagggcaccaagagacacctgagcagaaccatcagcgtgagcggcagcaccgccaaggagaccgtgaccgtgggcaaggacggcaccagagactacaccgagatcgacagcatcccccccctgcccctgtacgccctgctggccgccgaccaggacaccagctacagaatcagcgaggagagcaccaagatcccccagagctacgaggaccagaccgtgagccagcccgaggaccagtacagcgagctgttccagatccaggacatccccaccgacgacatcgacctggagcccgagaagagagagaacaagagcaaggtgatcaacctgagccagtacggccccgcctacttcggccaggagcacgccagagtgctgagcagccacctgatgcacagcagcctgcccggcctgaccagactggagcagatgttcctggtggccctggccgacaccgtggccaccaccagcaccgagctggacgagagcagagacaagagctgcagcggcagagacaccctggacgagtgcggcctgagatacctgctggccatgagactgcacacctgcctgctgaccagcctgccccccctgtacagagtgcagctgctgcaccagggcgtgagcacctgccacttcgcctgggccttccacagcgaggccgaggaggagctgatcaacatgatccccgccatccagagaggcgacccccagtggagcgagctgagagccatgggcatcggctggtgggtgagaaacatcaacaccctgagaagatgcatcgagaaggtggccaaggccagcttccagagaaacaacgacgccctggacgccgccctgttctacctgagcatgaagaagaaggccgtggtgtggggcctgttcagaagccagcacgacgagaagatgaccaccttcttcagccacaacttcaacgaggacagatggagaaaggccgccctgaagaacgccttcagcctgctgggcaagcagagattcgagcagagcgccgccttcttcctgctggccggcagcctgaaggacgccatcgaggtgtgcctggagaagatggaggacatccagctggccatggtgatcgccagactgtacgagagcgagttcgagaccagcagcacctacatcagcatcctgaaccagaagatcctgggctgccagaaggacggcagcggcttcagctgcaagagactgcaccccgaccccttcctgagaagcctggcctactgggtgatgaaggactacaccagagccctggacaccctgctggagcagacccccaaggaggacgacgagcaccaggtgatcatcaagagctgcaaccccgtggccttcagcttctacaactacctgagaacccaccccctgctgatcagaagaaacctggccagccccgagggcaccctggccaccctgggcctgaagaccgagaagaacttcgtggacaagatcaacctgatcgagagaaagctgttcttcaccaccgccaacgcccacttcaaggtgggctgccccgtgctggccctggaggtgctgagcaagatccccaaggtgaccaagaccagcgccctgagcgccaagaaggaccagcccgacttcatcagccacagaatggacgacgtgcccagccacagcaaggccctgagcgacggcaacggcagcagcggcatcgagtggagcaacgtgaccagcagccagtacgactggagccagcccatcgtgaaggtggacgaggagcccctgaacctggactggggcgaggaccacgacagcgccctggacgaggaggaggacgacgccgtgggcctggtgatgaagagcaccgacgccagagagaaggacaagcagagcgaccagaaggccagcgaccccaacatgctgctgaccccccaggaggaggacgaccccgagggcgacaccgaggtggacgtgatcgccgagcagctgaagttcagagcctgcctgaagatcctgatgaccgagctgagaaccctggccaccggctacgaggtggacggcggcaagctgagattccagctgtacaactggctggagaaggagatcgccgccctgcacgagatctgcaaccacgagagcgtgatcaaggagtacagcagcaagacctacagcaaggtggagagcgacctgctggaccaggaggagatggtggacaagcccgacatcggcagctacgagagacaccagatcgagagaagaagactgcaggccaagagagagcacgccgagagaagaaagagctggctgcagaagaaccaggacctgctgagagtgttcctgagctactgcagcctgcacggcgcccagggcggcggcctggccagcgtgagaatggagctgaagttcctgctgcaggagagccagcaggagaccaccgtgaagcagctgcagagccccctgcccctgcccaccaccctgcccctgctgagcgccagcatcgccagcaccaagaccgtgatcgccaaccccgtgctgtacctgaacaaccacatccacgacatcctgtacaccatcgtgcagatgaagacccccccccaccccagcatcgaggacgtgaaggtgcacaccctgcacagcctggccgccagcctgagcgccagcatctaccaggccctgtgcgacagccacagctacagcagccagaccgagggcaaccagttcaccggcatggcctaccagggcctgctgctgagcgacagaagaagactgagaaccgagagcatcgaggagcacgccacccccaacagcagccccgcccagtggcccggcgtgagcagcctgatcaacctgctgagcagcgcccaggacgaggaccagcccaagctgaacatcctgctgtgcgaggccgtggtggccgtgtacctgagcctgctgatccacgccctggccaccaacagcagcagcgagctgttcagactggccgcccaccccctgaacaacagaatgtgggccgccgtgttcggcggcggcgtgaagctggtggtgaagcccagaagacagagcgagaacatcagcgccccccccgtgctgagcgaggacatcgacaagcacagaagaagattcaacatgagaatgctggtgcccggcagacccgtgaaggacgccacccccccccccgtgcccgccgagagacccagctacaaggagaagttcatcccccccgagctgagcatgtgggactacttcgtggccaagcccttcctgcccctgagcgacagcggcgtgatctacgacagcgacgagagcatccacagcgacgaggaggacgacgccttcttcagcgacacccagatccaggagcaccaggaccccaacagctacagctgggccctgctgcacctgaccatggtgaagctggccctgcacaacgtgaagaacttcttccccatcgccggcctggagttcagcgagctgcccgtgaccagccccctgggcatcgccgtgatcaagaacctggagaactgggagcagatcctgcaggagaagatggaccagttcgagggccccccccccaactacatcaacacctaccccaccgacctgagcgtgggcgccggccccgccatcctgagaaacaaggccatgctggagcccgagaacacccccttcaagagcagagacagcagcgccttccccgtgaagagactgtggcacttcctggtgaagcaggaggtgctgcaggagaccttcatcagatacatcttcaccaagaagagaaagcagagcgaggtggaggccgacctgggctaccccggcggcaaggccaaggtgatccacaaggagagcgacatgatcatggccttcagcgtgaacaaggccaactgcaacgagatcgtgctggccagcacccacgacgtgcaggagctggacgtgaccagcctgctggcctgccagagctacatctggatcggcgaggagtacgacagagagagcaagagcagcgacgacgtggactacagaggcagcaccaccaccctgtaccagcccagcgccaccagctacagcgccagccaggtgcacccccccagcagcctgccctggctgggcaccggccagaccagcaccggcgccagcgtgctgatgaagagaaacctgcacaacgtgaagagaatgaccagccaccccgtgcaccagtactacctgaccggcgcccaggacggcagcgtgagaatgttcgagtggaccagaccccagcagctggtgtgcttcagacaggccggcaacgccagagtgaccagactgtacttcaacagccagggcaacaagtgcggcgtggccgacggcgagggcttcctgagcatctggcaggtgaaccagaccgccagcaaccccaagccctacatgagctggcagtgccacagcaaggccaccagcgacttcgccttcatcaccagcagcagcctggtggccaccagcggccacagcaacgacaacagaaacgtgtgcctgtgggacaccctgatcagccccggcaacagcctgatccacggcttcacctgccacgaccacggcgccaccgtgctgcagtacgcccccaagcagcagctgctgatcagcggcggcagaaagggccacgtgtgcatcttcgacatcagacagagacagctgatccacaccttccaggcccacgacagcgccatcaaggccctggccctggacccctacgaggagtacttcaccaccggcagcgccgagggcaacatcaaggtgtggagactgaccggccacggcctgatccacagcttcaagagcgagcacgccaagcagagcatcttcagaaacatcggcgccggcgtgatgcagatcgacatcatccagggcaacagactgttcagctgcggcgccgacggcaccctgaagaccagagtgctgcccaacgccttcaacatccccaacagaatcctggacatcctgtag

SEQ ID NO: 79450 - DNA, 4851 bp, Artificial Sequence
  Description of Artificial Sequence: Synthetic coding sequence
atgcccgccagaaccgcccccgccagagtgcccaccctggccgtgcccgccatcagcctgcccgacgacgtgagaagaagactgaaggacctggagagagacagcctgaccgagaaggagtgcgtgaaggagaagctgaacctgctgcacgagttcctgcagaccgagatcaagaaccagctgtgcgacctggagaccaagctgagaaaggaggagctgagcgaggagggctacctggccaaggtgaagagcctgctgaacaaggacctgagcctggagaacggcgcccacgcctacaacagagaggtgaacggcagactggagaacggcaaccaggccagaagcgaggccagaagagtgggcatggccgacgccaacagcccccccaagcccctgagcaagcccagaacccccagaagaagcaagagcgacggcgaggccaagcccgagcccagccccagccccagaatcaccagaaagagcaccagacagaccaccatcaccagccacttcgccaagggccccgccaagagaaagccccaggaggagagcgagagagccaagagcgacgagagcatcaaggaggaggacaaggaccaggacgagaagagaagaagagtgaccagcagagagagagtggccagacccctgcccgccgaggagcccgagagagccaagagcggcaccagaaccgagaaggaggaggagagagacgagaaggaggagaagagactgagaagccagaccaaggagcccacccccaagcagaagctgaaggaggagcccgacagagaggccagagccggcgtgcaggccgacgaggacgaggacggcgacgagaaggacgagaagaagcacagaagccagcccaaggacctggccgccaagagaagacccgaggagaaggagcccgagaaggtgaacccccagatcagcgacgagaaggacgaggacgagaaggaggagaagagaagaaagaccacccccaaggagcccaccgagaagaagatggccagagccaagaccgtgatgaacagcaagacccacccccccaagtgcatccagtgcggccagtacctggacgaccccgacctgaagtacggccagcacccccccgacgccgtggacgagccccagatgctgaccaacgagaagctgagcatcttcgacgccaacgagagcggcttcgagagctacgaggccctgccccagcacaagctgacctgcttcagcgtgtactgcaagcacggccacctgtgccccatcgacaccggcctgatcgagaagaacatcgagctgttcttcagcggcagcgccaagcccatctacgacgacgaccccagcctggagggcggcgtgaacggcaagaacctgggccccatcaacgagtggtggatcaccggcttcgacggcggcgagaaggccctgatcggcttcagcaccagcttcgccgagtacatcctgatggaccccagccccgagtacgcccccatcttcggcctgatgcaggagaagatctacatcagcaagatcgtggtggagttcctgcagagcaacagcgacagcacctacgaggacctgatcaacaagatcgagaccaccgtgccccccagcggcctgaacctgaacagattcaccgaggacagcctgctgagacacgcccagttcgtggtggagcaggtggagagctacgacgaggccggcgacagcgacgagcagcccatcttcctgaccccctgcatgagagacctgatcaagctggccggcgtgaccctgggccagagaagagcccaggccagaagacagaccatcagacacagcaccagagagaaggacagaggccccaccaaggccaccaccaccaagctggtgtaccagatcttcgacaccttcttcgccgagcagatcgagaaggacgacagagaggacaaggagaacgccttcaagagaagaagatgcggcgtgtgcgaggtgtgccagcagcccgagtgcggcaagtgcaaggcctgcaaggacatggtgaagttcggcggcagcggcagaagcaagcaggcctgccaggagagaagatgccccaacatggccatgaaggaggccgacgacgacgaggaggtggacgacaacatccccgagatgcccagccccaagaagatgcaccagggcaagaagaagaagcagaacaagaacagaatcagctgggtgggcgaggccgtgaagaccgacggcaagaagagctactacaagaaggtgtgcatcgacgccgagaccctggaggtgggcgactgcgtgagcgtgatccccgacgacagcagcaagcccctgtacctggccagagtgaccgccctgtgggaggacagcagcaacggccagatgttccacgcccactggttctgcgccggcaccgacaccgtgctgggcgccaccagcgaccccctggagctgttcctggtggacgagtgcgaggacatgcagctgagctacatccacagcaaggtgaaggtgatctacaaggcccccagcgagaactgggccatggagggcggcatggaccccgagagcctgctggagggcgacgacggcaagacctacttctaccagctgtggtacgaccaggactacgccagattcgagagcccccccaagacccagcccaccgaggacaacaagttcaagttctgcgtgagctgcgccagactggccgagatgagacagaaggagatccccagagtgctggagcagctggaggacctggacagcagagtgctgtactacagcgccaccaagaacggcatcctgtacagagtgggcgacggcgtgtacctgccccccgaggccttcaccttcaacatcaagctgagcagccccgtgaagagacccagaaaggagcccgtggacgaggacctgtaccccgagcactacagaaagtacagcgactacatcaagggcagcaacctggacgcccccgagccctacagaatcggcagaatcaaggagatcttctgccccaagaagagcaacggcagacccaacgagaccgacatcaagatcagagtgaacaagttctacagacccgagaacacccacaagagcacccccgccagctaccacgccgacatcaacctgctgtactggagcgacgaggaggccgtggtggacttcaaggccgtgcagggcagatgcaccgtggagtacggcgaggacctgcccgagtgcgtgcaggtgtacagcatgggcggccccaacagattctacttcctggaggcctacaacgccaagagcaagagcttcgaggacccccccaaccacgccagaagccccggcaacaagggcaagggcaagggcaagggcaagggcaagcccaagagccaggcctgcgagcccagcgagcccgagatcgagatcaagctgcccaagctgagaaccctggacgtgttcagcggctgcggcggcctgagcgagggcttccaccaggccggcatcagcgacaccctgtgggccatcgagatgtgggaccccgccgcccaggccttcagactgaacaaccccggcagcaccgtgttcaccgaggactgcaacatcctgctgaagctggtgatggccggcgagaccaccaacagcagaggccagagactgccccagaagggcgacgtggagatgctgtgcggcggccccccctgccagggcttcagcggcatgaacagattcaacagcagaacctacagcaagttcaagaacagcctggtggtgagcttcctgagctactgcgactactacagacccagattcttcctgctggagaacgtgagaaacttcgtgagcttcaagagaagcatggtgctgaagctgaccctgagatgcctggtgagaatgggctaccagtgcaccttcggcgtgctgcaggccggccagtacggcgtggcccagaccagaagaagagccatcatcctggccgccgcccccggcgagaagctgcccctgttccccgagcccctgcacgtgttcgcccccagagcctgccagctgagcgtggtggtggacgacaagaagttcgtgagcaacatcaccagactgagcagcggccccttcagaaccatcaccgtgagagacaccatgagcgacctgcccgaggtgagaaacggcgccagcgccctggagatcagctacaacggcgagccccagagctggttccagagacagctgagaggcgcccagtaccagcccatcctgagagaccacatctgcaaggacatgagcgccctggtggccgccagaatgagacacatccccctggcccccggcagcgactggagagacctgcccaacatcgaggtgagactgagcgacggcaccatggccagaaagctgagatacacccaccacgacagaaagaacggcagaagcagcagcggcgccctgagaggcgtgtgcagctgcgtggaggccggcaaggcctgcgaccccgccgccagacagttcaacaccctgatcccctggtgcctgccccacaccggcaacagacacaaccactgggccggcctgtacggcagactggagtgggacggcttcttcagcaccaccgtgaccaaccccgagcccatgggcaagcagggcagagtgctgcaccccgagcagcacagagtggtgagcgtgagagagtgcgccagaagccagggcttccccgacacctacagactgttcggcaacatcctggacaagcacagacaggtgggcaacgccgtgcccccccccctggccaaggccatcggcctggagatcaagctgtgcatgctggccaaggccagagagagcgccagcgccaagatcaaggaggaggaggccgccaaggactag

SEQ ID NO: 79451 - DNA, 4899 bp, Artificial Sequence
  Description of Artificial Sequence: Synthetic coding sequence
atgcccgccagaaccgcccccgccagagtgcccaccctggccgtgcccgccatcagcctgcccgacgacgtgagaagaagactgaaggacctggagagagacagcctgaccgagaaggagtgcgtgaaggagaagctgaacctgctgcacgagttcctgcagaccgagatcaagaaccagctgtgcgacctggagaccaagctgagaaaggaggagctgagcgaggagggctacctggccaaggtgaagagcctgctgaacaaggacctgagcctggagaacggcgcccacgcctacaacagagaggtgaacggcagactggagaacggcaaccaggccagaagcgaggccagaagagtgggcatggccgacgccaacagcccccccaagcccctgagcaagcccagaacccccagaagaagcaagagcgacggcgaggccaagagaagcagagacccccccgccagcgccagccaggtgaccggcatcagagccgagcccagccccagccccagaatcaccagaaagagcaccagacagaccaccatcaccagccacttcgccaagggccccgccaagagaaagccccaggaggagagcgagagagccaagagcgacgagagcatcaaggaggaggacaaggaccaggacgagaagagaagaagagtgaccagcagagagagagtggccagacccctgcccgccgaggagcccgagagagccaagagcggcaccagaaccgagaaggaggaggagagagacgagaaggaggagaagagactgagaagccagaccaaggagcccacccccaagcagaagctgaaggaggagcccgacagagaggccagagccggcgtgcaggccgacgaggacgaggacggcgacgagaaggacgagaagaagcacagaagccagcccaaggacctggccgccaagagaagacccgaggagaaggagcccgagaaggtgaacccccagatcagcgacgagaaggacgaggacgagaaggaggagaagagaagaaagaccacccccaaggagcccaccgagaagaagatggccagagccaagaccgtgatgaacagcaagacccacccccccaagtgcatccagtgcggccagtacctggacgaccccgacctgaagtacggccagcacccccccgacgccgtggacgagccccagatgctgaccaacgagaagctgagcatcttcgacgccaacgagagcggcttcgagagctacgaggccctgccccagcacaagctgacctgcttcagcgtgtactgcaagcacggccacctgtgccccatcgacaccggcctgatcgagaagaacatcgagctgttcttcagcggcagcgccaagcccatctacgacgacgaccccagcctggagggcggcgtgaacggcaagaacctgggccccatcaacgagtggtggatcaccggcttcgacggcggcgagaaggccctgatcggcttcagcaccagcttcgccgagtacatcctgatggaccccagccccgagtacgcccccatcttcggcctgatgcaggagaagatctacatcagcaagatcgtggtggagttcctgcagagcaacagcgacagcacctacgaggacctgatcaacaagatcgagaccaccgtgccccccagcggcctgaacctgaacagattcaccgaggacagcctgctgagacacgcccagttcgtggtggagcaggtggagagctacgacgaggccggcgacagcgacgagcagcccatcttcctgaccccctgcatgagagacctgatcaagctggccggcgtgaccctgggccagagaagagcccaggccagaagacagaccatcagacacagcaccagagagaaggacagaggccccaccaaggccaccaccaccaagctggtgtaccagatcttcgacaccttcttcgccgagcagatcgagaaggacgacagagaggacaaggagaacgccttcaagagaagaagatgcggcgtgtgcgaggtgtgccagcagcccgagtgcggcaagtgcaaggcctgcaaggacatggtgaagttcggcggcagcggcagaagcaagcaggcctgccaggagagaagatgccccaacatggccatgaaggaggccgacgacgacgaggaggtggacgacaacatccccgagatgcccagccccaagaagatgcaccagggcaagaagaagaagcagaacaagaacagaatcagctgggtgggcgaggccgtgaagaccgacggcaagaagagctactacaagaaggtgtgcatcgacgccgagaccctggaggtgggcgactgcgtgagcgtgatccccgacgacagcagcaagcccctgtacctggccagagtgaccgccctgtgggaggacagcagcaacggccagatgttccacgcccactggttctgcgccggcaccgacaccgtgctgggcgccaccagcgaccccctggagctgttcctggtggacgagtgcgaggacatgcagctgagctacatccacagcaaggtgaaggtgatctacaaggcccccagcgagaactgggccatggagggcggcatggaccccgagagcctgctggagggcgacgacggcaagacctacttctaccagctgtggtacgaccaggactacgccagattcgagagcccccccaagacccagcccaccgaggacaacaagttcaagttctgcgtgagctgcgccagactggccgagatgagacagaaggagatccccagagtgctggagcagctggaggacctggacagcagagtgctgtactacagcgccaccaagaacggcatcctgtacagagtgggcgacggcgtgtacctgccccccgaggccttcaccttcaacatcaagctgagcagccccgtgaagagacccagaaaggagcccgtggacgaggacctgtaccccgagcactacagaaagtacagcgactacatcaagggcagcaacctggacgcccccgagccctacagaatcggcagaatcaaggagatcttctgccccaagaagagcaacggcagacccaacgagaccgacatcaagatcagagtgaacaagttctacagacccgagaacacccacaagagcacccccgccagctaccacgccgacatcaacctgctgtactggagcgacgaggaggccgtggtggacttcaaggccgtgcagggcagatgcaccgtggagtacggcgaggacctgcccgagtgcgtgcaggtgtacagcatgggcggccccaacagattctacttcctggaggcctacaacgccaagagcaagagcttcgaggacccccccaaccacgccagaagccccggcaacaagggcaagggcaagggcaagggcaagggcaagcccaagagccaggcctgcgagcccagcgagcccgagatcgagatcaagctgcccaagctgagaaccctggacgtgttcagcggctgcggcggcctgagcgagggcttccaccaggccggcatcagcgacaccctgtgggccatcgagatgtgggaccccgccgcccaggccttcagactgaacaaccccggcagcaccgtgttcaccgaggactgcaacatcctgctgaagctggtgatggccggcgagaccaccaacagcagaggccagagactgccccagaagggcgacgtggagatgctgtgcggcggccccccctgccagggcttcagcggcatgaacagattcaacagcagaacctacagcaagttcaagaacagcctggtggtgagcttcctgagctactgcgactactacagacccagattcttcctgctggagaacgtgagaaacttcgtgagcttcaagagaagcatggtgctgaagctgaccctgagatgcctggtgagaatgggctaccagtgcaccttcggcgtgctgcaggccggccagtacggcgtggcccagaccagaagaagagccatcatcctggccgccgcccccggcgagaagctgcccctgttccccgagcccctgcacgtgttcgcccccagagcctgccagctgagcgtggtggtggacgacaagaagttcgtgagcaacatcaccagactgagcagcggccccttcagaaccatcaccgtgagagacaccatgagcgacctgcccgaggtgagaaacggcgccagcgccctggagatcagctacaacggcgagccccagagctggttccagagacagctgagaggcgcccagtaccagcccatcctgagagaccacatctgcaaggacatgagcgccctggtggccgccagaatgagacacatccccctggcccccggcagcgactggagagacctgcccaacatcgaggtgagactgagcgacggcaccatggccagaaagctgagatacacccaccacgacagaaagaacggcagaagcagcagcggcgccctgagaggcgtgtgcagctgcgtggaggccggcaaggcctgcgaccccgccgccagacagttcaacaccctgatcccctggtgcctgccccacaccggcaacagacacaaccactgggccggcctgtacggcagactggagtgggacggcttcttcagcaccaccgtgaccaaccccgagcccatgggcaagcagggcagagtgctgcaccccgagcagcacagagtggtgagcgtgagagagtgcgccagaagccagggcttccccgacacctacagactgttcggcaacatcctggacaagcacagacaggtgggcaacgccgtgcccccccccctggccaaggccatcggcctggagatcaagctgtgcatgctggccaaggccagagagagcgccagcgccaagatcaaggaggaggaggccgccaaggactag

SEQ ID NO: 79452 - DNA, 4860 bp, Artificial Sequence
  Description of Artificial Sequence: Synthetic coding sequence
atgcccgccagaaccgcccccgccagagtgcccaccctggccgtgcccgccatcagcctgcccgacgacgtgagaagaagactgaaggacctggagagagacagcctgaccgagaaggagtgcgtgaaggagaagctgaacctgctgcacgagttcctgcagaccgagatcaagaaccagctgtgcgacctggagaccaagctgagaaaggaggagctgagcgaggagggctacctggccaaggtgaagagcctgctgaacaaggacctgagcctggagaacggcgcccacgcctacaacagagaggtgaacggcagactggagaacggcaaccaggccagaagcgaggccagaagagtgggcatggccgacgccaacagcccccccaagcccctgagcaagcccagaacccccagaagaagcaagagcgacggcgaggccaagcccgagcccagccccagccccagaatcaccagaaagagcaccagacagaccaccatcaccagccacttcgccaagggccccgccaagagaaagccccaggaggagagcgagagagccaagagcgacgagagcatcaaggaggaggacaaggaccaggacgagaagagaagaagagtgaccagcagagagagagtggccagacccctgcccgccgaggagcccgagagagccaagagcggcaccagaaccgagaaggaggaggagagagacgagaaggaggagaagagactgagaagccagaccaaggagcccacccccaagcagaagctgaaggaggagcccgacagagaggccagagccggcgtgcaggccgacgaggacgaggacggcgacgagaaggacgagaagaagcacagaagccagcccaaggacctggccgccaagagaagacccgaggagaaggagcccgagaaggtgaacccccagatcagcgacgagaaggacgaggacgagaaggaggagaagagaagaaagaccacccccaaggagcccaccgagaagaagatggccagagccaagaccgtgatgaacagcaagacccacccccccaagtgcatccagtgcggccagtacctggacgaccccgacctgaagtacggccagcacccccccgacgccgtggacgagccccagatgctgaccaacgagaagctgagcatcttcgacgccaacgagagcggcttcgagagctacgaggccctgccccagcacaagctgacctgcttcagcgtgtactgcaagcacggccacctgtgccccatcgacaccggcctgatcgagaagaacatcgagctgttcttcagcggcagcgccaagcccatctacgacgacgaccccagcctggagggcggcgtgaacggcaagaacctgggccccatcaacgagtggtggatcaccggcttcgacggcggcgagaaggccctgatcggcttcagcaccagcttcgccgagtacatcctgatggaccccagccccgagtacgcccccatcttcggcctgatgcaggagaagatctacatcagcaagatcgtggtggagttcctgcagagcaacagcgacagcacctacgaggacctgatcaacaagatcgagaccaccgtgccccccagcggcctgaacctgaacagattcaccgaggacagcctgctgagacacgcccagttcgtggtggagcaggtggagagctacgacgaggccggcgacagcgacgagcagcccatcttcctgaccccctgcatgagagacctgatcaagctggccggcgtgaccctgggccagagaagagcccaggccagaagacagaccatcagacacagcaccagagagaaggacagaggccccaccaaggccaccaccaccaagctggtgtaccagatcttcgacaccttcttcgccgagcagatcgagaaggacgacagagaggacaaggagaacgccttcaagagaagaagatgcggcgtgtgcgaggtgtgccagcagcccgagtgcggcaagtgcaaggcctgcaaggacatggtgaagttcggcggcagcggcagaagcaagcaggcctgccaggagagaagatgccccaacatggccatgaaggaggccgacgacgacgaggaggtggacgacaacatccccgagatgcccagccccaagaagatgcaccagggcaagaagaagaagcagaacaagaacagaatcagctgggtgggcgaggccgtgaagaccgacggcaagaagagctactacaagaaggtgtgcatcgacgccgagaccctggaggtgggcgactgcgtgagcgtgatccccgacgacagcagcaagcccctgtacctggccagagtgaccgccctgtgggaggacagcagcaacggccagatgttccacgcccactggttctgcgccggcaccgacaccgtgctgggcgccaccagcgaccccctggagctgttcctggtggacgagtgcgaggacatgcagctgagctacatccacagcaaggtgaaggtgatctacaaggcccccagcgagaactgggccatggagggcggcatggaccccgagagcctgctggagggcgacgacggcaagacctacttctaccagctgtggtacgaccaggactacgccagattcgagagcccccccaagacccagcccaccgaggacaacaagttcaagttctgcgtgagctgcgccagactggccgagatgagacagaaggagatccccagagtgctggagcagctggaggacctggacagcagagtgctgtactacagcgccaccaagaacggcatcctgtacagagtgggcgacggcgtgtacctgccccccgaggccttcaccttcaacatcaagctgagcagccccgtgaagagacccagaaaggagcccgtggacgaggacctgtaccccgagcactacagaaagtacagcgactacatcaagggcagcaacctggacgcccccgagccctacagaatcggcagaatcaaggagatcttctgccccaagaagagcaacggcagacccaacgagaccgacatcaagatcagagtgaacaagttctacagacccgagaacacccacaagagcacccccgccagctaccacgccgacatcaacctgctgtactggagcgacgaggaggccgtggtggacttcaaggccgtgcagggcagatgcaccgtggagtacggcgaggacctgcccgagtgcgtgcaggtgtacagcatgggcggccccaacagattctacttcctggaggcctacaacgccaagagcaagagcttcgaggacccccccaaccacgccagaagccccggcaacaagggcaagggcaagggcaagggcaagggcaagcccaagagccaggcctgcgagcccagcgagcccgagatcgagatcaagctgcccaagctgagaaccctggacgtgttcagcggctgcggcggcctgagcgagggcttccaccaggccggcatcagcgacaccctgtgggccatcgagatgtgggaccccgccgcccaggccttcagactgaacaaccccggcagcaccgtgttcaccgaggactgcaacatcctgctgaagctggtgatggccggcgagaccaccaacagcagaggccagagactgccccagaagggcgacgtggagatgctgtgcggcggccccccctgccagggcttcagcggcatgaacagattcaacagcagaacctacagcaagttcaagaacagcctggtggtgagcttcctgagctactgcgactactacagacccagattcttcctgctggagaacgtgagaaacttcgtgagcttcaagagaagcatggtgctgaagctgaccctgagatgcctggtgagaatgggctaccagtgcaccttcggcgtgctgcaggccggccagtacggcgtggcccagaccagaagaagagccatcatcctggccgccgcccccggcgagaagctgcccctgttccccgagcccctgcacgtgttcgcccccagagcctgccagctgagcgtggtggtggacgacaagaagttcgtgagcaacatcaccagactgagcagcggccccttcagaaccatcaccgtgagagacaccatgagcgacctgcccgaggtgagaaacggcgccagcgccctggagatcagctacaacggcgagccccagagctggttccagagacagctgagaggcgcccagtaccagcccatcctgagagaccacatctgcaaggacatgagcgccctggtggccgccagaatgagacacatccccctggcccccggcagcgactggagagacctgcccaacatcgaggtgagactgagcgacggcaccatggccagaaagctgagatacacccaccacgacagaaagaacggcagaagcagcagcggcgccctgagaggcgtgtgcagctgcgtggagggcggcagcagcggcaaggcctgcgaccccgccgccagacagttcaacaccctgatcccctggtgcctgccccacaccggcaacagacacaaccactgggccggcctgtacggcagactggagtgggacggcttcttcagcaccaccgtgaccaaccccgagcccatgggcaagcagggcagagtgctgcaccccgagcagcacagagtggtgagcgtgagagagtgcgccagaagccagggcttccccgacacctacagactgttcggcaacatcctggacaagcacagacaggtgggcaacgccgtgcccccccccctggccaaggccatcggcctggagatcaagctgtgcatgctggccaaggccagagagagcgccagcgccaagatcaaggaggaggaggccgccaaggactag

SEQ ID NO: 79453 - DNA, 4455 bp, Artificial Sequence
  Description of Artificial Sequence: Synthetic coding sequence
ggcagctgccacagccccgccagcgccagccaggtggccggcaccaccgccgagcccagccccagccccagaatcaccagaaagagcaccagacagaccaccatcaccagccacttcgccaagggccccgccaagagaaagccccaggaggagagcgagagagccaagagcgacgagagcatcaaggaggaggacaaggaccaggacgagaagagaagaagagtgaccagcagagagagagtggccagacccctgcccgccgaggagcccgagagagccaagagcggcaccagaaccgagaaggaggaggagagagacgagaaggaggagaagagactgagaagccagaccaaggagcccacccccaagcagaagctgaaggaggagcccgacagagaggccagagccggcgtgcaggccgacgaggacgaggacggcgacgagaaggacgagaagaagcacagaagccagcccaaggacctggccgccaagagaagacccgaggagaaggagcccgagaaggtgaacccccagatcagcgacgagaaggacgaggacgagaaggaggagaagagaagaaagaccacccccaaggagcccaccgagaagaagatggccagagccaagaccgtgatgaacagcaagacccacccccccaagtgcatccagtgcggccagtacctggacgaccccgacctgaagtacggccagcacccccccgacgccgtggacgagccccagatgctgaccaacgagaagctgagcatcttcgacgccaacgagagcggcttcgagagctacgaggccctgccccagcacaagctgacctgcttcagcgtgtactgcaagcacggccacctgtgccccatcgacaccggcctgatcgagaagaacatcgagctgttcttcagcggcagcgccaagcccatctacgacgacgaccccagcctggagggcggcgtgaacggcaagaacctgggccccatcaacgagtggtggatcaccggcttcgacggcggcgagaaggccctgatcggcttcagcaccagcttcgccgagtacatcctgatggaccccagccccgagtacgcccccatcttcggcctgatgcaggagaagatctacatcagcaagatcgtggtggagttcctgcagagcaacagcgacagcacctacgaggacctgatcaacaagatcgagaccaccgtgccccccagcggcctgaacctgaacagattcaccgaggacagcctgctgagacacgcccagttcgtggtggagcaggtggagagctacgacgaggccggcgacagcgacgagcagcccatcttcctgaccccctgcatgagagacctgatcaagctggccggcgtgaccctgggccagagaagagcccaggccagaagacagaccatcagacacagcaccagagagaaggacagaggccccaccaaggccaccaccaccaagctggtgtaccagatcttcgacaccttcttcgccgagcagatcgagaaggacgacagagaggacaaggagaacgccttcaagagaagaagatgcggcgtgtgcgaggtgtgccagcagcccgagtgcggcaagtgcaaggcctgcaaggacatggtgaagttcggcggcagcggcagaagcaagcaggcctgccaggagagaagatgccccaacatggccatgaaggaggccgacgacgacgaggaggtggacgacaacatccccgagatgcccagccccaagaagatgcaccagggcaagaagaagaagcagaacaagaacagaatcagctgggtgggcgaggccgtgaagaccgacggcaagaagagctactacaagaaggtgtgcatcgacgccgagaccctggaggtgggcgactgcgtgagcgtgatccccgacgacagcagcaagcccctgtacctggccagagtgaccgccctgtgggaggacagcagcaacggccagatgttccacgcccactggttctgcgccggcaccgacaccgtgctgggcgccaccagcgaccccctggagctgttcctggtggacgagtgcgaggacatgcagctgagctacatccacagcaaggtgaaggtgatctacaaggcccccagcgagaactgggccatggagggcggcatggaccccgagagcctgctggagggcgacgacggcaagacctacttctaccagctgtggtacgaccaggactacgccagattcgagagcccccccaagacccagcccaccgaggacaacaagttcaagttctgcgtgagctgcgccagactggccgagatgagacagaaggagatccccagagtgctggagcagctggaggacctggacagcagagtgctgtactacagcgccaccaagaacggcatcctgtacagagtgggcgacggcgtgtacctgccccccgaggccttcaccttcaacatcaagctgagcagccccgtgaagagacccagaaaggagcccgtggacgaggacctgtaccccgagcactacagaaagtacagcgactacatcaagggcagcaacctggacgcccccgagccctacagaatcggcagaatcaaggagatcttctgccccaagaagagcaacggcagacccaacgagaccgacatcaagatcagagtgaacaagttctacagacccgagaacacccacaagagcacccccgccagctaccacgccgacatcaacctgctgtactggagcgacgaggaggccgtggtggacttcaaggccgtgcagggcagatgcaccgtggagtacggcgaggacctgcccgagtgcgtgcaggtgtacagcatgggcggccccaacagattctacttcctggaggcctacaacgccaagagcaagagcttcgaggacccccccaaccacgccagaagccccggcaacaagggcaagggcaagggcaagggcaagggcaagcccaagagccaggcctgcgagcccagcgagcccgagatcgagatcaagctgcccaagctgagaaccctggacgtgttcagcggctgcggcggcctgagcgagggcttccaccaggccggcatcagcgacaccctgtgggccatcgagatgtgggaccccgccgcccaggccttcagactgaacaaccccggcagcaccgtgttcaccgaggactgcaacatcctgctgaagctggtgatggccggcgagaccaccaacagcagaggccagagactgccccagaagggcgacgtggagatgctgtgcggcggccccccctgccagggcttcagcggcatgaacagattcaacagcagaacctacagcaagttcaagaacagcctggtggtgagcttcctgagctactgcgactactacagacccagattcttcctgctggagaacgtgagaaacttcgtgagcttcaagagaagcatggtgctgaagctgaccctgagatgcctggtgagaatgggctaccagtgcaccttcggcgtgctgcaggccggccagtacggcgtggcccagaccagaagaagagccatcatcctggccgccgcccccggcgagaagctgcccctgttccccgagcccctgcacgtgttcgcccccagagcctgccagctgagcgtggtggtggacgacaagaagttcgtgagcaacatcaccagactgagcagcggccccttcagaaccatcaccgtgagagacaccatgagcgacctgcccgaggtgagaaacggcgccagcgccctggagatcagctacaacggcgagccccagagctggttccagagacagctgagaggcgcccagtaccagcccatcctgagagaccacatctgcaaggacatgagcgccctggtggccgccagaatgagacacatccccctggcccccggcagcgactggagagacctgcccaacatcgaggtgagactgagcgacggcaccatggccagaaagctgagatacacccaccacgacagaaagaacggcagaagcagcagcggcgccctgagaggcgtgtgcagctgcgtggaggccggcaaggcctgcgaccccgccgccagacagttcaacaccctgatcccctggtgcctgccccacaccggcaacagacacaaccactgggccggcctgtacggcagactggagtgggacggcttcttcagcaccaccgtgaccaaccccgagcccatgggcaagcagggcagagtgctgcaccccgagcagcacagagtggtgagcgtgagagagtgcgccagaagccagggcttccccgacacctacagactgttcggcaacatcctggacaagcacagacaggtgggcaacgccgtgcccccccccctggccaaggccatcggcctggagatcaagctgtgcatgctggccaaggccagagagagcgccagcgccaagatcaaggaggaggaggccgccaaggactag

SEQ ID NO: 79454 - DNA, 2739 bp, Artificial Sequence
  Description of Artificial Sequence: Synthetic coding sequence
atgcccgccatgcccagcagcggccccggcgacaccagcagcagcgccgccgagagagaggaggacagaaaggacggcgaggagcaggaggagcccagaggcaaggaggagagacaggagcccagcaccaccgccagaaaggtgggcagacccggcagaaagagaaagcacccccccgtggagagcggcgacacccccaaggaccccgccgtgatcagcaagagccccagcatggcccaggacagcggcgccagcgagctgctgcccaacggcgacctggagaagagaagcgagccccagcccgaggagggcagccccgccggcggccagaagggcggcgcccccgccgagggcgagggcgccgccgagaccctgcccgaggccagcagagccgtggagaacggctgctgcacccccaaggagggcagaggcgcccccgccgaggccggcaaggagcagaaggagaccaacatcgagagcatgaagatggagggcagcagaggcagactgagaggcggcctgggctgggagagcagcctgagacagagacccatgcccagactgaccttccaggccggcgacccctactacatcagcaagagaaagagagacgagtggctggccagatggaagagagaggccgagaagaaggccaaggtgatcgccggcatgaacgccgtggaggagaaccagggccccggcgagagccagaaggtggaggaggccagcccccccgccgtgcagcagcccaccgaccccgccagccccaccgtggccaccacccccgagcccgtgggcagcgacgccggcgacaagaacgccaccaaggccggcgacgacgagcccgagtacgaggacggcagaggcttcggcatcggcgagctggtgtggggcaagctgagaggcttcagctggtggcccggcagaatcgtgagctggtggatgaccggcagaagcagagccgccgagggcaccagatgggtgatgtggttcggcgacggcaagttcagcgtggtgtgcgtggagaagctgatgcccctgagcagcttctgcagcgccttccaccaggccacctacaacaagcagcccatgtacagaaaggccatctacgaggtgctgcaggtggccagcagcagagccggcaagctgttccccgtgtgccacgacagcgacgagagcgacaccgccaaggccgtggaggtgcagaacaagcccatgatcgagtgggccctgggcggcttccagcccagcggccccaagggcctggagccccccgaggaggagaagaacccctacaaggaggtgtacaccgacatgtgggtggagcccgaggccgccgcctacgccccccccccccccgccaagaagcccagaaagagcaccgccgagaagcccaaggtgaaggagatcatcgacgagagaaccagagagagactggtgtacgaggtgagacagaagtgcagaaacatcgaggacatctgcatcagctgcggcagcctgaacgtgaccctggagcaccccctgttcgtgggcggcatgtgccagaactgcaagaactgcttcctggagtgcgcctaccagtacgacgacgacggctaccagagctactgcaccatctgctgcggcggcagagaggtgctgatgtgcggcaacaacaactgctgcagatgcttctgcgtggagtgcgtggacctgctggtgggccccggcgccgcccaggccgccatcaaggaggacccctggaactgctacatgtgcggccacaagggcacctacggcctgctgagaagaagagaggactggcccagcagactgcagatgttcttcgccaacaaccacgaccaggagttcgacccccccaaggtgtacccccccgtgcccgccgagaagagaaagcccatcagagtgctgagcctgttcgacggcatcgccaccggcctgctggtgctgaaggacctgggcatccaggtggacagatacatcgccagcgaggtgtgcgaggacagcatcaccgtgggcatggtgagacaccagggcaagatcatgtacgtgggcgacgtgagaagcgtgacccagaagcacatccaggagtggggccccttcgacctggtgatcggcggcagcccctgcaacgacctgagcatcgtgaaccccgccagaaagggcctgtacgagggcaccggcagactgttcttcgagttctacagactgctgcacgacgccagacccaaggagggcgacgacagacccttcttctggctgttcgagaacgtggtggccatgggcgtgagcgacaagagagacatcagcagattcctggagagcaaccccgtgatgatcgacgccaaggaggtgagcgccgcccacagagccagatacttctggggcaacctgcccggcatgaacagacccctggccagcaccgtgaacgacaagctggagctgcaggagtgcctggagcacggcagaatcgccaagttcagcaaggtgagaaccatcaccaccagaagcaacagcatcaagcagggcaaggaccagcacttccccgtgttcatgaacgagaaggaggacatcctgtggtgcaccgagatggagagagtgttcggcttccccgtgcactacaccgacgtgagcaacatgagcagactggccagacagagactgctgggcagaagctggagcgtgcccgtgatcagacacctgttcgcccccctgaaggagtacttcgcctgcgtgtag

SEQ ID NO: 79455 - DNA, 2739 bp, Artificial Sequence; identical to SEQ ID NO: 79454
  Description of Artificial Sequence: Synthetic coding sequence

SEQ ID NO: 79456 - DNA, 2172 bp, Artificial Sequence
  Description of Artificial Sequence: Synthetic coding sequence
atgggcatcctggagagagtggtgagaagaaacggcagagtggacagaagcctgaaggacgagtgcgacaccgccgagaagaaggccaaggtgatcgccggcatgaacgccgtggaggagaaccagggccccggcgagagccagaaggtggaggaggccagcccccccgccgtgcagcagcccaccgaccccgccagccccaccgtggccaccacccccgagcccgtgggcagcgacgccggcgacaagaacgccaccaaggccggcgacgacgagcccgagtacgaggacggcagaggcttcggcatcggcgagctggtgtggggcaagctgagaggcttcagctggtggcccggcagaatcgtgagctggtggatgaccggcagaagcagagccgccgagggcaccagatgggtgatgtggttcggcgacggcaagttcagcgtggtgtgcgtggagaagctgatgcccctgagcagcttctgcagcgccttccaccaggccacctacaacaagcagcccatgtacagaaaggccatctacgaggtgctgcaggtggccagcagcagagccggcaagctgttccccgtgtgccacgacagcgacgagagcgacaccgccaaggccgtggaggtgcagaacaagcccatgatcgagtgggccctgggcggcttccagcccagcggccccaagggcctggagccccccgaggaggagaagaacccctacaaggaggtgtacaccgacatgtgggtggagcccgaggccgccgcctacgccccccccccccccgccaagaagcccagaaagagcaccgccgagaagcccaaggtgaaggagatcatcgacgagagaaccagagagagactggtgtacgaggtgagacagaagtgcagaaacatcgaggacatctgcatcagctgcggcagcctgaacgtgaccctggagcaccccctgttcgtgggcggcatgtgccagaactgcaagaactgcttcctggagtgcgcctaccagtacgacgacgacggctaccagagctactgcaccatctgctgcggcggcagagaggtgctgatgtgcggcaacaacaactgctgcagatgcttctgcgtggagtgcgtggacctgctggtgggccccggcgccgcccaggccgccatcaaggaggacccctggaactgctacatgtgcggccacaagggcacctacggcctgctgagaagaagagaggactggcccagcagactgcagatgttcttcgccaacaaccacgaccaggagttcgacccccccaaggtgtacccccccgtgcccgccgagaagagaaagcccatcagagtgctgagcctgttcgacggcatcgccaccggcctgctggtgctgaaggacctgggcatccaggtggacagatacatcgccagcgaggtgtgcgaggacagcatcaccgtgggcatggtgagacaccagggcaagatcatgtacgtgggcgacgtgagaagcgtgacccagaagcacatccaggagtggggccccttcgacctggtgatcggcggcagcccctgcaacgacctgagcatcgtgaaccccgccagaaagggcctgtacgagggcaccggcagactgttcttcgagttctacagactgctgcacgacgccagacccaaggagggcgacgacagacccttcttctggctgttcgagaacgtggtggccatgggcgtgagcgacaagagagacatcagcagattcctggagagcaaccccgtgatgatcgacgccaaggaggtgagcgccgcccacagagccagatacttctggggcaacctgcccggcatgaacagacccctggccagcaccgtgaacgacaagctggagctgcaggagtgcctggagcacggcagaatcgccaagttcagcaaggtgagaaccatcaccaccagaagcaacagcatcaagcagggcaaggaccagcacttccccgtgttcatgaacgagaaggaggacatcctgtggtgcaccgagatggagagagtgttcggcttccccgtgcactacaccgacgtgagcaacatgagcagactggccagacagagactgctgggcagaagctggagcgtgcccgtgatcagacacctgttcgcccccctgaaggagtacttcgcctgcgtgtag

SEQ ID NO: 79457 - DNA, 2070 bp, Artificial Sequence
  Description of Artificial Sequence: Synthetic coding sequence
atgaacgccgtggaggagaaccagggccccggcgagagccagaaggtggaggaggccagcccccccgccgtgcagcagcccaccgaccccgccagccccaccgtggccaccacccccgagcccgtgggcagcgacgccggcgacaagaacgccaccaaggccggcgacgacgagcccgagtacgaggacggcagaggcttcggcatcggcgagctggtgtggggcaagctgagaggcttcagctggtggcccggcagaatcgtgagctggtggatgaccggcagaagcagagccgccgagggcaccagatgggtgatgtggttcggcgacggcaagttcagcgtggtgtgcgtggagaagctgatgcccctgagcagcttctgcagcgccttccaccaggccacctacaacaagcagcccatgtacagaaaggccatctacgaggtgctgcaggtggccagcagcagagccggcaagctgttccccgtgtgccacgacagcgacgagagcgacaccgccaaggccgtggaggtgcagaacaagcccatgatcgagtgggccctgggcggcttccagcccagcggccccaagggcctggagccccccgaggaggagaagaacccctacaaggaggtgtacaccgacatgtgggtggagcccgaggccgccgcctacgccccccccccccccgccaagaagcccagaaagagcaccgccgagaagcccaaggtgaaggagatcatcgacgagagaaccagagagagactggtgtacgaggtgagacagaagtgcagaaacatcgaggacatctgcatcagctgcggcagcctgaacgtgaccctggagcaccccctgttcgtgggcggcatgtgccagaactgcaagaactgcttcctggagtgcgcctaccagtacgacgacgacggctaccagagctactgcaccatctgctgcggcggcagagaggtgctgatgtgcggcaacaacaactgctgcagatgcttctgcgtggagtgcgtggacctgctggtgggccccggcgccgcccaggccgccatcaaggaggacccctggaactgctacatgtgcggccacaagggcacctacggcctgctgagaagaagagaggactggcccagcagactgcagatgttcttcgccaacaaccacgaccaggagttcgacccccccaaggtgtacccccccgtgcccgccgagaagagaaagcccatcagagtgctgagcctgttcgacggcatcgccaccggcctgctggtgctgaaggacctgggcatccaggtggacagatacatcgccagcgaggtgtgcgaggacagcatcaccgtgggcatggtgagacaccagggcaagatcatgtacgtgggcgacgtgagaagcgtgacccagaagcacatccaggagtggggccccttcgacctggtgatcggcggcagcccctgcaacgacctgagcatcgtgaaccccgccagaaagggcctgtacgagggcaccggcagactgttcttcgagttctacagactgctgcacgacgccagacccaaggagggcgacgacagacccttcttctggctgttcgagaacgtggtggccatgggcgtgagcgacaagagagacatcagcagattcctggagagcaaccccgtgatgatcgacgccaaggaggtgagcgccgcccacagagccagatacttctggggcaacctgcccggcatgaacagacccctggccagcaccgtgaacgacaagctggagctgcaggagtgcctggagcacggcagaatcgccaagttcagcaaggtgagaaccatcaccaccagaagcaacagcatcaagcagggcaaggaccagcacttccccgtgttcatgaacgagaaggaggacatcctgtggtgcaccgagatggagagagtgttcggcttccccgtgcactacaccgacgtgagcaacatgagcagactggccagacagagactgctgggcagaagctggagcgtgcccgtgatcagacacctgttcgcccccctgaaggagtacttcgcctgcgtgtag

SEQ ID NO: 79458 - DNA, 501 bp, Artificial Sequence
  Description of Artificial Sequence: Synthetic coding sequence
atgcccgccatgcccagcagcggccccggcgacaccagcagcagcgccgccgagagagaggaggacagaaaggacggcgaggagcaggaggagcccagaggcaaggaggagagacaggagcccagcaccaccgccagaaaggtgggcagacccggcagaaagagaaagcacccccccgtggagagcggcgacacccccaaggaccccgccgtgatcagcaagagccccagcatggcccaggacagcggcgccagcgagctgctgcccaacggcgacctggagaagagaagcgagccccagcccgaggagggcagccccgccggcggccagaagggcggcgcccccgccgagggcgagggcgccgccgagaccctgcccgaggccagcagagccgtggagaacggctgctgcacccccaaggagggcagaggcgcccccgccgaggccggcgagagcagcgcccccggcgccgccagcagcggccccaccagcatcccctag

SEQ ID NO: 79459 - DNA, 2538 bp, Artificial Sequence
  Description of Artificial Sequence: Synthetic coding sequence
atggagcccagccccgagccccccagcctggagagcatgaagggcgacaccagacacctgaacggcgaggaggacgccggcggcagagaggacagcatcctggtgaacggcgcctgcagcgaccagagcagcgacagcccccccatcctggaggccatcagaacccccgagatcagaggcagaagaagcagcagcagactgagcaagagagaggtgagcagcctgctgagctacacccaggacctgaccggcgacggcgacggcgaggacggcgacggcagcgacacccccgtgatgcccaagctgttcagagagaccagaaccagaagcgagagccccgccgtgagaaccagaaacaacaacagcgtgagcagcagagagagacacagacccagccccagaagcaccagaggcagacagggcagaaaccacgtggacgagagccccgtggagttccccgccaccagaagcctgagaagaagagccaccgccagcgccggcaccccctggcccagcccccccagcagctacctgaccatcgacctgaccgacgacaccgaggacacccacggcaccccccagagcagcagcaccccctacgccagactggcccaggacagccagcagggcggcatggagagcccccaggtggaggccgacagcggcgacggcgacagcagcgagtaccaggacggcaaggagttcggcatcggcgacctggtgtggggcaagatcaagggcttcagctggtggcccgccatggtggtgagctggaaggccaccagcaagagacaggccatgagcggcatgagatgggtgcagtggttcggcgacggcaagttcagcgaggtgagcgccgacaagctggtggccctgggcctgttcagccagcacttcaacctggccaccttcaacaagctggtgagctacagaaaggccatgtaccacgccctggagaaggccagagtgagagccggcaagaccttccccagcagccccggcgacagcctggaggaccagctgaagcccatgctggagtgggcccacggcggcttcaagcccaccggcatcgagggcctgaagcccaacaacacccagcccgagaacaagaccagaagaagaaccgccgacgacagcgccaccagcgactactgccccgcccccaagagactgaagaccaactgctacaacaacggcaaggacagaggcgacgaggaccagagcagagagcagatggccagcgacgtggccaacaacaagagcagcctggaggacggctgcctgagctgcggcagaaagaaccccgtgagcttccaccccctgttcgagggcggcctgtgccagacctgcagagacagattcctggagctgttctacatgtacgacgacgacggctaccagagctactgcaccgtgtgctgcgagggcagagagctgctgctgtgcagcaacaccagctgctgcagatgcttctgcgtggagtgcctggaggtgctggtgggcaccggcaccgccgccgaggccaagctgcaggagccctggagctgctacatgtgcctgccccagagatgccacggcgtgctgagaagaagaaaggactggaacgtgagactgcaggccttcttcaccagcgacaccggcctggagtacgaggcccccaagctgtaccccgccatccccgccgccagaagaagacccatcagagtgctgagcctgttcgacggcatcgccaccggctacctggtgctgaaggagctgggcatcaaggtgggcaagtacgtggccagcgaggtgtgcgaggagagcatcgccgtgggcaccgtgaagcacgagggcaacatcaagtacgtgaacgacgtgagaaacatcaccaagaagaacatcgaggagtggggccccttcgacctggtgatcggcggcagcccctgcaacgacctgagcaacgtgaaccccgccagaaagggcctgtacgagggcaccggcagactgttcttcgagttctaccacctgctgaactacagcagacccaaggagggcgacgacagacccttcttctggatgttcgagaacgtggtggccatgaaggtgggcgacaagagagacatcagcagattcctggagtgcaaccccgtgatgatcgacgccatcaaggtgagcgccgcccacagagccagatacttctggggcaacctgcccggcatgaacagacccgtgatcgccagcaagaacgacaagctggagctgcaggactgcctggagtacaacagaatcgccaagctgaagaaggtgcagaccatcaccaccaagagcaacagcatcaagcagggcaagaaccagctgttccccgtggtgatgaacggcaaggaggacgtgctgtggtgcaccgagctggagagaatcttcggcttccccgtgcactacaccgacgtgagcaacatgggcagaggcgccagacagaagctgctgggcagaagctggagcgtgcccgtgatcagacacctgttcgcccccctgaaggactacttcgcctgcgagtag

SEQ ID NO: 79460 - DNA, 2562 bp, Artificial Sequence
  Description of Artificial Sequence: Synthetic coding sequence
atgaagggcgacaccagacacctgaacggcgaggaggacgccggcggcagagaggacagcatcctggtgaacggcgcctgcagcgaccagagcagcgacagcccccccatcctggaggccatcagaacccccgagatcagaggcagaagaagcagcagcagactgagcaagagagaggtgagcagcctgctgagctacacccaggacctgaccggcgacggcgacggcgaggacggcgacggcagcgacacccccgtgatgcccaagctgttcagagagaccagaaccagaagcgagagccccgccgtgagaaccagaaacaacaacagcgtgagcagcagagagagacacagacccagccccagaagcaccagaggcagacagggcagaaaccacgtggacgagagccccgtggagttccccgccaccagaagcctgagaagaagagccaccgccagcgccggcaccccctggcccagcccccccagcagctacctgaccatcgacctgaccgacgacaccgaggacacccacggcaccccccagagcagcagcaccccctacgccagactggcccaggacagccagcagggcggcatggagagcccccaggtggaggccgacagcggcgacggcgacagcagcgagtaccaggacggcaaggagttcggcatcggcgacctggtgtggggcaagatcaagggcttcagctggtggcccgccatggtggtgagctggaaggccaccagcaagagacaggccatgagcggcatgagatgggtgcagtggttcggcgacggcaagttcagcgaggtgagcgccgacaagctggtggccctgggcctgttcagccagcacttcaacctggccaccttcaacaagctggtgagctacagaaaggccatgtaccacgccctggagaaggccagagtgagagccggcaagaccttccccagcagccccggcgacagcctggaggaccagctgaagcccatgctggagtgggcccacggcggcttcaagcccaccggcatcgagggcctgaagcccaacaacacccagcccgtggtgaacaagagcaaggtgagaagagccggcagcagaaagctggagagcagaaagtacgagaacaagaccagaagaagaaccgccgacgacagcgccaccagcgactactgccccgcccccaagagactgaagaccaactgctacaacaacggcaaggacagaggcgacgaggaccagagcagagagcagatggccagcgacgtggccaacaacaagagcagcctggaggacggctgcctgagctgcggcagaaagaaccccgtgagcttccaccccctgttcgagggcggcctgtgccagacctgcagagacagattcctggagctgttctacatgtacgacgacgacggctaccagagctactgcaccgtgtgctgcgagggcagagagctgctgctgtgcagcaacaccagctgctgcagatgcttctgcgtggagtgcctggaggtgctggtgggcaccggcaccgccgccgaggccaagctgcaggagccctggagctgctacatgtgcctgccccagagatgccacggcgtgctgagaagaagaaaggactggaacgtgagactgcaggccttcttcaccagcgacaccggcctggagtacgaggcccccaagctgtaccccgccatccccgccgccagaagaagacccatcagagtgctgagcctgttcgacggcatcgccaccggctacctggtgctgaaggagctgggcatcaaggtgggcaagtacgtggccagcgaggtgtgcgaggagagcatcgccgtgggcaccgtgaagcacgagggcaacatcaagtacgtgaacgacgtgagaaacatcaccaagaagaacatcgaggagtggggccccttcgacctggtgatcggcggcagcccctgcaacgacctgagcaacgtgaaccccgccagaaagggcctgtacgagggcaccggcagactgttcttcgagttctaccacctgctgaactacagcagacccaaggagggcgacgacagacccttcttctggatgttcgagaacgtggtggccatgaaggtgggcgacaagagagacatcagcagattcctggagtgcaaccccgtgatgatcgacgccatcaaggtgagcgccgcccacagagccagatacttctggggcaacctgcccggcatgaacagacccgtgatcgccagcaagaacgacaagctggagctgcaggactgcctggagtacaacagaatcgccaagctgaagaaggtgcagaccatcaccaccaagagcaacagcatcaagcagggcaagaaccagctgttccccgtggtgatgaacggcaaggaggacgtgctgtggtgcaccgagctggagagaatcttcggcttccccgtgcactacaccgacgtgagcaacatgggcagaggcgccagacagaagctgctgggcagaagctggagcgtgcccgtgatcagacacctgttcgcccccctgaaggactacttcgcctgcgagtag

SEQ ID NO: 79461 - DNA, 2379 bp, Artificial Sequence
  Description of Artificial Sequence: Synthetic coding sequence
atgaagggcgacaccagacacctgaacggcgaggaggacgccggcggcagagaggacagcatcctggtgaacggcgcctgcagcgaccagagcagcgacagcccccccatcctggaggccatcagaacccccgagatcagaggcagaagaagcagcagcagactgagcaagagagaggtgagcagcctgctgagctacacccaggacctgaccggcgacggcgacggcgaggacggcgacggcagcgacacccccgtgatgcccaagctgttcagagagaccagaaccagaagcgagagccccgccgtgagaaccagaaacaacaacagcgtgagcagcagagagagacacagacccagccccagaagcaccagaggcagacagggcagaaaccacgtggacgagagccccgtggagttccccgccaccagaagcctgagaagaagagccaccgccagcgccggcaccccctggcccagcccccccagcagctacctgaccatcgacctgaccgacgacaccgaggacacccacggcaccccccagagcagcagcaccccctacgccagactggcccaggacagccagcagggcggcatggagagcccccaggtggaggccgacagcggcgacggcgacagcagcgagtaccaggacggcaaggagttcggcatcggcgacctggtgtggggcaagatcaagggcttcagctggtggcccgccatggtggtgagctggaaggccaccagcaagagacaggccatgagcggcatgagatgggtgcagtggttcggcgacggcaagttcagcgaggtgagcgccgacaagctggtggccctgggcctgttcagccagcacttcaacctggccaccttcaacaagctggtgagctacagaaaggccatgtaccacgccctggagaaggccagagtgagagccggcaagaccttccccagcagccccggcgacagcctggaggaccagctgaagcccatgctggagtgggcccacggcggcttcaagcccaccggcatcgagggcctgaagcccaacaacacccagcccgagaacaagaccagaagaagaaccgccgacgacagcgccaccagcgactactgccccgcccccaagagactgaagaccaactgctacaacaacggcaaggacagaggcgacgaggaccagagcagagagcagatggccagcgacgtggccaacaacaagagcagcctggaggacggctgcctgagctgcggcagaaagaaccccgtgagcttccaccccctgttcgagggcggcctgtgccagacctgcagagacagattcctggagctgttctacatgtacgacgacgacggctaccagagctactgcaccgtgtgctgcgagggcagagagctgctgctgtgcagcaacaccagctgctgcagatgcttctgcgtggagtgcctggaggtgctggtgggcaccggcaccgccgccgaggccaagctgcaggagccctggagctgctacatgtgcctgccccagagatgccacggcgtgctgagaagaagaaaggactggaacgtgagactgcaggccttcttcaccagcgacaccggcctggagtacgaggcccccaagctgtaccccgccatccccgccgccagaagaagacccatcagagtgctgagcctgttcgacggcatcgccaccggctacctggtgctgaaggagctgggcatcaaggtgggcaagtacgtggccagcgaggtgtgcgaggagagcatcgccgtgggcaccgtgaagcacgagggcaacatcaagtacgtgaacgacgtgagaaacatcaccaagaagaacatcgaggagtggggccccttcgacctggtgatcggcggcagcccctgcaacgacctgagcaacgtgaaccccgccagaaagggcctgtacgagggcaccggcagactgttcttcgagttctaccacctgctgaactacagcagacccaaggagggcgacgacagacccttcttctggatgttcgagaacgtggtggccatgaaggtgggcgacaagagagacatcagcagattcctggagtgcaaccccgtgatgatcgacgccatcaaggtgagcgccgcccacagagccagatacttctggggcaacctgcccggcatgaacagacccgtgatcgccagcaagaacgacaagctggagctgcaggactgcctggagtacaacagaatcgccaaggacctgtggctgagctgcgccctgcacagaagagtgcagcacggcccctggtgcccccccgaggccgccggcaaggtgctggagagagcctgccaccccacccccctgagacccagcgagggcctgctgtgcatgtag

SEQ ID NO: 79462 - DNA, 2313 bp, Artificial Sequence
  Description of Artificial Sequence: Synthetic coding sequence
atgaagggcgacaccagacacctgaacggcgaggaggacgccggcggcagagaggacagcatcctggtgaacggcgcctgcagcgaccagagcagcgacagcccccccatcctggaggccatcagaacccccgagatcagaggcagaagaagcagcagcagactgagcaagagagaggtgagcagcctgctgagctacacccaggacctgaccggcgacggcgacggcgaggacggcgacggcagcgacacccccgtgatgcccaagctgttcagagagaccagaaccagaagcgagagccccgccgtgagaaccagaaacaacaacagcgtgagcagcagagagagacacagacccagccccagaagcaccagaggcagacagggcagaaaccacgtggacgagagccccgtggagttccccgccaccagaagcctgagaagaagagccaccgccagcgccggcaccccctggcccagcccccccagcagctacctgaccatcgacctgaccgacgacaccgaggacacccacggcaccccccagagcagcagcaccccctacgccagactggcccaggacagccagcagggcggcatggagagcccccaggtggaggccgacagcggcgacggcgacagcagcgagtaccaggacggcaaggagttcggcatcggcgacctggtgtggggcaagatcaagggcttcagctggtggcccgccatggtggtgagctggaaggccaccagcaagagacaggccatgagcggcatgagatgggtgcagtggttcggcgacggcaagttcagcgaggtgagcgccgacaagctggtggccctgggcctgttcagccagcacttcaacctggccaccttcaacaagctggtgagctacagaaaggccatgtaccacgccctggagaaggccagagtgagagccggcaagaccttccccagcagccccggcgacagcctggaggaccagctgaagcccatgctggagtgggcccacggcggcttcaagcccaccggcatcgagggcctgaagcccaacaacacccagcccgagaacaagaccagaagaagaaccgccgacgacagcgccaccagcgactactgccccgcccccaagagactgaagaccaactgctacaacaacggcaaggacagaggcgacgaggaccagagcagagagcagatggccagcgacgtggccaacaacaagagcagcctggaggacggctgcctgagctgcggcagaaagaaccccgtgagcttccaccccctgttcgagggcggcctgtgccagacctgcagagacagattcctggagctgttctacatgtacgacgacgacggctaccagagctactgcaccgtgtgctgcgagggcagagagctgctgctgtgcagcaacaccagctgctgcagatgcttctgcgtggagtgcctggaggtgctggtgggcaccggcaccgccgccgaggccaagctgcaggagccctggagctgctacatgtgcctgccccagagatgccacggcgtgctgagaagaagaaaggactggaacgtgagactgcaggccttcttcaccagcgacaccggcctggagtacgaggcccccaagctgtaccccgccatccccgccgccagaagaagacccatcagagtgctgagcctgttcgacggcatcgccaccggctacctggtgctgaaggagctgggcatcaaggtgggcaagtacgtggccagcgaggtgtgcgaggagagcatcgccgtgggcaccgtgaagcacgagggcaacatcaagtacgtgaacgacgtgagaaacatcaccaagaagaacatcgaggagtggggccccttcgacctggtgatcggcggcagcccctgcaacgacctgagcaacgtgaaccccgccagaaagggcctgtacgagggcaccggcagactgttcttcgagttctaccacctgctgaactacagcagacccaaggagggcgacgacagacccttcttctggatgttcgagaacgtggtggccatgaaggtgggcgacaagagagacatcagcagattcctggagtgcaaccccgtgatgatcgacgccatcaaggtgagcgccgcccacagagccagatacttctggggcaacctgcccggcatgaacagaatcttcggcttccccgtgcactacaccgacgtgagcaacatgggcagaggcgccagacagaagctgctgggcagaagctggagcgtgcccgtgatcagacacctgttcgcccccctgaaggactacttcgcctgcgagtag

SEQ ID NO: 79463 - DNA, 2502 bp, Artificial Sequence
  Description of Artificial Sequence: Synthetic coding sequence
atgaagggcgacaccagacacctgaacggcgaggaggacgccggcggcagagaggacagcatcctggtgaacggcgcctgcagcgaccagagcagcgacagcccccccatcctggaggccatcagaacccccgagatcagaggcagaagaagcagcagcagactgagcaagagagaggtgagcagcctgctgagctacacccaggacctgaccggcgacggcgacggcgaggacggcgacggcagcgacacccccgtgatgcccaagctgttcagagagaccagaaccagaagcgagagccccgccgtgagaaccagaaacaacaacagcgtgagcagcagagagagacacagacccagccccagaagcaccagaggcagacagggcagaaaccacgtggacgagagccccgtggagttccccgccaccagaagcctgagaagaagagccaccgccagcgccggcaccccctggcccagcccccccagcagctacctgaccatcgacctgaccgacgacaccgaggacacccacggcaccccccagagcagcagcaccccctacgccagactggcccaggacagccagcagggcggcatggagagcccccaggtggaggccgacagcggcgacggcgacagcagcgagtaccaggacggcaaggagttcggcatcggcgacctggtgtggggcaagatcaagggcttcagctggtggcccgccatggtggtgagctggaaggccaccagcaagagacaggccatgagcggcatgagatgggtgcagtggttcggcgacggcaagttcagcgaggtgagcgccgacaagctggtggccctgggcctgttcagccagcacttcaacctggccaccttcaacaagctggtgagctacagaaaggccatgtaccacgccctggagaaggccagagtgagagccggcaagaccttccccagcagccccggcgacagcctggaggaccagctgaagcccatgctggagtgggcccacggcggcttcaagcccaccggcatcgagggcctgaagcccaacaacacccagcccgagaacaagaccagaagaagaaccgccgacgacagcgccaccagcgactactgccccgcccccaagagactgaagaccaactgctacaacaacggcaaggacagaggcgacgaggaccagagcagagagcagatggccagcgacgtggccaacaacaagagcagcctggaggacggctgcctgagctgcggcagaaagaaccccgtgagcttccaccccctgttcgagggcggcctgtgccagacctgcagagacagattcctggagctgttctacatgtacgacgacgacggctaccagagctactgcaccgtgtgctgcgagggcagagagctgctgctgtgcagcaacaccagctgctgcagatgcttctgcgtggagtgcctggaggtgctggtgggcaccggcaccgccgccgaggccaagctgcaggagccctggagctgctacatgtgcctgccccagagatgccacggcgtgctgagaagaagaaaggactggaacgtgagactgcaggccttcttcaccagcgacaccggcctggagtacgaggcccccaagctgtaccccgccatccccgccgccagaagaagacccatcagagtgctgagcctgttcgacggcatcgccaccggctacctggtgctgaaggagctgggcatcaaggtgggcaagtacgtggccagcgaggtgtgcgaggagagcatcgccgtgggcaccgtgaagcacgagggcaacatcaagtacgtgaacgacgtgagaaacatcaccaagaagaacatcgaggagtggggccccttcgacctggtgatcggcggcagcccctgcaacgacctgagcaacgtgaaccccgccagaaagggcctgtacgagggcaccggcagactgttcttcgagttctaccacctgctgaactacagcagacccaaggagggcgacgacagacccttcttctggatgttcgagaacgtggtggccatgaaggtgggcgacaagagagacatcagcagattcctggagtgcaaccccgtgatgatcgacgccatcaaggtgagcgccgcccacagagccagatacttctggggcaacctgcccggcatgaacagacccgtgatcgccagcaagaacgacaagctggagctgcaggactgcctggagtacaacagaatcgccaagctgaagaaggtgcagaccatcaccaccaagagcaacagcatcaagcagggcaagaaccagctgttccccgtggtgatgaacggcaaggaggacgtgctgtggtgcaccgagctggagagaatcttcggcttccccgtgcactacaccgacgtgagcaacatgggcagaggcgccagacagaagctgctgggcagaagctggagcgtgcccgtgatcagacacctgttcgcccccctgaaggactacttcgcctgcgagtag

SEQ ID NO: 79464 - DNA, 999 bp, Artificial Sequence
  Description of Artificial Sequence: Synthetic coding sequence
atgaagggcgacaccagacacctgaacggcgaggaggacgccggcggcagagaggacagcatcctggtgaacggcgcctgcagcgaccagagcagcgacagcccccccatcctggaggccatcagaacccccgagatcagaggcagaagaagcagcagcagactgagcaagagagaggtgagcagcctgctgagctacacccaggacctgaccggcgacggcgacggcgaggacggcgacggcagcgacacccccgtgatgcccaagctgttcagagagaccagaaccagaagcgagagccccgccagcctgagaagaagagccaccgccagcgccggcaccccctggcccagcccccccagcagctacctgaccatcgacctgaccgacgacaccgaggacacccacggcaccccccagagcagcagcaccccctacgccagactggcccaggacagccagcagggcggcatggagagcccccaggtggaggccgacagcggcgacggcgacagcagcgagtaccaggacggcaaggagttcggcatcggcgacctggtgtggggcaagatcaagggcttcagctggtggcccgccatggtggtgagctggaaggccaccagcaagagacaggccatgagcggcatgagatgggtgcagtggttcggcgacggcaagttcagcgaggtgagcgccgacaagctggtggccctgggcctgttcagccagcacttcaacctggccaccttcaacaagctggtgagctacagaaaggccatgtaccacgccctggagagaaccagactggaggacgcccagctgaccacccagccccccctgaccaccgccccccaccccagcgccagcagacagatcgccatcaccaccgccaagaccgagggcatgaagatcagagccgagaacaagtggctgcagatgctgcccaccaccagagccgcctggaaggagaagcccagagtgctgccccccagcctgtag

SEQ ID NO: 79465 - DNA, 2187 bp, Artificial Sequence
  Description of Artificial Sequence: Synthetic coding sequence
atgaagggcgacaccagacacctgaacggcgaggaggacgccggcggcagagaggacagcatcctggtgaacggcgcctgcagcgaccagagcagcgacagcccccccatcctggaggccatcagaacccccgagatcagaggcagaagaagcagcagcagactgagcaagagagaggtgagcagcctgctgagctacacccaggacctgaccggcgacggcgacggcgaggacggcgacggcagcgacacccccgtgatgcccaagctgttcagagagaccagaaccagaagcgagagccccgccagcctgagaagaagagccaccgccagcgccggcaccccctggcccagcccccccagcagctacctgaccatcgacctgaccgacgacaccgaggacacccacggcaccccccagagcagcagcaccccctacgccagactggcccaggacagccagcagggcggcatggagagcccccaggtggaggccgacagcggcgacggcgacagcagcgagtaccaggacggcaaggagttcggcatcggcgacctggtgtggggcaagatcaagggcttcagctggtggcccgccatggtggtgagctggaaggccaccagcaagagacaggccatgagcggcatgagatgggtgcagtggttcggcgacggcaagttcagcgaggtgagcgccgacaagctggtggccctgggcctgttcagccagcacttcaacctggccaccttcaacaagctggtgagctacagaaaggccatgtaccacgccctggagaaggccagagtgagagccggcaagaccttccccagcagccccggcgacagcctggaggaccagctgaagcccatgctggagtgggcccacggcggcttcaagcccaccggcatcgagggcctgaagcccaacaacacccagcccgagaacaagaccagaagaagaaccgccgacgacagcgccaccagcgactactgccccgcccccaagagactgaagaccaactgctacaacaacggcaaggacagaggcgacgaggaccagagcagagagcagatggccagcgacgtggccaacaacaagagcagcctggaggacggctgcctgagctgcggcagaaagaaccccgtgagcttccaccccctgttcgagggcggcctgtgccagacctgcagagacagattcctggagctgttctacatgtacgacgacgacggctaccagagctactgcaccgtgtgctgcgagggcagagagctgctgctgtgcagcaacaccagctgctgcagatgcttctgcgtggagtgcctggaggtgctggtgggcaccggcaccgccgccgaggccaagctgcaggagccctggagctgctacatgtgcctgccccagagatgccacggcgtgctgagaagaagaaaggactggaacgtgagactgcaggccttcttcaccagcgacaccggcctggagtacgaggcccccaagctgtaccccgccatccccgccgccagaagaagacccatcagagtgctgagcctgttcgacggcatcgccaccggctacctggtgctgaaggagctgggcatcaaggtgggcaagtacgtggccagcgaggtgtgcgaggagagcatcgccgtgggcaccgtgaagcacgagggcaacatcaagtacgtgaacgacgtgagaaacatcaccaagaagaacatcgaggagtggggccccttcgacctggtgatcggcggcagcccctgcaacgacctgagcaacgtgaaccccgccagaaagggcctgtacgagggcaccggcagactgttcttcgagttctaccacctgctgaactacagcagacccaaggagggcgacgacagacccttcttctggatgttcgagaacgtggtggccatgaaggtgggcgacaagagagacatcagcagattcctggagtgcaaccccgtgatgatcgacgccatcaaggtgagcgccgcccacagagccagatacttctggggcaacctgcccggcatgaacagaatcttcggcttccccgtgcactacaccgacgtgagcaacatgggcagaggcgccagacagaagctgctgggcagaagctggagcgtgcccgtgatcagacacctgttcgcccccctgaaggactacttcgcctgcgagtag

SEQ ID NO: 79466 - DNA, 2085 bp, Artificial Sequence
  Description of Artificial Sequence: Synthetic coding sequence
atgaagggcgacaccagacacctgaacggcgaggaggacgccggcggcagagaggacagcatcctggtgaacggcgcctgcagcgaccagagcagcgacagcccccccatcctggaggccatcagaacccccgagatcagaggcagaagaagcagcagcagactgagcaagagagaggtgagcagcctgctgagctacacccagagcctgagaagaagagccaccgccagcgccggcaccccctggcccagcccccccagcagctacctgaccatcgacctgaccgacgacaccgaggacacccacggcaccccccagagcagcagcaccccctacgccagactggcccaggacagccagcagggcggcatggagagcccccaggtggaggccgacagcggcgacggcgacagcagcgagtaccaggacggcaaggagttcggcatcggcgacctggtgtggggcaagatcaagggcttcagctggtggcccgccatggtggtgagctggaaggccaccagcaagagacaggccatgagcggcatgagatgggtgcagtggttcggcgacggcaagttcagcgaggtgagcgccgacaagctggtggccctgggcctgttcagccagcacttcaacctggccaccttcaacaagctggtgagctacagaaaggccatgtaccacgccctggagaaggccagagtgagagccggcaagaccttccccagcagccccggcgacagcctggaggaccagctgaagcccatgctggagtgggcccacggcggcttcaagcccaccggcatcgagggcctgaagcccaacaacacccagcccgagaacaagaccagaagaagaaccgccgacgacagcgccaccagcgactactgccccgcccccaagagactgaagaccaactgctacaacaacggcaaggacagaggcgacgaggaccagagcagagagcagatggccagcgacgtggccaacaacaagagcagcctggaggacggctgcctgagctgcggcagaaagaaccccgtgagcttccaccccctgttcgagggcggcctgtgccagacctgcagagacagattcctggagctgttctacatgtacgacgacgacggctaccagagctactgcaccgtgtgctgcgagggcagagagctgctgctgtgcagcaacaccagctgctgcagatgcttctgcgtggagtgcctggaggtgctggtgggcaccggcaccgccgccgaggccaagctgcaggagccctggagctgctacatgtgcctgccccagagatgccacggcgtgctgagaagaagaaaggactggaacgtgagactgcaggccttcttcaccagcgacaccggcctggagtacgaggcccccaagctgtaccccgccatccccgccgccagaagaagacccatcagagtgctgagcctgttcgacggcatcgccaccggctacctggtgctgaaggagctgggcatcaaggtgggcaagtacgtggccagcgaggtgtgcgaggagagcatcgccgtgggcaccgtgaagcacgagggcaacatcaagtacgtgaacgacgtgagaaacatcaccaagaagaacatcgaggagtggggccccttcgacctggtgatcggcggcagcccctgcaacgacctgagcaacgtgaaccccgccagaaagggcctgtacgagggcaccggcagactgttcttcgagttctaccacctgctgaactacagcagacccaaggagggcgacgacagacccttcttctggatgttcgagaacgtggtggccatgaaggtgggcgacaagagagacatcagcagattcctggagtgcaaccccgtgatgatcgacgccatcaaggtgagcgccgcccacagagccagatacttctggggcaacctgcccggcatgaacagaatcttcggcttccccgtgcactacaccgacgtgagcaacatgggcagaggcgccagacagaagctgctgggcagaagctggagcgtgcccgtgatcagacacctgttcgcccccctgaaggactacttcgcctgcgagtag

SEQ ID NO: 79467 - DNA, 1701 bp, Artificial Sequence
  Description of Artificial Sequence: Synthetic coding sequence
ggcagaagccccagaggcagaagcgagagaccccccaccgacggcaccggcagcctggccgtgggcagagccggcggcaacgccgccagacccgccgccctgggcctgagcggccccagcaagcccagcagcgccatcggcgccggcgacagcagagcccagagacccgccagaccccccgccggcctgccccccgccagccccgaccccagactgagaagacccgccgccccccagcccgccctgagacaggagagcatgaagggcgacaccagacacctgaacggcgaggaggacgccggcggcagagaggacagcatcctggtgaacggcgcctgcagcgaccagagcagcgacagcccccccatcctggaggccatcagaacccccgagatcagaggcagaagaagcagcagcagactgagcaagagagaggtgagcagcctgctgagctacacccaggacctgaccggcgacggcgacggcgaggacggcgacggcagcgacacccccgtgatgcccaagctgttcagagagaccagaaccagaagcgagagccccgccgtgagaaccagaaacaacaacagcgtgagcagcagagagagacacagacccagccccagaagcaccagaggcagacagggcagaaaccacgtggacgagagccccgtggagttccccgccaccagaagcctgagaagaagagccaccgccagcgccggcaccccctggcccagcccccccagcagctacctgaccatcgacctgaccgacgacaccgaggacacccacggcaccccccagagcagcagcaccccctacgccagactggcccaggacagccagcagggcggcatggagagcccccaggtggaggccgacagcggcgacggcgacagcagcgagtaccaggacggcaaggagttcggcatcggcgacctggtgtggggcaagatcaagggcttcagctggtggcccgccatggtggtgagctggaaggccaccagcaagagacaggccatgagcggcatgagatgggtgcagtggttcggcgacggcaagttcagcgaggtgagcgccgacaagctggtggccctgggcctgttcagccagcacttcaacctggccaccttcaacaagctggtgagctacagaaaggccatgtaccacgccctggagaaggccagagtgagagccggcaagaccttccccagcagccccggcgacagcctggaggaccagctgaagcccatgctggagtgggcccacggcggcttcaagcccaccggcatcgagggcctgaagcccaacaacacccagcccgagaacaagaccagaagaagaaccgccgacgacagcgccaccagcgactactgccccgcccccaagagactgaagaccaactgctacaacaacggcaaggacagaggcgacgaggaccagagcagagagcagatggccagcgacgtggccaacaacaagagcagcctggaggacggctgcctgagctgcggcagaaagaaccccgtgagcttccaccccctgttcgagggcggcctgtgccagacctgcagacacctgtgcggcgacagcgtgaagcccacccaccccagctgcctggccctgtgcctgtggggcagaatgggcgacagctgccacagaggccagtggcacgccggccacagccagctgagcttctag

SEQ ID NO: 79468 - DNA, 1164 bp, Artificial Sequence
  Description of Artificial Sequence: Synthetic coding sequence
atggccgccatccccgccctggaccccgaggccgagcccagcatggacgtgatcctggtgggcagcagcgagctgagcagcagcgtgagccccggcaccggcagagacctgatcgcctacgaggtgaaggccaaccagagaaacatcgaggacatctgcatctgctgcggcagcctgcaggtgcacacccagcaccccctgttcgagggcggcatctgcgccccctgcaaggacaagttcctggacgccctgttcctgtacgacgacgacggctaccagagctactgcagcatctgctgcagcggcgagaccctgctgatctgcggcaaccccgactgcaccagatgctactgcttcgagtgcgtggacagcctggtgggccccggcaccagcggcaaggtgcacgccatgagcaactgggtgtgctacctgtgcctgcccagcagcagaagcggcctgctgcagagaagaagaaagtggagaagccagctgaaggccttctacgacagagagagcgagaaccccctggagatgttcgagaccgtgcccgtgtggagaagacagcccgtgagagtgctgagcctgttcgaggacatcaagaaggagctgaccagcctgggcttcctggagagcggcagcgaccccggccagctgaagcacgtggtggacgtgaccgacaccgtgagaaaggacgtggaggagtggggccccttcgacctggtgtacggcgccaccccccccctgggccacacctgcgacagaccccccagctggtacctgttccagttccacagactgctgcagtacgccagacccaagcccggcagccccagacccttcttctggatgttcgtggacaacctggtgctgaacaaggaggacctggacgtggccagcagattcctggagatggagcccgtgaccatccccgacgtgcacggcggcagcctgcagaacgccgtgagagtgtggagcaacatccccgccatcagaagcagcagacactgggccctggtgagcgaggaggagctgagcctgctggcccagaacaagcagagcagcaagctggccgccaagtggcccaccaagctggtgaagaactgcttcctgcccctgagagagtacttcaagtacttcagcaccgagctgaccagcagcctgtag

SEQ ID NO: 79469 - DNA, 1161 bp, Artificial Sequence
  Description of Artificial Sequence: Synthetic coding sequence
atggccgccatccccgccctggaccccgaggccgagcccagcatggacgtgatcctggtgggcagcagcgagctgagcagcagcgtgagccccggcaccggcagagacctgatcgcctacgaggtgaaggccaaccagagaaacatcgaggacatctgcatctgctgcggcagcctgcaggtgcacacccagcaccccctgttcgagggcggcatctgcgccccctgcaaggacaagttcctggacgccctgttcctgtacgacgacgacggctaccagagctactgcagcatctgctgcagcggcgagaccctgctgatctgcggcaaccccgactgcaccagatgctactgcttcgagtgcgtggacagcctggtgggccccggcaccagcggcaaggtgcacgccatgagcaactgggtgtgctacctgtgcctgcccagcagcagaagcggcctgctgcagagaagaagaaagtggagaagccagctgaaggccttctacgacagagagagcgagaaccccctggagatgttcgagaccgtgcccgtgtggagaagacagcccgtgagagtgctgagcctgttcgaggacatcaagaaggagctgaccagcctgggcttcctggagagcggcagcgaccccggccagctgaagcacgtggtggacgtgaccgacaccgtgagaaaggacgtggaggagtggggccccttcgacctggtgtacggcgccaccccccccctgggccacacctgcgacagaccccccagctggtacctgttccagttccacagactgctgcagtacgccagacccaagcccggcagccccagacccttcttctggatgttcgtggacaacctggtgctgaacaaggaggacctggacgtggccagcagattcctggagatggagcccgtgaccatccccgacgtgcacggcggcagcctgcagaacgccgtgagagtgtggagcaacatccccgccatcagaagcagacactgggccctggtgagcgaggaggagctgagcctgctggcccagaacaagcagagcagcaagctggccgccaagtggcccaccaagctggtgaagaactgcttcctgcccctgagagagtacttcaagtacttcagcaccgagctgaccagcagcctgtag

SEQ ID NO: 79470 - DNA, 3123 bp, Artificial Sequence
  Description of Artificial Sequence: Synthetic coding sequence
atgctggaggacatcagcgaggaggacatctgggagtacaagagcaagagaaagcccaagagagtggaccccaacaacggcagcaagaacatcctgaagagcgtggagaaggccaccgacggcaagtaccagagcaagagaagcagaaacagaaagagagccgccgaggccaaggaggtgaaggaccacgaggtgcccctgggcaacgccggctgccagaccagcgtggccagcagccagaacagcagctgcggcgacggcatccagcagacccaggacaaggagaccacccccggcaagctgtgcagaacccagaagagccagcacgtgagccccaagatcagacccgtgtacgacggctactgccccaactgccagatgcccttcagcagcctgatcggccagacccccagatggcacgtgttcgagtgcctggacagcccccccagaagcgagaccgagtgccccgacggcctgctgtgcaccagcaccatccccttccactacaagagatacacccacttcctgctggcccagagcagagccggcgaccaccccttcagcagccccagccccgccagcggcggcagcttcagcgagaccaagagcggcgtgctgtgcagcctggaggagagatggagcagctaccagaaccagaccgacaacagcgtgagcaacgaccccctgctgatgacccagtacttcaagaagagccccagcctgaccgaggccagcgagaagatcagcacccacatccagaccagccagcaggccctgcagttcaccgacttcgtggagaacgacaagctggtgggcgtggccctgagactggccaacaacagcgagcacatcaacctgcccctgcccgagaacgacttcagcgactgcgagatcagctacagccccctgcagagcgacgaggacacccacgacatcgacgagaagcccgacgacagccaggagcagctgttcttcaccgagagcagcaaggacggcagcctggaggaggacgacgacagctgcggcttcttcaagaagagacacggccccctgctgaaggaccaggacgagagctgccccaaggtgaacagcttcctgaccagagacaagtacgacgagggcctgtacagattcaacagcctgaacgacctgagccagcccatcagccagaacaacgagagcaccctgccctacgacctggcctgcaccggcggcgacttcgtgctgttcccccccgccctggccggcaagctggccgccagcgtgcaccaggccaccaaggccaagcccgacgagcccgagttccacagcgcccagagcaacaagcagaagcaggtgatcgaggagagcagcgtgtacaaccaggtgagcctgcccctggtgaagagcctgatgctgaagcccttcgagagccaggtggagggctacctgagcagccagcccacccagaacaccatcagaaagctgagcagcgagaacctgaacgccaagaacaacaccaacagcgcctgcttctgcagaaaggccctggagggcgtgcccgtgggcaaggccaccatcctgaacaccgagaacctgagcagcacccccgcccccaagtacctgaagatcctgcccagcggcctgaagtacaacgccagacaccccagcaccaaggtgatgaagcagatggacatcggcgtgtacttcggcctgccccccaagagaaaggaggagaagctgctgggcgagagcgccctggagggcatcaacctgaaccccgtgcccagccccaaccagaagagaagcagccagtgcaagagaaaggccgagaagagcctgagcgacctggagttcgacgccagcaccctgcacgagagccagctgagcgtggagctgagcagcgagagaagccagagacagaagaagagatgcagaaagagcaacagcctgcaggagggcgcctgccagaagagaagcgaccacctgatcaacaccgagagcgaggccgtgaacctgagcaaggtgaaggtgttcaccaagagcgcccacggcggcctgcagagaggcaacaagaagatccccgagagcagcaacgtgggcggcagcagaaagaagacctgccccttctacaagaagatccccggcaccggcttcaccgtggacgccttccagtacggcgtggtggagggctgcaccgcctacttcctgacccacttccacagcgaccactacgccggcctgagcaagcacttcaccttccccgtgtactgcagcgagatcaccggcaacctgctgaagaacaagctgcacgtgcaggagcagtacatccaccccctgcccctggacaccgagtgcatcgtgaacggcgtgaaggtggtgctgctggacgccaaccactgccccggcgccgtgatgatcctgttctacctgcccaacggcaccgtgatcctgcacaccggcgacttcagagccgaccccagcatggagagaagcctgctggccgaccagaaggtgcacatgctgtacctggacaccacctactgcagccccgagtacaccttccccagccagcaggaggtgatcagattcgccatcaacaccgccttcgaggccgtgaccctgaacccccacgccctggtggtgtgcggcacctacagcatcggcaaggagaaggtgttcctggccatcgccgacgtgctgggcagcaaggtgggcatgagccaggagaagtacaagaccctgcagtgcctgaacatccccgagatcaacagcctgatcaccaccgacatgtgcagcagcctggtgcacctgctgcccatgatgcagatcaacttcaagggcctgcagagccacctgaagaagtgcggcggcaagtacaaccagatcctggccttcagacccaccggctggacccacagcaacaagttcaccagaatcgccgacgtgatcccccagaccaagggcaacatcagcatctacggcatcccctacagcgagcacagcagctacctggagatgaagagattcgtgcagtggctgaagccccagaagatcatccccaccgtgaacgtgggcacctggaagagcagaagcaccatggagaagtacttcagagagtggaagctggaggccggctactag

SEQ ID NO: 79471 - DNA, 3123 bp, Artificial Sequence; identical to SEQ ID NO: 79470
  Description of Artificial Sequence: Synthetic coding sequence

SEQ ID NO: 79472 - DNA, 813 bp, Artificial Sequence
  Description of Artificial Sequence: Synthetic coding sequence
atgctgcagaagcccaagagcgtgaagctgagagccctgagaagccccagaaagttcggcgtggccggcagaagctgccaggaggtgctgagaaagggctgcctgagattccagctgcccgagagaggcagcagactgtgcctgtacgaggacggcaccgagctgaccgaggactacttccccagcgtgcccgacaacgccgagctggtgctgctgaccctgggccaggcctggcagggctacgtgagcgacatcagaagattcctgagcgccttccacgagccccaggtgggcctgatccaggccgcccagcagctgctgtgcgacgagcaggccccccagagacagagactgctggccgacctgctgcacaacgtgagccagaacatcgccgccgagaccagagccgaggaccccccctggttcgagggcctggagagcagattccagagcaagagcggctacctgagatacagctgcgagagcagaatcagaagctacctgagagaggtgagcagctaccccagcaccgtgggcgccgaggcccaggaggagttcctgagagtgctgggcagcatgtgccagagactgagaagcatgcagtacaacggcagctacttcgacagaggcgccaagggcggcagcagactgtgcacccccgagggctggttcagctgccagggccccttcgacatggacagctgcctgagcagacacagcatcaacccctacagcaacagagagagcagaatcctgttcagcacctggaacctggaccacatcgacggcgtgctgctgtgcggccccggctag

SEQ ID NO: 79473 - DNA, 825 bp, Artificial Sequence
  Description of Artificial Sequence: Synthetic coding sequence
atgtgcctgctgctggacagacacctgctgttcgtgcccctggtggccgacgtgagcgacatcagaagattcctgagcgccttccacgagccccaggtgggcctgatccaggccgcccagcagctgctgtgcgacgagcaggccccccagagacagagactgctggccgacctgctgcacaacgtgagccagaacatcgccgccgagaccagagccgaggaccccccctggttcgagggcctggagagcagattccagagcaagagcggctacctgagatacagctgcgagagcagaatcagaagctacctgagagaggtgagcagctaccccagcaccgtgggcgccgaggcccaggaggagttcctgagagtgctgggcagcatgtgccagagactgagaagcatgcagtacaacggcagctacttcgacagaggcgccaagggcggcagcagactgtgcacccccgagggctggttcagctgccagggccccttcgacatggacagctgcctgagcagacacagcatcaacccctacagcaacagagagagcagaatcctgttcagcacctggaacctggaccacatcatcgagaagaagagaaccatcatccccaccctggtggaggccatcaaggagcaggacggcagagaggtggactgggagtacttctacggcctgctgttcaccagcgagaacctgaagctggtgcacatcgtgtgccacaagaagaccacccacaagctgaactgcgaccccagcagaatctacaagccccagaccagactgaagagaaagcagcccgtgagaaagagacagtag

SEQ ID NO: 79474 - DNA, 312 bp, Artificial Sequence
  Description of Artificial Sequence: Synthetic coding sequence
atgctgcagaagcccaagagcgtgaagctgagagccctgagaagccccagaaagttcggcgtggccggcagaagctgccaggaggtgctgagaaagggctgcctgagattccagctgcccgagagaggcagcagactgtgcctgtacgaggacggcaccgagctgaccgaggactacttccccagcgtgcccgacaacgccgagctggtgctgctgaccctgggccaggcctggcagggctggttcagacacgtgagccaggacagcctgaccctgctgggcagcagctgcccccccgccctggtgagctag

SEQ ID NO: 79475 - DNA, 825 bp, Artificial Sequence; identical to SEQ ID NO: 79473
  Description of Artificial Sequence: Synthetic coding sequence

SEQ ID NO: 79476 - DNA, 1017 bp, Artificial Sequence
  Description of Artificial Sequence: Synthetic coding sequence
atgctgcagaagcccaagagcgtgaagctgagagccctgagaagccccagaaagttcggcgtggccggcagaagctgccaggaggtgctgagaaagggctgcctgagattccagctgcccgagagaggcagcagactgtgcctgtacgaggacggcaccgagctgaccgaggactacttccccagcgtgcccgacaacgccgagctggtgctgctgaccctgggccaggcctggcagggctacgtgagcgacatcagaagattcctgagcgccttccacgagccccaggtgggcctgatccaggccgcccagcagctgctgtgcgacgagcaggccccccagagacagagactgctggccgacctgctgcacaacgtgagccagaacatcgccgccgagaccagagccgaggaccccccctggttcgagggcctggagagcagattccagagcaagagcggctacctgagatacagctgcgagagcagaatcagaagctacctgagagaggtgagcagctaccccagcaccgtgggcgccgaggcccaggaggagttcctgagagtgctgggcagcatgtgccagagactgagaagcatgcagtacaacggcagctacttcgacagaggcgccaagggcggcagcagactgtgcacccccgagggctggttcagctgccagggccccttcgacatggacagctgcctgagcagacacagcatcaacccctacagcaacagagagagcagaatcctgttcagcacctggaacctggaccacatcatcgagaagaagagaaccatcatccccaccctggtggaggccatcaaggagcaggacggcagagaggtggactgggagtacttctacggcctgctgttcaccagcgagaacctgaagctggtgcacatcgtgtgccacaagaagaccacccacaagctgaactgcgaccccagcagaatctacaagccccagaccagactgaagagaaagcagcccgtgagaaagagacagtag

SEQ ID NO: 79477 - DNA, 351 bp, Artificial Sequence
  Description of Artificial Sequence: Synthetic coding sequence
atgctgcagaagcccaagagcgtgaagctgagagccctgagaagccccagaaagttcggcgtggccggcagaagctgccaggaggtgctgagaaagggctgcctgagattccagctgcccgagagaggcagcagactgtgcctgtacgaggacggcaccgagctgaccgaggactacttccccagcgtgcccgacaacgccgagctggtgctgctgaccctgggccaggcctggcagggcagcgtgggcgtgagagccagaaccaagaccagagacaccagcagcctgagccccggcgactgccaggccctgggcaacggcggcagatgcggccagagactgttcctgtag

SEQ ID NO: 79478 - DNA, 261 bp, Artificial Sequence
  Description of Artificial Sequence: Synthetic coding sequence
atgctgcagaagcccaagagcgtgaagctgagagccctgagaagccccagaaagttcggcgtggccggcagaagctgccaggaggtgctgagaaagggctgcctgagattccagctgcccgagagaggcagcagactgtgcctgtacgaggacggcaccgagctgaccgaggactacttccccagcgtgcccgacaacgccgagctggtgctgctgaccctgggccaggcctggcagggctgctggagcgccgtggcctag

SEQ ID NO: 79479 - DNA, 249 bp, Artificial Sequence
  Description of Artificial Sequence: Synthetic coding sequence
atgctgcagaagcccaagagcgtgaagctgagagccctgagaagccccagaaagttcggcgtggccggcagaagctgccaggaggtgctgagaaagggctgcctgagattccagctgcccgagagaggcagcagactgtgcctgtacgaggacggcaccgagctgaccgaggactacttccccagcgtgcccgacaacgccgagctggtgctgctgaccctgggccaggcctggcagggctgcgagtag

SEQ ID NO: 79480 - DNA, 813 bp, Artificial Sequence; identical to SEQ ID NO: 79472
  Description of Artificial Sequence: Synthetic coding sequence

SEQ ID NO: 79481 - DNA, 3183 bp, Artificial Sequence
  Description of Artificial Sequence: Synthetic coding sequence
atggagcagctgaacgagctggagctgctgatggagaagagcttctgggaggaggccgagctgcccgccgagctgttccagaagaaggtggtggccagcttccccagaaccgtgctgagcaccggcatggacaacagatacctggtgctggccgtgaacaccgtgcagaacaaggagggcaactgcgagaagagactggtgatcaccgccagccagagcctggagaacaaggagctgtgcatcctgagaaacgactggtgcagcgtgcccgtggagcccggcgacatcatccacctggagggcgactgcaccagcgacacctggatcatcgacaaggacttcggctacctgatcctgtaccccgacatgctgatcagcggcaccagcatcgccagcagcatcagatgcatgagaagagccgtgctgagcgagaccttcagaagcagcgaccccgccaccagacagatgctgatcggcaccgtgctgcacgaggtgttccagaaggccatcaacaacagcttcgcccccgagaagctgcaggagctggccttccagaccatccaggagatcagacacctgaaggagatgtacagactgaacctgagccaggacgagatcaagcaggaggtggaggactacctgcccagcttctgcaagtgggccggcgacttcatgcacaagaacaccagcaccgacttcccccagatgcagctgagcctgcccagcgacaacagcaaggacaacagcacctgcaacatcgaggtggtgaagcccatggacatcgaggagagcatctggagccccagattcggcctgaagggcaagatcgacgtgaccgtgggcgtgaagatccacagaggctacaagaccaagtacaagatcatgcccctggagctgaagaccggcaaggagagcaacagcatcgagcacagaagccaggtggtgctgtacaccctgctgagccaggagagaagagccgaccccgaggccggcctgctgctgtacctgaagaccggccagatgtaccccgtgcccgccaaccacctggacaagagagagctgctgaagctgagaaaccagatggccttcagcctgttccacagaatcagcaagagcgccaccagacagaagacccagctggccagcctgccccagatcatcgaggaggagaagacctgcaagtactgcagccagatcggcaactgcgccctgtacagcagagccgtggagcagcagatggactgcagcagcgtgcccatcgtgatgctgcccaagatcgaggaggagacccagcacctgaagcagacccacctggagtacttcagcctgtggtgcctgatgctgaccctggagagccagagcaaggacaacaagaagaaccaccagaacatctggctgatgcccgccagcgagatggagaagagcggcagctgcatcggcaacctgatcagaatggagcacgtgaagatcgtgtgcgacggccagtacctgcacaacttccagtgcaagcacggcgccatccccgtgaccaacctgatggccggcgacagagtgatcgtgagcggcgaggagagaagcctgttcgccctgagcagaggctacgtgaaggagatcaacatgaccaccgtgacctgcctgctggacagaaacctgagcgtgctgcccgagagcaccctgttcagactggaccaggaggagaagaactgcgacatcgacacccccctgggcaacctgagcaagctgatggagaacaccttcgtgagcaagaagctgagagacctgatcatcgacttcagagagccccagttcatcagctacctgagcagcgtgctgccccacgacgccaaggacaccgtggcctgcatcctgaagggcctgaacaagccccagagacaggccatgaagaaggtgctgctgagcaaggactacaccctgatcgtgggcatgcccggcaccggcaagaccaccaccatctgcaccctggtgagaatcctgtacgcctgcggcttcagcgtgctgctgaccagctacacccacagcgccgtggacaacatcctgctgaagctggccaagttcaagatcggcttcctgagactgggccagatccagaaggtgcaccccgccatccagcagttcaccgagcaggagatctgcagaagcaagagcatcaagagcctggccctgctggaggagctgtacaacagccagctgatcgtggccaccacctgcatgggcatcaaccaccccatcttcagcagaaagatcttcgacttctgcatcgtggacgaggccagccagatcagccagcccatctgcctgggccccctgttcttcagcagaagattcgtgctggtgggcgaccaccagcagctgccccccctggtgctgaacagagaggccagagccctgggcatgagcgagagcctgttcaagagactggagcagaacaagagcgccgtggtgcagctgaccgtgcagtacagaatgaacagcaagatcatgagcctgagcaacaagctgacctacgagggcaagctggagtgcggcagcgacaaggtggccaacgccgtgatcaacctgagacacttcaaggacgtgaagctggagctggagttctacgccgactacagcgacaacccctggctgatgggcgtgttcgagcccaacaaccccgtgtgcttcctgaacaccgacaaggtgcccgcccccgagcaggtggagaagggcggcgtgagcaacgtgaccgaggccaagctgatcgtgttcctgaccagcatcttcgtgaaggccggctgcagccccagcgacatcggcatcatcgccccctacagacagcagctgaagatcatcaacgacctgctggccagaagcatcggcatggtggaggtgaacaccgtggacaagtaccagggcagagacaagagcatcgtgctggtgagcttcgtgagaagcaacaaggacggcaccgtgggcgagctgctgaaggactggagaagactgaacgtggccatcaccagagccaagcacaagctgatcctgctgggctgcgtgcccagcctgaactgctacccccccctggagaagctgctgaaccacctgaacagcgagaagctgatcatcgacctgcccagcagagagcacgagagcctgtgccacatcctgggcgacttccagagagagtag

SEQ ID NO: 79482 - DNA, 2469 bp, Artificial Sequence
  Description of Artificial Sequence: Synthetic coding sequence
atggagcagctgaacgagctggagctgctgatggagaagagcttctgggaggaggccgagctgcccgccgagctgttccagaagaaggtggtggccagcttccccagaaccgtgctgagcaccggcatggacaacagatacctggtgctggccgtgaacaccgtgcagaacaaggagggcaactgcgagaagagactggtgatcaccgccagccagagcctggagaacaaggagctgtgcatcctgagaaacgactggtgcagcgtgcccgtggagcccggcgacatcatccacctggagggcgactgcaccagcgacacctggatcatcgacaaggacttcggctacctgatcctgtaccccgacatgctgatcagcggcaccagcatcgccagcagcatcagatgcatgagaagagccgtgctgagcgagaccttcagaagcagcgaccccgccaccagacagatgctgatcggcaccgtgctgcacgaggtgttccagaaggccatcaacaacagcttcgcccccgagaagctgcaggagctggccttccagaccatccaggagatcagacacctgaaggagatgtacagactgaacctgagccaggacgagatcaagcaggaggtggaggactacctgcccagcttctgcaagtgggccggcgacttcatgcacaagaacaccagcaccgacttcccccagatgcagctgagcctgcccagcgacaacagcaaggacaacagcacctgcaacatcgaggtggtgaagcccatggacatcgaggagagcatctggagccccagattcggcctgaagggcaagatcgacgtgaccgtgggcgtgaagatccacagaggctacaagaccaagtacaagatcatgcccctggagctgaagaccggcaaggagagcaacagcatcgagcacagaagccaggtggtgctgtacaccctgctgagccaggagagaagagccgaccccgaggccggcctgctgctgtacctgaagaccggccagatgtaccccgtgcccgccaaccacctggacaagagagagctgctgaagctgagaaaccagatggccttcagcctgttccacagaatcagcaagagcgccaccagacagaagacccagctggccagcctgccccagatcatcgaggaggagaagacctgcaagtactgcagccagatcggcaactgcgccctgtacagcagagccgtggagcagcagatggactgcagcagcgtgcccatcgtgatgctgcccaagatcgaggaggagacccagcacctgaagcagacccacctggagtacttcagcctgtggtgcctgatgctgaccctggagagccagagcaaggacaacaagaagaaccaccagaacatctggctgatgcccgccagcgagatggagaagagcggcagctgcatcggcaacctgatcagaatggagcacgtgaagatcgtgtgcgacggccagtacctgcacaacttccagtgcaagcacggcgccatccccgtgaccaacctgatggccggcgacagagtgatcgtgagcggcgaggagagaagcctgttcgccctgagcagaggctacgtgaaggagatcaacatgaccaccgtgacctgcctgctggacagaaacctgagcgtgctgcccgagagcaccctgttcagactggaccaggaggagaagaactgcgacatcgacacccccctgggcaacctgagcaagctgatggagaacaccttcgtgagcaagaagctgagagacctgatcatcgacttcagagagccccagttcatcagctacctgagcagcgtgctgccccacgacgccaaggacaccgtggcctgcatcctgaagggcctgaacaagccccagagacaggccatgaagaaggtgctgctgagcaaggactacaccctgatcgtgggcatgcccggcaccggcaagaccaccaccatctgcaccctggtgcccgcccccgagcaggtggagaagggcggcgtgagcaacgtgaccgaggccaagctgatcgtgttcctgaccagcatcttcgtgaaggccggctgcagccccagcgacatcggcatcatcgccccctacagacagcagctgaagatcatcaacgacctgctggccagaagcatcggcatggtggaggtgaacaccgtggacaagtaccagggcagagacaagagcatcgtgctggtgagcttcgtgagaagcaacaaggacggcaccgtgggcgagctgctgaaggactggagaagactgaacgtggccatcaccagagccaagcacaagctgatcctgctgggctgcgtgcccagcctgaactgctacccccccctggagaagctgctgaaccacctgaacagcgagaagctgatcatcgacctgcccagcagagagcacgagagcctgtgccacatcctgggcgacttccagagagagtag

SEQ ID NO: 79483 - DNA, 3441 bp, Artificial Sequence
  Description of Artificial Sequence: Synthetic coding sequence
atgaagaccccctgcatccccagccccaagcagggcagcaagggcagaggccagagccccgccgcccaggtgagaggccccacctggaacgcccccgccagagagggcagacccggcgccggccacctgggccacctgagagtgggcgcctgcgccagaggcgcccaggccagagccttcttccccttcctgagcttcctgtgctaccccagattcagatgcctgttctgcctgcagttcgccatccccgccagcagaatggagcagctgaacgagctggagctgctgatggagaagagcttctgggaggaggccgagctgcccgccgagctgttccagaagaaggtggtggccagcttccccagaaccgtgctgagcaccggcatggacaacagatacctggtgctggccgtgaacaccgtgcagaacaaggagggcaactgcgagaagagactggtgatcaccgccagccagagcctggagaacaaggagctgtgcatcctgagaaacgactggtgcagcgtgcccgtggagcccggcgacatcatccacctggagggcgactgcaccagcgacacctggatcatcgacaaggacttcggctacctgatcctgtaccccgacatgctgatcagcggcaccagcatcgccagcagcatcagatgcatgagaagagccgtgctgagcgagaccttcagaagcagcgaccccgccaccagacagatgctgatcggcaccgtgctgcacgaggtgttccagaaggccatcaacaacagcttcgcccccgagaagctgcaggagctggccttccagaccatccaggagatcagacacctgaaggagatgtacagactgaacctgagccaggacgagatcaagcaggaggtggaggactacctgcccagcttctgcaagtgggccggcgacttcatgcacaagaacaccagcaccgacttcccccagatgcagctgagcctgcccagcgacaacagcaaggacaacagcacctgcaacatcgaggtggtgaagcccatggacatcgaggagagcatctggagccccagattcggcctgaagggcaagatcgacgtgaccgtgggcgtgaagatccacagaggctacaagaccaagtacaagatcatgcccctggagctgaagaccggcaaggagagcaacagcatcgagcacagaagccaggtggtgctgtacaccctgctgagccaggagagaagagccgaccccgaggccggcctgctgctgtacctgaagaccggccagatgtaccccgtgcccgccaaccacctggacaagagagagctgctgaagctgagaaaccagatggccttcagcctgttccacagaatcagcaagagcgccaccagacagaagacccagctggccagcctgccccagatcatcgaggaggagaagacctgcaagtactgcagccagatcggcaactgcgccctgtacagcagagccgtggagcagcagatggactgcagcagcgtgcccatcgtgatgctgcccaagatcgaggaggagacccagcacctgaagcagacccacctggagtacttcagcctgtggtgcctgatgctgaccctggagagccagagcaaggacaacaagaagaaccaccagaacatctggctgatgcccgccagcgagatggagaagagcggcagctgcatcggcaacctgatcagaatggagcacgtgaagatcgtgtgcgacggccagtacctgcacaacttccagtgcaagcacggcgccatccccgtgaccaacctgatggccggcgacagagtgatcgtgagcggcgaggagagaagcctgttcgccctgagcagaggctacgtgaaggagatcaacatgaccaccgtgacctgcctgctggacagaaacctgagcgtgctgcccgagagcaccctgttcagactggaccaggaggagaagaactgcgacatcgacacccccctgggcaacctgagcaagctgatggagaacaccttcgtgagcaagaagctgagagacctgatcatcgacttcagagagccccagttcatcagctacctgagcagcgtgctgccccacgacgccaaggacaccgtggcctgcatcctgaagggcctgaacaagccccagagacaggccatgaagaaggtgctgctgagcaaggactacaccctgatcgtgggcatgcccggcaccggcaagaccaccaccatctgcaccctggtgagaatcctgtacgcctgcggcttcagcgtgctgctgaccagctacacccacagcgccgtggacaacatcctgctgaagctggccaagttcaagatcggcttcctgagactgggccagatccagaaggtgcaccccgccatccagcagttcaccgagcaggagatctgcagaagcaagagcatcaagagcctggccctgctggaggagctgtacaacagccagctgatcgtggccaccacctgcatgggcatcaaccaccccatcttcagcagaaagatcttcgacttctgcatcgtggacgaggccagccagatcagccagcccatctgcctgggccccctgttcttcagcagaagattcgtgctggtgggcgaccaccagcagctgccccccctggtgctgaacagagaggccagagccctgggcatgagcgagagcctgttcaagagactggagcagaacaagagcgccgtggtgcagctgaccgtgcagtacagaatgaacagcaagatcatgagcctgagcaacaagctgacctacgagggcaagctggagtgcggcagcgacaaggtggccaacgccgtgatcaacctgagacacttcaaggacgtgaagctggagctggagttctacgccgactacagcgacaacccctggctgatgggcgtgttcgagcccaacaaccccgtgtgcttcctgaacaccgacaaggtgcccgcccccgagcaggtggagaagggcggcgtgagcaacgtgaccgaggccaagctgatcgtgttcctgaccagcatcttcgtgaaggccggctgcagccccagcgacatcggcatcatcgccccctacagacagcagctgaagatcatcaacgacctgctggccagaagcatcggcatggtggaggtgaacaccgtggacaagtaccagggcagagacaagagcatcgtgctggtgagcttcgtgagaagcaacaaggacggcaccgtgggcgagctgctgaaggactggagaagactgaacgtggccatcaccagagccaagcacaagctgatcctgctgggctgcgtgcccagcctgaactgctacccccccctggagaagctgctgaaccacctgaacagcgagaagctgatcatcgacctgcccagcagagagcacgagagcctgtgccacatcctgggcgacttccagagagagtag

SEQ ID NO: 79484 - DNA, 717 bp, Artificial Sequence
  Description of Artificial Sequence: Synthetic coding sequence
atgctgtgcttcctgagaggcatggccttcgtgcccttcctgctggtgacctggagcagcgccgccttcatcatcagctacgtggtggccgtgctgagcggccacgtgaaccccttcctgccctacatcagcgacaccggcaccaccccccccgagagcggcatcttcggcttcatgatcaacttcagcgccttcctgggcgccgccaccatgtacaccagatacaagatcgtgcagaagcagaaccagacctgctacttcagcacccccgtgttcaacctggtgagcctggtgctgggcctggtgggctgcttcggcatgggcatcgtggccaacttccaggagctggccgtgcccgtggtgcacgacggcggcgccctgctggccttcgtgtgcggcgtggtgtacaccctgctgcagagcatcatcagctacaagagctgcccccagtggaacagcctgagcacctgccacatcagaatggtgatcagcgccgtgagctgcgccgccgtgatccccatgatcgtgtgcgccagcctgatcagcatcaccaagctggagtggaaccccagagagaaggactacgtgtaccacgtggtgagcgccatctgcgagtggaccgtggccttcggcttcatcttctacttcctgaccttcatccaggacttccagagcgtgaccctgagaatcagcaccgagatcaacggcgacatctag

SEQ ID NO: 79485 - DNA, 801 bp, Artificial Sequence
  Description of Artificial Sequence: Synthetic coding sequence
atgtggtggttccagcagggcctgagcttcctgcccagcgccctggtgatctggaccagcgccgccttcatcttcagctacatcaccgccgtgaccctgcaccacatcgaccccgccctgccctacatcagcgacaccggcaccgtggcccccgagaagtgcctgttcggcgccatgctgaacatcgccgccgtgctgtgcatcgccaccatctacgtgagatacaagcaggtgcacgccctgagccccgaggagaacgtgatcatcaagctgaacaaggccggcctggtgctgggcatcctgagctgcctgggcctgagcatcgtggccaacttccagaagaccaccctgttcgccgcccacgtgagcggcgccgtgctgaccttcggcatgggcagcctgtacatgttcgtgcagaccatcctgagctaccagatgcagcccaagatccacggcaagcaggtgttctggatcagactgctgctggtgatctggtgcggcgtgagcgccctgagcatgctgacctgcagcagcgtgctgcacagcggcaacttcggcaccgacctggagcagaagctgcactggaaccccgaggacaagggctacgtgctgcacatgatcaccaccgccgccgagtggagcatgagcttcagcttcttcggcttcttcctgacctacatcagagacttccagaagatcagcctgagagtggaggccaacctgcacggcctgaccctgtacgacaccgccccctgccccatcaacaacgagagaaccagactgctgagcagagacatctag

SEQ ID NO: 79486 - DNA, 801 bp, Artificial Sequence; identical to SEQ ID NO: 79485
  Description of Artificial Sequence: Synthetic coding sequence

SEQ ID NO: 79487 - DNA, 699 bp, Artificial Sequence
  Description of Artificial Sequence: Synthetic coding sequence
atgcccagcctgtgggacagattcagcagcagcagcaccagcagcagccccagcagcctgcccagaacccccacccccgacagaccccccagaagcgcctggggcagcgccaccagagaggagggcttcgacagaagcaccagcctggagagcagcgactgcgagagcctggacagcagcaacagcggcttcggccccgaggaggacaccgcctacctggacggcgtgagcctgcccgacttcgagctgctgagcgaccccgaggacgagcacctgtgcgccaacctgatgcagctgctgcaggagagcctggcccaggccagactgggcagcagaagacccgccagactgctgatgcccagccagctggtgagccaggtgggcaaggagctgctgagactggcctacagcgagccctgcggcctgagaggcgccctgctggacgtgtgcgtggagcagggcaagagctgccacagcgtgggccagctggccctggaccccagcctggtgcccaccttccagctgaccctggtgctgagactggacagcagactgtggcccaagatccagggcctgttcagcagcgccaacagccccttcctgcccggcttcagccagagcctgaccctgagcaccggcttcagagtgatcaagaagaagctgtacagcagcgagcagctgctgatcgaggagtgctag

SEQ ID NO: 79488 - DNA, 582 bp, Artificial Sequence
  Description of Artificial Sequence: Synthetic coding sequence
atggtggccaccggcagcctgagcagcaagaaccccgccagcatcagcgagctgctggactgcggctaccaccccgagagcctgctgagcgacttcgactactgggactacgtggtgcccgagcccaacctgaacgaggtgatcttcgaggagagcacctgccagaacctggtgaagatgctggagaactgcctgagcaagagcaagcagaccaagctgggctgcagcaaggtgctggtgcccgagaagctgacccagagaatcgcccaggacgtgctgagactgagcagcaccgagccctgcggcctgagaggctgcgtgatgcacgtgaacctggagatcgagaacgtgtgcaagaagctggacagaatcgtgtgcgacagcagcgtggtgcccaccttcgagctgaccctggtgttcaagcaggagaactgcagctggaccagcttcagagacttcttcttcagcagaggcagattcagcagcggcttcagaagaaccctgatcctgagcagcggcttcagactggtgaagaagaagctgtacagcctgatcggcaccaccgtgatcgagggcagctag

SEQ ID NO: 79489 - DNA, 534 bp, Artificial Sequence
  Description of Artificial Sequence: Synthetic coding sequence
atggtggccaccggcagcctgagcagcaagaaccccgccagcatcagcgagctgctggactgcggctaccaccccgagagcctgctgagcgacttcgactactgggactacgtggtgcccgagcccaacctgaacgaggtgatcttcgaggagagcacctgccagaacctggtgaagatgctggagaactgcctgagcaagagcaagcagaccaagctgggctgcagcaaggtgctggtgcccgagaagctgacccagagaatcgcccaggacgtgctgagactgagcagcaccgagccctgcggcctgagaggctgcgtgatgcacgtgaacctggagatcgagaacgtgtgcaagaagctggacagaatcgtgtgcgacagcagcgtggtgcccaccttcgagctgaccctggtgttcaagcaggagaactgcagctggaccagcttcagagacttcttcttcagcagaggcagattcagcagcggcttcagaagaaccctgatcctgagcagcggcttcagactggtgtag

SEQ ID NO: 79490 - DNA, 387 bp, Artificial Sequence
  Description of Artificial Sequence: Synthetic coding sequence
atggtggccaccggcagcctgagcagcaagaaccccgccagcatcagcgagctgctggactgcggctaccaccccgagagcctgctgagcgacttcgactactgggactacgtggtgcccgagcccaacctgaacgaggtgatcttcgaggagagcacctgccagaacctggtgaagatgctggagaactgcctgagcaagagcaagcagaccaagctgggctgcagcaaggtgctggtgcccgagaagctgacccagagaatcgcccaggacgtgctgagactgagcagcaccgagccctgcggcctgagaggctgcgtgatgcacgtgaacctggagatcgagaacgtgtgcaagaagctggacagaatcgtgtgcgacagctag

SEQ ID NO: 79491 - DNA, 1239 bp, Artificial Sequence
  Description of Artificial Sequence: Synthetic coding sequence
atggccaacgtggccgacaccaagctgtacgacatcctgggcgtgccccccggcgccagcgagaacgagctgaagaaggcctacagaaagctggccaaggagtaccaccccgacaagaaccccaacgccggcgacaagttcaaggagatcagcttcgcctacgaggtgctgagcaaccccgagaagagagagctgtacgacagatacggcgagcagggcctgagagagggcagcggcggcggcggcggcatggacgacatcttcagccacatcttcggcggcggcctgttcggcttcatgggcaaccagagcagaagcagaaacggcagaagaagaggcgaggacatgatgcaccccctgaaggtgagcctggaggacctgtacaacggcaagaccaccaagctgcagctgagcaagaacgtgctgtgcagcgcctgcagcggccagggcggcaagagcggcgccgtgcagaagtgcagcgcctgcagaggcagaggcgtgagaatcatgatcagacagctggcccccggcatggtgcagcagatgcagagcgtgtgcagcgactgcaacggcgagggcgaggtgatcaacgagaaggacagatgcaagaagtgcgagggcaagaaggtgatcaaggaggtgaagatcctggaggtgcacgtggacaagggcatgaagcacggccagagaatcaccttcaccggcgaggccgaccaggcccccggcgtggagcccggcgacatcgtgctgctgctgcaggagaaggagcacgaggtgttccagagagacggcaacgacctgcacatgacctacaagatcggcctggtggaggccctgtgcggcttccagttcaccttcaagcacctggacggcagacagatcgtggtgaagtacccccccggcaaggtgatcgagcccggctgcgtgagagtggtgagaggcgagggcatgccccagtacagaaaccccttcgagaagggcgacctgtacatcaagttcgacgtgcagttccccgagaacaactggatcaaccccgacaagctgagcgagctggaggacctgctgcccagcagacccgaggtgcccaacatcatcggcgagaccgaggaggtggagctgcaggagttcgacagcaccagaggcagcggcggcggccagagaagagaggcctacaacgacagcagcgacgaggagagcagcagccaccacggccccggcgtgcagtgcgcccaccagtag

SEQ ID NO: 79492 - DNA, 1443 bp, Artificial Sequence
  Description of Artificial Sequence: Synthetic coding sequence
atggccgccagatgcagcaccagatggctgctggtggtggtgggcacccccagactgcccgccatcagcggcagaggcgccagaccccccagagagggcgtggtgggcgcctggctgagcagaaagctgagcgtgcccgccttcgccagcagcctgaccagctgcggccccagagccctgctgaccctgagacccggcgtgagcctgaccggcaccaagcacaaccccttcatctgcaccgccagcttccacaccagcgcccccctggccaaggaggactactaccagatcctgggcgtgcccagaaacgccagccagaaggagatcaagaaggcctactaccagctggccaagaagtaccaccccgacaccaacaaggacgaccccaaggccaaggagaagttcagccagctggccgaggcctacgaggtgctgagcgacgaggtgaagagaaagcagtacgacgcctacggcagcgccggcttcgaccccggcgccagcggcagccagcacagctactggaagggcggccccaccgtggaccccgaggagctgttcagaaagatcttcggcgagttcagcagcagcagcttcggcgacttccagaccgtgttcgaccagccccaggagtacttcatggagctgaccttcaaccaggccgccaagggcgtgaacaaggagttcaccgtgaacatcatggacacctgcgagagatgcaacggcaagggcaacgagcccggcaccaaggtgcagcactgccactactgcggcggcagcggcatggagaccatcaacaccggccccttcgtgatgagaagcacctgcagaagatgcggcggcagaggcagcatcatcatcagcccctgcgtggtgtgcagaggcgccggccaggccaagcagaagaagagagtgatgatccccgtgcccgccggcgtggaggacggccagaccgtgagaatgcccgtgggcaagagagagatcttcatcaccttcagagtgcagaagagccccgtgttcagaagagacggcgccgacatccacagcgacctgttcatcagcatcgcccaggccctgctgggcggcaccgccagagcccagggcctgtacgagaccatcaacgtgaccatcccccccggcacccagaccgaccagaagatcagaatgggcggcaagggcatccccagaatcaacagctacggctacggcgaccactacatccacatcaagatcagagtgcccaagagactgaccagcagacagcagagcctgatcctgagctacgccgaggacgagaccgacgtggagggcaccgtgaacggcgtgaccctgaccagcagcggcggcagcaccatggacagcagcgccggcagcaaggccagaagagaggccggcgaggacgaggagggcttcctgagcaagctgaagaagatgttcaccagctag

SEQ ID NO: 79493 - DNA, 1362 bp, Artificial Sequence
  Description of Artificial Sequence: Synthetic coding sequence
atggccgccagatgcagcaccagatggctgctggtggtggtgggcacccccagactgcccgccatcagcggcagaggcgccagaccccccagagagggcgtggtgggcgcctggctgagcagaaagctgagcgtgcccgccttcgccagcagcctgaccagctgcggccccagagccctgctgaccctgagacccggcgtgagcctgaccggcaccaagcacaaccccttcatctgcaccgccagcttccacaccagcgcccccctggccaaggaggactactaccagatcctgggcgtgcccagaaacgccagccagaaggagatcaagaaggcctactaccagctggccaagaagtaccaccccgacaccaacaaggacgaccccaaggccaaggagaagttcagccagctggccgaggcctacgaggtgctgagcgacgaggtgaagagaaagcagtacgacgcctacggcagcgccggcttcgaccccggcgccagcggcagccagcacagctactggaagggcggccccaccgtggaccccgaggagctgttcagaaagatcttcggcgagttcagcagcagcagcttcggcgacttccagaccgtgttcgaccagccccaggagtacttcatggagctgaccttcaaccaggccgccaagggcgtgaacaaggagttcaccgtgaacatcatggacacctgcgagagatgcaacggcaagggcaacgagcccggcaccaaggtgcagcactgccactactgcggcggcagcggcatggagaccatcaacaccggccccttcgtgatgagaagcacctgcagaagatgcggcggcagaggcagcatcatcatcagcccctgcgtggtgtgcagaggcgccggccaggccaagcagaagaagagagtgatgatccccgtgcccgccggcgtggaggacggccagaccgtgagaatgcccgtgggcaagagagagatcttcatcaccttcagagtgcagaagagccccgtgttcagaagagacggcgccgacatccacagcgacctgttcatcagcatcgcccaggccctgctgggcggcaccgccagagcccagggcctgtacgagaccatcaacgtgaccatcccccccggcacccagaccgaccagaagatcagaatgggcggcaagggcatccccagaatcaacagctacggctacggcgaccactacatccacatcaagatcagagtgcccaagagactgaccagcagacagcagagcctgatcctgagctacgccgaggacgagaccgacgtggagggcaccgtgaacggcgtgaccctgaccagcagcggcaagagaagcaccggcaactag

SEQ ID NO: 79494 - DNA, 903 bp, Artificial Sequence
  Description of Artificial Sequence: Synthetic coding sequence
atggccgagccccaggccgagagacccagactgtgcgtgttccccgacctgctgagaccccccagcgccgccgacatcgagacctggtgccagccctacagaaagatcttcggcgagttcagcagcagcagcttcggcgacttccagaccgtgttcgaccagccccaggagtacttcatggagctgaccttcaaccaggccgccaagggcgtgaacaaggagttcaccgtgaacatcatggacacctgcgagagatgcaacggcaagggcaacgagcccggcaccaaggtgcagcactgccactactgcggcggcagcggcatggagaccatcaacaccggccccttcgtgatgagaagcacctgcagaagatgcggcggcagaggcagcatcatcatcagcccctgcgtggtgtgcagaggcgccggccaggccaagcagaagaagagagtgatgatccccgtgcccgccggcgtggaggacggccagaccgtgagaatgcccgtgggcaagagagagatcttcatcaccttcagagtgcagaagagccccgtgttcagaagagacggcgccgacatccacagcgacctgttcatcagcatcgcccaggccctgctgggcggcaccgccagagcccagggcctgtacgagaccatcaacgtgaccatcccccccggcacccagaccgaccagaagatcagaatgggcggcaagggcatccccagaatcaacagctacggctacggcgaccactacatccacatcaagatcagagtgcccaagagactgaccagcagacagcagagcctgatcctgagctacgccgaggacgagaccgacgtggagggcaccgtgaacggcgtgaccctgaccagcagcggcaagagaagcaccggcaactag

SEQ ID NO: 79495 - DNA, 1023 bp, Artificial Sequence
  Description of Artificial Sequence: Synthetic coding sequence
atgggcaaggactactaccagaccctgggcctggccagaggcgccagcgacgaggagatcaagagagcctacagaagacaggccctgagataccaccccgacaagaacaaggagcccggcgccgaggagaagttcaaggagatcgccgaggcctacgacgtgctgagcgaccccagaaagagagagatcttcgacagatacggcgaggagggcctgaagggcagcggccccagcggcggcagcggcggcggcgccaacggcaccagcttcagctacaccttccacggcgacccccacgccatgttcgccgagttcttcggcggcagaaaccccttcgacaccttcttcggccagagaaacggcgaggagggcatggacatcgacgaccccttcagcggcttccccatgggcatgggcggcttcaccaacgtgaacttcggcagaagcagaagcgcccaggagcccgccagaaagaagcaggacccccccgtgacccacgacctgagagtgagcctggaggagatctacagcggctgcaccaagaagatgaagatcagccacaagagactgaaccccgacggcaagagcatcagaaacgaggacaagatcctgaccatcgaggtgaagaagggctggaaggagggcaccaagatcaccttccccaaggagggcgaccagaccagcaacaacatccccgccgacatcgtgttcgtgctgaaggacaagccccacaacatcttcaagagagacggcagcgacgtgatctaccccgccagaatcagcctgagagaggccctgtgcggctgcaccgtgaacgtgcccaccctggacggcagaaccatccccgtggtgttcaaggacgtgatcagacccggcatgagaagaaaggtgcccggcgagggcctgcccctgcccaagacccccgagaagagaggcgacctgatcatcgagttcgaggtgatcttccccgagagaatcccccagaccagcagaaccgtgctggagcaggtgctgcccatctag

SEQ ID NO: 79496 - DNA, 723 bp, Artificial Sequence
  Description of Artificial Sequence: Synthetic coding sequence
atgttcgccgagttcttcggcggcagaaaccccttcgacaccttcttcggccagagaaacggcgaggagggcatggacatcgacgaccccttcagcggcttccccatgggcatgggcggcttcaccaacgtgaacttcggcagaagcagaagcgcccaggagcccgccagaaagaagcaggacccccccgtgacccacgacctgagagtgagcctggaggagatctacagcggctgcaccaagaagatgaagatcagccacaagagactgaaccccgacggcaagagcatcagaaacgaggacaagatcctgaccatcgaggtgaagaagggctggaaggagggcaccaagatcaccttccccaaggagggcgaccagaccagcaacaacatccccgccgacatcgtgttcgtgctgaaggacaagccccacaacatcttcaagagagacggcagcgacgtgatctaccccgccagaatcagcctgagagaggccctgtgcggctgcaccgtgaacgtgcccaccctggacggcagaaccatccccgtggtgttcaaggacgtgatcagacccggcatgagaagaaaggtgcccggcgagggcctgcccctgcccaagacccccgagaagagaggcgacctgatcatcgagttcgaggtgatcttccccgagagaatcccccagaccagcagaaccgtgctggagcaggtgctgcccatctag

SEQ ID NO: 79497 - DNA, 1230 bp, Artificial Sequence
  Description of Artificial Sequence: Synthetic coding sequence
atgagcagcctgagagccagactgcccgccaccagaagaagagtggcccagcccttcgccagacccgccagccccagcctggtgcccagaagcggcagcgccatggagagcaacaaggacgaggccgagagatgcatcagcatcgccctgaaggccatccagagcaaccagcccgacagagccctgagattcctggagaaggcccagagactgtaccccacccccagagtgagagccctgatcgagagcctgaaccagaagccccagaccgccggcgaccagcccccccccaccgacaccacccacgccacccacagaaaggccggcggcaccgacgcccccagcgccaacggcgaggccggcggcgagagcaccaagggctacaccgccgagcaggtggccgccgtgaagagagtgaagcagtgcaaggactactacgagatcctgggcgtgagcagaggcgccagcgacgaggacctgaagaaggcctacagaagactggccctgaagttccaccccgacaagaaccacgcccccggcgccaccgaggccttcaaggccatcggcaccgcctacgccgtgctgagcaaccccgagaagagaaagcagtacgaccagttcggcgacgacaagagccaggccgccagacacggccacggccacggcgacttccacagaggcttcgaggccgacatcagccccgaggacctgttcaacatgttcttcggcggcggcttccccagcagcaacgtgcacgtgtacagcaacggcagaatgagatacacctaccagcagagacaggacagaagagacaaccagggcgacggcggcctgggcgtgttcgtgcagctgatgcccatcctgatcctgatcctggtgagcgccctgagccagctgatggtgagcagccccccctacagcctgagccccagacccagcgtgggccacatccacagaagagtgaccgaccacctgggcgtggtgtactacgtgggcgacaccttcagcgaggagtacaccggcagcagcctgaagaccgtggagagaaacgtggaggacgactacatcgccaacctgagaaacaactgctggaaggagaagcagcagaaggagggcctgctgtacagagccagatacttcggcgacaccgacatgtaccacagagcccagaagatgggcacccccagctgcagcagactgagcgaggtgcaggccagcctgcacggctag

SEQ ID NO: 79498 - DNA, 1230 bp, Artificial Sequence; identical to SEQ ID NO: 79497
  Description of Artificial Sequence: Synthetic coding sequence

SEQ ID NO: 79499 - DNA, 1128 bp, Artificial Sequence
  Description of Artificial Sequence: Synthetic coding sequence
atggagagcaacaaggacgaggccgagagatgcatcagcatcgccctgaaggccatccagagcaaccagcccgacagagccctgagattcctggagaaggcccagagactgtaccccacccccagagtgagagccctgatcgagagcctgaaccagaagccccagaccgccggcgaccagcccccccccaccgacaccacccacgccacccacagaaaggccggcggcaccgacgcccccagcgccaacggcgaggccggcggcgagagcaccaagggctacaccgccgagcaggtggccgccgtgaagagagtgaagcagtgcaaggactactacgagatcctgggcgtgagcagaggcgccagcgacgaggacctgaagaaggcctacagaagactggccctgaagttccaccccgacaagaaccacgcccccggcgccaccgaggccttcaaggccatcggcaccgcctacgccgtgctgagcaaccccgagaagagaaagcagtacgaccagttcggcgacgacaagagccaggccgccagacacggccacggccacggcgacttccacagaggcttcgaggccgacatcagccccgaggacctgttcaacatgttcttcggcggcggcttccccagcagcaacgtgcacgtgtacagcaacggcagaatgagatacacctaccagcagagacaggacagaagagacaaccagggcgacggcggcctgggcgtgttcgtgcagctgatgcccatcctgatcctgatcctggtgagcgccctgagccagctgatggtgagcagccccccctacagcctgagccccagacccagcgtgggccacatccacagaagagtgaccgaccacctgggcgtggtgtactacgtgggcgacaccttcagcgaggagtacaccggcagcagcctgaagaccgtggagagaaacgtggaggacgactacatcgccaacctgagaaacaactgctggaaggagaagcagcagaaggagggcctgctgtacagagccagatacttcggcgacaccgacatgtaccacagagcccagaagatgggcacccccagctgcagcagactgagcgaggtgcaggccagcctgcacggctag

SEQ ID NO: 79500 - DNA, 975 bp, Artificial Sequence
  Description of Artificial Sequence: Synthetic coding sequence
atggccagctactacgagatcctggacgtgcccagaagcgccagcgccgacgacatcaagaaggcctacagaagaaaggccctgcagtggcaccccgacaagaaccccgacaacaaggagttcgccgagaagaagttcaaggaggtggccgaggcctacgaggtgctgagcgacaagcacaagagagagatctacgacagatacggcagagagggcctgaccggcaccggcaccggccccagcagagccgaggccggcagcggcggccccggcttcaccttcaccttcagaagccccgaggaggtgttcagagagttcttcggcagcggcgaccccttcgccgagctgttcgacgacctgggccccttcagcgagctgcagaacagaggcagcagacacagcggccccttcttcaccttcagcagcagcttccccggccacagcgacttcagcagcagcagcttcagcttcagccccggcgccggcgccttcagaagcgtgagcaccagcaccaccttcgtgcagggcagaagaatcaccaccagaagaatcatggagaacggccaggagagagtggaggtggaggaggacggccagctgaagagcgtgaccatcaacggcgtgcccgacgacctggccctgggcctggagctgagcagaagagagcagcagcccagcgtgaccagcagaagcggcggcacccaggtgcagcagacccccgccagctgccccctggacagcgacctgagcgaggacgaggacctgcagctggccatggcctacagcctgagcgagatggaggccgccggcaagaagcccgccggcggcagagaggcccagcacagaagacagggcagacccaaggcccagcaccaggaccccggcctgggcggcacccaggagggcgccagaggcgaggccaccaagagaagccccagccccgaggagaaggccagcagatgcctgatcctgtag

SEQ ID NO: 79501 - DNA, 834 bp, Artificial Sequence
  Description of Artificial Sequence: Synthetic coding sequence
atggccagctactacgagatcctggacgtgcccagaagcgccagcgccgacgacatcaagaaggcctacagaagaaaggccctgcagtggcaccccgacaagaaccccgacaacaaggagttcgccgagaagaagttcaaggaggtggccgaggcctacgaggtgctgagcgacaagcacaagagagagatctacgacagatacggcagagagggcctgaccggcaccggcaccggccccagcagagccgaggccggcagcggcggccccggcttcaccttcaccttcagaagccccgaggaggtgttcagagagttcttcggcagcggcgaccccttcgccgagctgttcgacgacctgggccccttcagcgagctgcagaacagaggcagcagacacagcggccccttcttcaccttcagcagcagcttccccggccacagcgacttcagcagcagcagcttcagcttcagccccggcgccggcgccttcagaagcgtgagcaccagcaccaccttcgtgcagggcagaagaatcaccaccagaagaatcatggagaacggccaggagagagtggaggtggaggaggacggccagctgaagagcgtgaccatcaacggcgtgcccgacgacctggccctgggcctggagctgagcagaagagagcagcagcccagcgtgaccagcagaagcggcggcacccaggtgcagcagacccccgccagctgccccctggacagcgacctgagcgaggacgaggacctgcagctggccatggcctacagcctgagcgagatggaggccgccggcaagaagcccgccgacgtgttctag

SEQ ID NO: 79502 - DNA, 687 bp, Artificial Sequence
  Description of Artificial Sequence: Synthetic coding sequence
atggccagctactacgagatcctggacgtgcccagaagcgccagcgccgacgacatcaagaaggcctacagaagaaaggccctgcagtggcaccccgacaagaaccccgacaacaaggagttcgccgagaagaagttcaaggaggtggccgaggcctacgaggtgctgagcgacaagcacaagagagagatctacgacagatacggcagagagggcctgaccggcaccggcaccggccccagcagagccgaggccggcagcggcggccccggcttcaccttcaccttcagaagccccgaggaggtgttcagagagttcttcggcagcggcgaccccttcgccgagctgttcgacgacctgggccccttcagcgagctgcagaacagaggcagcagacacagcggccccttcttcaccttcagcagcagcttccccggccacagcgacttcagcagcagcagcttcagcttcagccccggcgccggcgccttcagaagcgtgagcaccagcaccaccttcgtgcagggcagaagaatcaccaccagaagaatcatggagaacggccaggagagagtggaggtggaggaggacggccagctgaagagcgtgaccatcaacggcgtgcccgacgacctggccctgggcctggagctgagcagaagagagcagcagcccagcgtgacctag

SEQ ID NO: 79503 - DNA, 447 bp, Artificial Sequence
  Description of Artificial Sequence: Synthetic coding sequence
atggccagctactacgagatcctggacgtgcccagaagcgccagcgccgacgacatcaagaaggcctacagaagaaaggccctgcagtggcaccccgacaagaaccccgacaacaaggagttcgccgagaagaagttcaaggaggtggccgaggcctacgaggtgctgagcgacaagcacaagagagagatctacgacagatacggcagagagggcctgaccggcaccggcaccggccccagcagagccgaggccggcagcggcggccccggcttcaccttcaccttcagaagccccgaggaggtgttcagagagttcttcggcagcggcgaccccttcgccgagctgttcgacgacctgggccccttcagcgagctgcagaacagaggcagcagacacagcggccccttcttcaccttcagcagcagcttccccggccacagctag

SEQ ID NO: 79504 - DNA, 369 bp, Artificial Sequence
  Description of Artificial Sequence: Synthetic coding sequence
atggccagctactacgagatcctggacgtgcccagaagcgccagcgccgacgacatcaagaaggcctacagaagaaaggccctgcagtggcaccccgacaagaaccccgacaacaaggagttcgccgagaagaagttcaaggaggtggccgaggcctacgaggtgctgagcgacaagcacaagagagagatctacgacagatacggcagagagggcctgaccggcaccggcaccggccccagcagagccgaggccggcagcggcggccccggcttcaccttcaccttcagaagccccgaggaggtgttcagagagttcttcggcagcggcgaccccttcgccgagctgttcgacgacctgggcccctag

SEQ ID NO: 79505 - DNA, 981 bp, Artificial Sequence
  Description of Artificial Sequence: Synthetic coding sequence
atggtggactactacgaggtgctgggcgtgcagagacacgccagccccgaggacatcaagaaggcctacagaaagctggccctgaagtggcaccccgacaagaaccccgagaacaaggaggaggccgagagaaagttcaagcaggtggccgaggcctacgaggtgctgagcgacgccaagaagagagacatctacgacaagtacggcaaggagggcctgaacggcggcggcggcggcggcagccacttcgacagccccttcgagttcggcttcaccttcagaaaccccgacgacgtgttcagagagttcttcggcggcagagaccccttcagcttcgacttcttcgaggaccccttcgaggacttcttcggcaacagaagaggccccagaggcagcagaagcagaggcaccggcagcttcttcagcgccttcagcggcttccccagcttcggcagcggcttcagcagcttcgacaccggcttcaccagcttcggcagcctgggccacggcggcctgaccagcttcagcagcaccagcttcggcggcagcggcatgggcaacttcaagagcatcagcaccagcaccaagatggtgaacggcagaaagatcaccaccaagagaatcgtggagaacggccaggagagagtggaggtggaggaggacggccagctgaagagcctgaccatcaacggcgtggccgacgacgacgccctggccgaggagagaatgagaagaggccagaacgccctgcccgcccagcccgccggcctgagaccccccaagccccccagacccgccagcctgctgagacacgccccccactgcctgagcgaggaggagggcgagcaggacagacccagagcccccggcccctgggaccccctggccagcgccgccggcctgaaggagggcggcaagagaaagaagcagaagcagagagaggagagcaagaagaagaagagcaccaagggcaaccactag

SEQ ID NO: 79506 - DNA, 378 bp, Artificial Sequence
  Description of Artificial Sequence: Synthetic coding sequence
atggtggactactacgaggtgctgggcgtgcagagacacgccagccccgaggacatcaagaaggcctacagaaagctggccctgaagtggcaccccgacaagaaccccgagaacaaggaggaggccgagagaaagttcaagcaggtggccgaggcctacgaggtgctgagcgacgccaagaagagagacatctacgacaagtacggcaaggagggcctgaacggcggcggcggcggcggcagccacttcgacagccccttcgagttcggcttcaccttcagaaaccccgacgacgtgttcagagagttcttcggcggcagagaccccttcagcttcgacttcttcgaggaccccttcgaggacttcttcggcaactag

SEQ ID NO: 79507 - DNA, 687 bp, Artificial Sequence
  Description of Artificial Sequence: Synthetic coding sequence
atggtggactactacgaggtgctgggcgtgcagagacacgccagccccgaggacatcaagaaggcctacagaaagctggccctgaagtggcaccccgacaagaaccccgagaacaaggaggaggccgagagaaagttcaagcaggtggccgaggcctacgaggtgctgagcgacgccaagaagagagacatctacgacaagtacggcaaggagggcctgaacggcggcggcggcggcggcagccacttcgacagccccttcgagttcggcttcaccttcagaaaccccgacgacgtgttcagagagttcttcggcggcagagaccccttcagcttcgacttcttcgaggaccccttcgaggacttcttcggcaacagaagaggccccagaggcagcagaagcagaggcaccggcagcttcttcagcgccttcagcggcttccccagcttcggcagcggcttcagcagcttcgacaccggcttcaccagcttcggcagcctgggccacggcggcctgaccagcttcagcagcaccagcttcggcggcagcggcatgggcaacttcaagagcatcagcaccagcaccaagatggtgaacggcagaaagatcaccaccaagagaatcgtggagaacggccaggagagagtggaggtggaggaggacggccagctgaagagcctgacctag

SEQ ID NO: 79508 - DNA, 648 bp, Artificial Sequence
  Description of Artificial Sequence: Synthetic coding sequence
atggtggactactacgaggtgctgggcgtgcagagacacgccagccccgaggacatcaagaaggcctacagaaagctggccctgaagtggcaccccgacaagaaccccgagaacaaggaggaggccgagagaaagttcaagcaggtggccgaggcctacgaggtgctgagcgacgccaagaagagagacatctacgacaagtacggcaaggagggcctgaacggcggcggcggcggcggcagccacttcgacagccccttcgagttcggcttcaccttcagaaaccccgacgacgtgttcagagagttcttcggcggcagagaccccttcagcttcgacttcttcgaggaccccttcgaggacttcttcggcaacagaagaggccccagaggcagcagaagcagaggcaccggcagcttcttcagcgccttcagcggcttccccagcttcggcagcggcttcagcagcttcgacaccggcttcaccagcttcggcagcctgggccacggcggcctgaccagcttcagcagcaccagcttcggcggcagcggcatgggcaacttcaagagcatcagcaccagcaccaagtggctgatggccgagaagagcctgcagagagagctgagcagaaccgtgaagaaggagtag

SEQ ID NO: 79509 - DNA, 726 bp, Artificial Sequence
  Description of Artificial Sequence: Synthetic coding sequence
atggtggactactacgaggtgctgggcgtgcagagacacgccagccccgaggacatcaagaaggcctacagaaagctggccctgaagtggcaccccgacaagaaccccgagaacaaggaggaggccgagagaaagttcaagcaggtggccgaggcctacgaggtgctgagcgacgccaagaagagagacatctacgacaagtacggcaaggagggcctgaacggcggcggcggcggcggcagccacttcgacagccccttcgagttcggcttcaccttcagaaaccccgacgacgtgttcagagagttcttcggcggcagagaccccttcagcttcgacttcttcgaggaccccttcgaggacttcttcggcaacagaagaggccccagaggcagcagaagcagaggcaccggcagcttcttcagcgccttcagcggcttccccagcttcggcagcggcttcagcagcttcgacaccggcttcaccagcttcggcagcctgggccacggcggcctgaccagcttcagcagcaccagcttcggcggcagcggcatgggcaacttcaagagcatcagcaccagcaccaagatggtgaacggcagaaagatcaccaccaagagaatcgtggagaacggccaggagagagtggaggtggaggaggacggccagctgaagagcctgaccatcaacggcaaggagcagctgctgagactggacaacaagtag

SEQ ID NO: 79510 - DNA, 201 bp, Artificial Sequence
  Description of Artificial Sequence: Synthetic coding sequence
atggtggactactacgaggtgctgggcgtgcagagacacgccagccccgaggacatcaagaaggcctacagaaagctggccctgaagtggcaccccgacaagaaccccgagaacaaggaggaggccgagagaaagttcaagcaggtggccgaggcctacgaggtgctgagcgacgccaagaagagagacatctacgactag

SEQ ID NO: 79511 - DNA, 138 bp, Artificial Sequence
  Description of Artificial Sequence: Synthetic coding sequence
atggtggactactacgaggtgctgggcgtgcagagacacgccagccccgaggacatcaagaaggcctacagaaagctggccctgaagtggcaccccgacaagaaccccgagaacaaggaggaggccgagagaaagtag

SEQ ID NO: 79512 - DNA, 441 bp, Artificial Sequence
  Description of Artificial Sequence: Synthetic coding sequence
atggtggactactacgaggtgctgggcgtgcagagacacgccagccccgaggacatcaagaaggcctacagaaagctggccctgaagtggcaccccgacaagaaccccgagaacaaggaggaggccgagagaaagttcaagcaggtggccgaggcctacgaggtgctgagcgacgccaagaagagagacatctacgacaagtacggcaaggagggcctgaacggcggcggcggcggcggcagccacttcgacagccccttcgagttcggcttcaccttcagaaaccccgacgacgtgttcagagagttcttcggcggcagagaccccttcagcttcgacttcttcgaggaccccttcgaggacttcttcggcaacagaagaggccccagaggcagcagaagcagaggcaccggcagcttcttcagcgccttcagcggctag

SEQ ID NO: 79513 - DNA, 636 bp, Artificial Sequence
  Description of Artificial Sequence: Synthetic coding sequence
atggtggactactacgaggtgctgggcgtgcagagacacgccagccccgaggacatcaagaaggcctacagaaagctggccctgaagtggcaccccgacaagaaccccgagaacaaggaggaggccgagagaaagttcaagcaggtggccgaggcctacgaggtgctgagcgacgccaagaagagagacatctacgacaagtacggcaaggagggcctgaacggcggcggcggcggcggcagccacttcgacagccccttcgagttcggcttcaccttcagaaaccccgacgacgtgttcagagagttcttcggcggcagagaccccttcagcttcgacttcttcggcgtggccgacgacgacgccctggccgaggagagaatgagaagaggccagaacgccctgcccgcccagcccgccggcctgagaccccccaagccccccagacccgccagcctgctgagacacgccccccactgcctgagcgaggaggagggcgagcaggacagacccagagcccccggcccctgggaccccctggccagcgccgccggcctgaaggagggcggcaagagaaagaagcagaagcagagagaggagagcaagaagaagaagagcaccaagggcaaccactag

SEQ ID NO: 79514 - DNA, 834 bp, Artificial Sequence
  Description of Artificial Sequence: Synthetic coding sequence
atgccccaccccagaatcctgaagagacccaagaagagagacatctacgacaagtacggcaaggagggcctgaacggcggcggcggcggcggcagccacttcgacagccccttcgagttcggcttcaccttcagaaaccccgacgacgtgttcagagagttcttcggcggcagagaccccttcagcttcgacttcttcgaggaccccttcgaggacttcttcggcaacagaagaggccccagaggcagcagaagcagaggcaccggcagcttcttcagcgccttcagcggcttccccagcttcggcagcggcttcagcagcttcgacaccggcttcaccagcttcggcagcctgggccacggcggcctgaccagcttcagcagcaccagcttcggcggcagcggcatgggcaacttcaagagcatcagcaccagcaccaagatggtgaacggcagaaagatcaccaccaagagaatcgtggagaacggccaggagagagtggaggtggaggaggacggccagctgaagagcctgaccatcaacggcgtggccgacgacgacgccctggccgaggagagaatgagaagaggccagaacgccctgcccgcccagcccgccggcctgagaccccccaagccccccagacccgccagcctgctgagacacgccccccactgcctgagcgaggaggagggcgagcaggacagacccagagcccccggcccctgggaccccctggccagcgccgccggcctgaaggagggcggcaagagaaagaagcagaagcagagagaggagagcaagaagaagaagagcaccaagggcaaccactag

SEQ ID NO: 79515 - DNA, 297 bp, Artificial Sequence
  Description of Artificial Sequence: Synthetic coding sequence
atggtggactactacgaggtgctgggcgtgcagagacacgccagccccgaggacatcaagaaggcctacagaaagctggccctgaagtggcaccccgacaagaaccccgagaacaaggaggaggccgagagaaagttcaagcaggtggccgaggcctacgaggtgctgagcgacgccaagaagagagacatctacgacaagtacggcaaggagggcctgaacggcggcggcggcggcggcagccacttcgacagccccttcgagttcggcttcaccttcagaaaccccgacgactag

SEQ ID NO: 79516 - DNA, 672 bp, Artificial Sequence
  Description of Artificial Sequence: Synthetic coding sequence
atggccaccccccagagcatcttcatcttcgccatctgcatcctgatgatcaccgagctgatcctggccagcaagagctactacgacatcctgggcgtgcccaagagcgccagcgagagacagatcaagaaggccttccacaagctggccatgaagtaccaccccgacaagaacaagagccccgacgccgaggccaagttcagagagatcgccgaggcctacgagaccctgagcgacgccaacagaagaaaggagtacgacaccctgggccacagcgccttcaccagcggcaagggccagagaggcagcggcagcagcttcgagcagagcttcaacttcaacttcgacgacctgttcaaggacttcggcttcttcggccagaaccagaacaccggcagcaagaagagattcgagaaccacttccagaccagacaggacggcggcagcagcagacagagacaccacttccaggagttcagcttcggcggcggcctgttcgacgacatgttcgaggacatggagaagatgttcagcttcagcggcttcgacagcaccaaccagcacaccgtgcagaccgagaacagattccacggcagcagcaagcactgcagaaccgtgacccagagaagaggcaacatggtgaccacctacaccgactgcagcggccagtag

SEQ ID NO: 79517 - DNA, 2382 bp, Artificial Sequence
  Description of Artificial Sequence: Synthetic coding sequence
atgggcgtgtggctgaacaaggacgactacatcagagacctgaagagaatcatcctgtgcttcctgatcgtgtacatggccatcctggtgggcaccgaccaggacttctacagcctgctgggcgtgagcaagaccgccagcagcagagagatcagacaggccttcaagaagctggccctgaagctgcaccccgacaagaaccccaacaaccccaacgcccacggcgacttcctgaagatcaacagagcctacgaggtgctgaaggacgaggacctgagaaagaagtacgacaagtacggcgagaagggcctggaggacaaccagggcggccagtacgagagctggaactactacagatacgacttcggcatctacgacgacgaccccgagatcatcaccctggagagaagagagttcgacgccgccgtgaacagcggcgagctgtggttcgtgaacttctacagccccggctgcagccactgccacgacctggcccccacctggagagacttcgccaaggaggtggacggcctgctgagaatcggcgccgtgaactgcggcgacgacagaatgctgtgcagaatgaagggcgtgaacagctaccccagcctgttcatcttcagaagcggcatggcccccgtgaagtaccacggcgacagaagcaaggagagcctggtgagcttcgccatgcagcacgtgagaagcaccgtgaccgagctgtggaccggcaacttcgtgaacagcatccagaccgccttcgccgccggcatcggctggctgatcaccttctgcagcaagggcggcgactgcctgaccagccagaccagactgagactgagcggcatgctggacggcctggtgaacgtgggctggatggactgcgccacccaggacaacctgtgcaagagcctggacatcaccaccagcaccaccgcctacttcccccccggcgccaccctgaacaacaaggagaagaacagcatcctgttcctgaacagcctggacgccaaggagatctacctggaggtgatccacaacctgcccgacttcgagctgctgagcgccaacaccctggaggacagactggcccaccacagatggctgctgttcttccacttcggcaagaacgagaacagcaacgaccccgagctgaagaagctgaagaccctgctgaagaacgaccacatccaggtgggcagattcgactgcagcagcgcccccgacatctgcagcaacctgtacgtgttccagcccagcctggccgtgttcaagggccagggcaccaaggagtacgagatccaccacggcaagaagatcctgtacgacatcctggccttcgccaaggagagcgtgaacagccacgtgaccaccctgggcccccagaacttccccgccaacgacaaggagccctggctggtggacttcttcgccccctggtgccccccctgcagagccctgctgcccgagctgagaagagccagcaacctgctgtacggccagctgaagttcggcaccctggactgcaccgtgcacgagggcctgtgcaacatgtacaacatccaggcctaccccaccaccgtggtgttcaaccagagcaacatccacgagtacgagggccaccacagcgccgagcagatcctggagttcatcgaggacctgatgaaccccagcgtggtgagcctgacccccaccaccttcaacgagctggtgacccagagaaagcacaacgaggtgtggatggtggacttctacagcccctggtgccacccctgccaggtgctgatgcccgagtggaagagaatggccagaaccctgaccggcctgatcaacgtgggcagcatcgactgccagcagtaccacagcttctgcgcccaggagaacgtgcagagataccccgagatcagattcttcccccccaagagcaacaaggcctaccactaccacagctacaacggctggaacagagacgcctacagcctgagaatctggggcctgggcttcctgccccaggtgagcaccgacctgaccccccagaccttcagcgagaaggtgctgcagggcaagaaccactgggtgatcgacttctacgccccctggtgcggcccctgccagaacttcgcccccgagttcgagctgctggccagaatgatcaagggcaaggtgaaggccggcaaggtggactgccaggcctacgcccagacctgccagaaggccggcatcagagcctaccccaccgtgaagttctacttctacgagagagccaagagaaacttccaggaggagcagatcaacaccagagacgccaaggccatcgccgccctgatcagcgagaagctggagaccctgagaaaccagggcaagagaaacaaggacgagctgtag

SEQ ID NO: 79518 - DNA, 2244 bp, Artificial Sequence
  Description of Artificial Sequence: Synthetic coding sequence
atgggcgtgtggctgaacaaggacgactacatcagagacctgaagagaatcatcctgtgcttcctgatcgtgtacatggccatcctggtgggcaccgaccaggacttctacagcctgctgggcgtgagcaagaccgccagcagcagagagatcagacaggccttcaagaagctggccctgaagctgcaccccgacaagaaccccaacaaccccaacgcccacggcgacttcctgaagatcaacagagcctacgaggtgctgaaggacgaggacctgagaaagaagtacgacaagtacggcgagaagggcctggaggacaaccagggcggccagtacgagagctggaactactacagatacgacttcggcatctacgacgacgaccccgagatcatcaccctggagagaagagagttcgacgccgccgtgaacagcggcgagctgtggttcgtgaacttctacagccccggctgcagccactgccacgacctggcccccacctggagagacttcgccaaggaggtggacggcctgctgagaatcggcgccgtgaactgcggcgacgacagaatgctgtgcagaatgaagggcgtgaacagctaccccagcctgttcatcttcagaagcggcatggcccccgtgaagtaccacggcgacagaagcaaggagagcctggtgagcttcgccatgcagcacgtgagaagcaccgtgaccgagctgtggaccggcaacttcgtgaacagcatccagaccgccttcgccgccggcatcggctggctgatcaccttctgcagcaagggcggcgactgcctgaccagccagaccagactgagactgagcggcatgctgttcctgaacagcctggacgccaaggagatctacctggaggtgatccacaacctgcccgacttcgagctgctgagcgccaacaccctggaggacagactggcccaccacagatggctgctgttcttccacttcggcaagaacgagaacagcaacgaccccgagctgaagaagctgaagaccctgctgaagaacgaccacatccaggtgggcagattcgactgcagcagcgcccccgacatctgcagcaacctgtacgtgttccagcccagcctggccgtgttcaagggccagggcaccaaggagtacgagatccaccacggcaagaagatcctgtacgacatcctggccttcgccaaggagagcgtgaacagccacgtgaccaccctgggcccccagaacttccccgccaacgacaaggagccctggctggtggacttcttcgccccctggtgccccccctgcagagccctgctgcccgagctgagaagagccagcaacctgctgtacggccagctgaagttcggcaccctggactgcaccgtgcacgagggcctgtgcaacatgtacaacatccaggcctaccccaccaccgtggtgttcaaccagagcaacatccacgagtacgagggccaccacagcgccgagcagatcctggagttcatcgaggacctgatgaaccccagcgtggtgagcctgacccccaccaccttcaacgagctggtgacccagagaaagcacaacgaggtgtggatggtggacttctacagcccctggtgccacccctgccaggtgctgatgcccgagtggaagagaatggccagaaccctgaccggcctgatcaacgtgggcagcatcgactgccagcagtaccacagcttctgcgcccaggagaacgtgcagagataccccgagatcagattcttcccccccaagagcaacaaggcctaccactaccacagctacaacggctggaacagagacgcctacagcctgagaatctggggcctgggcttcctgccccaggtgagcaccgacctgaccccccagaccttcagcgagaaggtgctgcagggcaagaaccactgggtgatcgacttctacgccccctggtgcggcccctgccagaacttcgcccccgagttcgagctgctggccagaatgatcaagggcaaggtgaaggccggcaaggtggactgccaggcctacgcccagacctgccagaaggccggcatcagagcctaccccaccgtgaagttctacttctacgagagagccaagagaaacttccaggaggagcagatcaacaccagagacgccaaggccatcgccgccctgatcagcgagaagctggagaccctgagaaaccagggcaagagaaacaaggaccacctgtag

SEQ ID NO: 79519 - DNA, 534 bp, Artificial Sequence
  Description of Artificial Sequence: Synthetic coding sequence
atgggcgtgtggctgaacaaggacgactacatcagagacctgaagagaatcatcctgtgcttcctgatcgtgtacatggccatcctggtgggcaccgaccaggacttctacagcctgctgggcgtgagcaagaccgccagcagcagagagatcagacaggccttcaagaagctggccctgaagctgcaccccgacaagaaccccaacaaccccaacgcccacggcgacttcctgaagatcaacagagcctacgaggtgctgaaggacgaggacctgagaaagaagtacgacaagtacggcgagaagggcctggaggacaaccagggcggccagtacgagagctggaactactacagatacgacttcggcatctacgacgacgaccccgagatcatcaccctggagagaagagagttcgacgccgccgtgaacagcggcgagctgtggttcgtgaacttctacagccccggctgcagccactgccacgacctggcccccacctggagagacttcgccaaggagagcctgagatag

SEQ ID NO: 79520 - DNA, 999 bp, Artificial Sequence
  Description of Artificial Sequence: Synthetic coding sequence
atgggcgtgtggctgaacaaggacgactacatcagagacctgaagagaatcatcctgtgcttcctgatcgtgtacatggccatcctggtgggcaccgaccaggacttctacagcctgctgggcgtgagcaagaccgccagcagcagagagatcagacaggccttcaagaagctggccctgaagctgcaccccgacaagaaccccaacaaccccaacgcccacggcgacttcctgaagatcaacagagcctacgaggtgctgaaggacgaggacctgagaaagaagtacgacaagtacggcgagaagggcctggaggacaaccagggcggccagtacgagagctggaactactacagatacgacttcggcatctacgacgacgaccccgagatcatcaccctggagagaagagagttcgacgccgccgtgaacagcggcgagctgtggttcgtgaacttctacagccccggctgcagccactgccacgacctggcccccacctggagagacttcgccaaggaggtggacggcctgctgagaatcggcgccgtgaactgcggcgacgacagaatgctgtgcagaatgaagggcgtgaacagctaccccagcctgttcatcttcagaagcggcatggcccccgtgaagtaccacggcgacagaagcaaggagagcctggtgagcttcgccatgcagcacgtgagaagcaccgtgaccgagctgtggaccggcaacttcgtgaacagcatccagaccgccttcgccgccggcatcggctggctgatcaccttctgcagcaagggcggcgactgcctgaccagccagaccagactgagactgagcggcatgctggacggcctggtgaacgtgggctggatggactgcgccacccaggacaacctgtgcaagagcctggacatcaccaccagcaccaccgcctacttcccccccggcgccaccctgaacaacaaggagaagaacagcatcctgctgctgcactag

SEQ ID NO: 79521 - DNA, 6732 bp, Artificial Sequence
  Description of Artificial Sequence: Synthetic coding sequence
atgaacatcatcagagagaacaaggacctggcctgcttctacaccaccaagcacagctggagaggcaagtacaagagagtgttcagcgtgggcacccacgccatcaccacctacaaccccaacaccctggaggtgaccaaccagtggccctacggcgacatctgcagcatcagccccgtgggcaagggccagggcaccgagttcaacctgaccttcagaaagggcagcggcaagaagagcgagaccctgaagttcagcaccgagcacagaaccgagctgctgaccgaggccctgagattcagaaccgacttcagcgagggcaagatcaccggcagaagatacaactgctacaagcaccactggagcgacagcagaaagcccgtgatcctggaggtgacccccggcggcttcgaccagatcaaccccgccaccaacagagtgctgtgcagctacgactacagaaacatcgagggcttcgtggacctgagcgactaccagggcggcttctgcatcctgtacggcggcttcagcagactgcacctgttcgccagcgagcagagagaggagatcatcaagagcgccatcgaccacgccggcaactacatcggcatcagcctgagaatcagaaaggagcccctggagttcgagcagtacctgaacctgagattcggcaagtacagcaccgacgagagcatcaccagcctggccgagttcgtggtgcagaagatcagccccagacacagcgagcccgtgaagagagtgctggccctgaccgagacctgcctggtggagagagaccccgccacctacaacatcgccaccctgaagcccctgggcgaggtgttcgccctggtgtgcgacagcgagaacccccagctgttcaccatcgagttcatcaagggccaggtgagaaagtacagcagcaccgagagagacagcctgctggccagcctgctggacggcgtgagagccagcggcaacagagacgtgtgcgtgaagatgacccccacccacaagggccagagatggggcctgctgagcatgcccgtggacgaggaggtggagagcctgcacctgagattcctggccaccccccccaacggcaacttcgccgacgccgtgttcagattcaacgccaacatcagctacagcggcgtgctgcacgccgtgacccaggacggcctgttcagcgagaacaaggagaagctgatcaacaacgccatcaccgccctgctgagccaggagggcgacgtggtggccagcaacgccgagctggagagccagttccaggccgtgagaagactggtggccagcaaggccggcttcctggccttcacccagctgcccaagttcagagagagactgggcgtgaaggtggtgaaggccctgaagagaagcaacaacggcatcatccacgccgccgtggacatgctgtgcgccctgatgtgccccatgcacgacgactacgacctgagacaggagcagctgaacaaggccagcctgctgagcagcaagaagttcctggagaacctgctggagaagttcaacagccacgtggaccacggcaccggcgccctggtgatcagcagcctgctggacttcctgaccttcgccctgtgcgccccctacagcgagaccaccgagggccagcagttcgacatgctgctggagatggtggccagcaacggcagaaccctgttcaagctgttccagcaccccagcatggccatcatcaagggcgccggcctggtgatgaaggccatcatcgaggagggcgacaaggagatcgccaccaagatgcaggagctggccctgagcgagggcgccctgcccagacacctgcacaccgccatgttcaccatcagcagcgaccagagaatgctgaccaacagacagctgagcagacacctggtgggcctgtggaccgccgacaacgccaccgccaccaacctgctgaagagaatcctgccccccggcctgctggcctacctggagagcagcgacctggtgcccgagaaggacgccgacagaatgcacgtgagagacaacgtgaagatcgccatggaccagtacggcaagttcaacaaggtgcccgagtggcagagactggccggcaaggccgccaaggaggtggagaagttcgccaaggagaaggtggacctggtgctgatgcactggagagacagaatgggcatcgcccagaaggagaacatcaaccagaagcccgtggtgctgagaaagagaagacagagaatcaagatcgaggccaactgggacctgttctactacagattcggccaggaccacgccagaagcaacctgatctggaacttcaagaccagagaggagctgaaggacaccctggagagcgagatgagagccttcaacatcgacagagagctgggcagcgccaacgtgatcagctggaaccaccacgagttcgaggtgaagtacgagtgcctggccgaggagatcaagatcggcgactactacctgagactgctgctggaggaggacgagaacgaggagagcggcagcatcaagagaagctacgagttcttcaacgagctgtaccacagattcctgctgacccccaaggtgaacatgaagtgcctgtgcctgcaggccctggccatcgtgtacggcagatgccacgaggagatcggccccttcaccgacaccagatacatcatcggcatgctggagagatgcaccgacaagctggagagagacagactgatcctgttcctgaacaagctgatcctgaacaagaagaacgtgaaggacctgatggacagcaacggcatcagaatcctggtggacctgctgaccctggcccacctgcacgtgagcagagccaccgtgcccctgcagagcaacgtgatcgaggccgcccccgacatgaagagagagagcgagaaggagtggtacttcggcaacgccgacaaggagagaagcggcccctacggcttccacgagatgcaggagctgtggaccaagggcatgctgaacgccaagaccagatgctgggcccagggcatggacggctggagacccctgcagagcatcccccagctgaagtggtgcctgctggccagcggccaggccgtgctgaacgagaccgacctggccaccctgatcctgaacatgctgatcaccatgtgcggctacttccccagcagagaccaggacaacgccatcatcagacccctgcccaaggtgaagagactgctgagcgacagcacctgcctgccccacatcatccagctgctgctgaccttcgaccccatcctggtggagaaggtggccatcctgctgtaccacatcatgcaggacaacccccagctgcccagactgtacctgagcggcgtgttcttcttcatcatgatgtacaccggcagcaacgtgctgcccgtggccagattcctgaagtacacccacaccaagcaggccttcaagagcgaggagaccaagggccaggacatcttccagagaagcatcctgggccacatcctgcccgaggccatggtgtgctacctggagaactacgagcccgagaagttcagcgagatcttcctgggcgagttcgacacccccgaggccatctggagcagcgagatgagaagactgatgatcgagaagatcgccgcccacctggccgacttcacccccagactgcagagcaacaccagagccctgtaccagtactgccccatccccatcatcaactacccccagctggagaacgagctgttctgcaacatctactacctgaagcagctgtgcgacaccctgagattccccgactggcccatcaaggaccccgtgaagctgctgaaggacaccctggacgcctggaagaaggaggtggagaagaagccccccatgatgagcatcgacgacgcctacgaggtgctgaacctgccccagggccagggcccccacgacgagagcaagatcagaaaggcctacttcagactggcccagaagtaccaccccgacaagaaccccgagggcagagacatgttcgagaaggtgaacaaggcctacgagttcctgtgcaccaagagcgccaagatcgtggacggccccgaccccgagaacatcatcctgatcctgaagacccagagcatcctgttcaacagacacaaggaggacctgcagccctacaagtacgccggctaccccatgctgatcagaaccatcaccatggagaccagcgacgacctgctgttcagcaaggagagccccctgctgcccgccgccaccgagctggccttccacaccgtgaactgcagcgccctgaacgccgaggagctgagaagagagaacggcctggaggtgctgcaggaggccttcagcagatgcgtggccgtgctgaccagagccagcaagcccagcgacatgagcgtgcaggtgtgcggctacatcagcaagtgctacagcgtggccgcccagttcgaggagtgcagagagaagatcaccgagatgcccagcatcatcaaggacctgtgcagagtgctgtacttcggcaagagcatccccagagtggccgccctgggcgtggagtgcgtgagcagcttcgccgtggacttctggctgcagacccacctgttccaggccggcatcctgtggtacctgctgggcttcctgttcaactacgactacaccctggaggagagcggcatccagaagagcgaggagaccaaccagcaggaggtggccaacagcctggccaagctgagcgtgcacgccctgagcagactgggcggctacctggccgaggagcaggccacccccgagaaccccaccatcagaaagagcctggccggcatgctgaccccctacgtggccagaaagctggccgtggccagcgtgaccgagatcctgaagatgctgaacagcaacaccgagagcccctacctgatctggaacaacagcaccagagccgagctgctggagttcctggagagccagcaggagaacatgatcaagaagggcgactgcgacaagacctacggcagcgagttcgtgtacagcgaccacgccaaggagctgatcgtgggcgagatcttcgtgagagtgtacaacgaggtgcccaccttccagctggaggtgcccaaggccttcgccgccagcctgctggactacatcggcagccaggcccagtacctgcacaccttcatggccatcacccacgccgccaaggtggagagcgagcagcacggcgacagactgcccagagtggagatggccctggaggccctgagaaacgtgatcaagtacaaccccggcagcgagagcgagtgcatcggccacttcaagctgatcttcagcctgctgagagtgcacggcgccggccaggtgcagcagctggccctggaggtggtgaacatcgtgaccagcaaccaggactgcgtgaacaacatcgccgagagcatggtgctgagcagcctgctggccctgctgcacagcctgcccagcagcagacagctggtgctggagaccctgtacgccctgaccagcagcaccaagatcatcaaggaggccatggccaagggcgccctgatctacctgctggacatgttctgcaacagcacccacccccaggtgagagcccagaccgccgagctgttcgccaagatgaccgccgacaagctgatcggccccaaggtgagaatcaccctgatgaagttcctgcccagcgtgttcatggacgccatgagagacaaccccgaggccgccgtgcacatcttcgagggcacccacgagaaccccgagctgatctggaacgacaacagcagagacaaggtgagcaccaccgtgagagagatgatgctggagcacttcaagaaccagcaggacaaccccgaggccaactggaagctgcccgaggacttcgccgtggtgttcggcgaggccgagggcgagctggccgtgggcggcgtgttcctgagaatcttcatcgcccagcccgcctgggtgctgagaaagcccagagagttcctgatcgccctgctggagaagctgaccgagctgctggagaagaacaacccccacggcgagaccctggagaccctgaccatggccaccgtgtgcctgttcagcgcccagccccagctggccgaccaggtgccccccctgggccacctgcccaaggtgatccaggccatgaaccacagaaacaacgccatccccaagagcgccatcagagtgatccacgccctgagcgagaacgagctgtgcgtgagagccatggccagcctggagaccatcggccccctgatgaacggcatgaagaagagagccgacaccgtgggcctggcctgcgaggccatcaacagaatgttccagaaggagcagagcgagctggtggcccaggccctgaaggccgacctggtgccctacctgctgaagctgctggagggcatcggcctggagaacctggacagccccgccgccaccaaggcccagatcgtgaaggccctgaaggccatgaccagaagcctgcagtacggcgagcaggtgaacgagatcctgtgcagaagcagcgtgtggagcgccttcaaggaccagaagcacgacctgttcatcagcgagagccagaccgccggctacctgaccggccccggcgtggccggctacctgaccgccggcaccagcaccagcgtgatgagcaacctgcccccccccgtggaccacgaggccggcgacctgggctaccagacctag

SEQ ID NO: 79522 - DNA, 2673 bp, Artificial Sequence
  Description of Artificial Sequence: Synthetic coding sequence
atgtaccagatcagcaagaacagcggctgggccagaagcagagagtacaacttcaacctgaagacccagagcatcctgttcaacagacacaaggaggacctgcagccctacaagtacgccggctaccccatgctgatcagaaccatcaccatggagaccagcgacgacctgctgttcagcaaggagagccccctgctgcccgccgccaccgagctggccttccacaccgtgaactgcagcgccctgaacgccgaggagctgagaagagagaacggcctggaggtgctgcaggaggccttcagcagatgcgtggccgtgctgaccagagccagcaagcccagcgacatgagcgtgcaggtgtgcggctacatcagcaagtgctacagcgtggccgcccagttcgaggagtgcagagagaagatcaccgagatgcccagcatcatcaaggacctgtgcagagtgctgtacttcggcaagagcatccccagagtggccgccctgggcgtggagtgcgtgagcagcttcgccgtggacttctggctgcagacccacctgttccaggccggcatcctgtggtacctgctgggcttcctgttcaactacgactacaccctggaggagagcggcatccagaagagcgaggagaccaaccagcaggaggtggccaacagcctggccaagctgagcgtgcacgccctgagcagactgggcggctacctggccgaggagcaggccacccccgagaaccccaccatcagaaagagcctggccggcatgctgaccccctacgtggccagaaagctggccgtggccagcgtgaccgagatcctgaagatgctgaacagcaacaccgagagcccctacctgatctggaacaacagcaccagagccgagctgctggagttcctggagagccagcaggagaacatgatcaagaagggcgactgcgacaagacctacggcagcgagttcgtgtacagcgaccacgccaaggagctgatcgtgggcgagatcttcgtgagagtgtacaacgaggtgcccaccttccagctggaggtgcccaaggccttcgccgccagcctgctggactacatcggcagccaggcccagtacctgcacaccttcatggccatcacccacgccgccaaggtggagagcgagcagcacggcgacagactgcccagagtggagatggccctggaggccctgagaaacgtgatcaagtacaaccccggcagcgagagcgagtgcatcggccacttcaagctgatcttcagcctgctgagagtgcacggcgccggccaggtgcagcagctggccctggaggtggtgaacatcgtgaccagcaaccaggactgcgtgaacaacatcgccgagagcatggtgctgagcagcctgctggccctgctgcacagcctgcccagcagcagacagctggtgctggagaccctgtacgccctgaccagcagcaccaagatcatcaaggaggccatggccaagggcgccctgatctacctgctggacatgttctgcaacagcacccacccccaggtgagagcccagaccgccgagctgttcgccaagatgaccgccgacaagctgatcggccccaaggtgagaatcaccctgatgaagttcctgcccagcgtgttcatggacgccatgagagacaaccccgaggccgccgtgcacatcttcgagggcacccacgagaaccccgagctgatctggaacgacaacagcagagacaaggtgagcaccaccgtgagagagatgatgctggagcacttcaagaaccagcaggacaaccccgaggccaactggaagctgcccgaggacttcgccgtggtgttcggcgaggccgagggcgagctggccgtgggcggcgtgttcctgagaatcttcatcgcccagcccgcctgggtgctgagaaagcccagagagttcctgatcgccctgctggagaagctgaccgagctgctggagaagaacaacccccacggcgagaccctggagaccctgaccatggccaccgtgtgcctgttcagcgcccagccccagctggccgaccaggtgccccccctgggccacctgcccaaggtgatccaggccatgaaccacagaaacaacgccatccccaagagcgccatcagagtgatccacgccctgagcgagaacgagctgtgcgtgagagccatggccagcctggagaccatcggccccctgatgaacggcatgaagaagagagccgacaccgtgggcctggcctgcgaggccatcaacagaatgttccagaaggagcagagcgagctggtggcccaggccctgaaggccgacctggtgccctacctgctgaagctgctggagggcatcggcctggagaacctggacagccccgccgccaccaaggcccagatcgtgaaggccctgaaggccatgaccagaagcctgcagtacggcgagcaggtgaacgagatcctgtgcagaagcagcgtgtggagcgccttcaaggaccagaagcacgacctgttcatcagcgagagccagaccgccggctacctgaccggccccggcgtggccggctacctgaccgccggcaccagcaccagcgtgatgagcaacctgcccccccccgtggaccacgaggccggcgacctgggctaccagacctag

SEQ ID NO: 79523 - DNA, 351 bp, Artificial Sequence
  Description of Artificial Sequence: Synthetic coding sequence
atggccagcaccgtggtggccgtgggcctgaccatcgccgccgccggcttcgccggcagatacgtgctgcaggccatgaagcacatggagccccaggtgaagcaggtgttccagagcctgcccaagagcgccttcagcggcggctactacagaggcggcttcgagcccaagatgaccaagagagaggccgccctgatcctgggcgtgagccccaccgccaacaagggcaagatcagagacgcccacagaagaatcatgctgctgaaccaccccgacaagggcggcagcccctacatcgccgccaagatcaacgaggccaaggacctgctggagggccaggccaagaagtag

SEQ ID NO: 79524 - DNA, 1707 bp, Artificial Sequence
  Description of Artificial Sequence: Synthetic coding sequence
atgctgctgctgcccagcgccgccgacggcagaggcaccgccatcacccacgccctgaccagcgccagcaccctgtgccaggtggagcccgtgggcagatggttcgaggccttcgtgaagagaagaaacagaaacgccagcgccagcttccaggagctggaggacaagaaggagctgagcgaggagagcgaggacgaggagctgcagctggaggagttccccatgctgaagaccctggaccccaaggactggaagaaccaggaccactacgccgtgctgggcctgggccacgtgagatacaaggccacccagagacagatcaaggccgcccacaaggccatggtgctgaagcaccaccccgacaagagaaaggccgccggcgagcccatcaaggagggcgacaacgactacttcacctgcatcaccaaggcctacgagatgctgagcgaccccgtgaagagaagagccttcaacagcgtggaccccaccttcgacaacagcgtgcccagcaagagcgaggccaaggacaacttcttcgaggtgttcacccccgtgttcgagagaaacagcagatggagcaacaagaagaacgtgcccaagctgggcgacatgaacagcagcttcgaggacgtggacatcttctacagcttctggtacaacttcgacagctggagagagttcagctacctggacgaggaggagaaggagaaggccgagtgcagagacgagagaagatggatcgagaagcagaacagagccaccagagcccagagaaagaaggaggagatgaacagaatcagaaccctggtggacaacgcctacagctgcgaccccagaatcaagaagttcaaggaggaggagaaggccaagaaggaggccgagaagaaggccaaggccgaggccaagagaaaggagcaggaggccaaggagaagcagagacaggccgagctggaggccgccagactggccaaggagaaggaggaggaggaggtgagacagcaggccctgctggccaagaaggagaaggacatccagaagaaggccatcaagaaggagagacagaagctgagaaacagctgcaagatcgaggagatcaacgagcagatcagaaaggagaaggaggaggccgaggccagaatgagacaggccagcaagaacaccgagaagagcaccggcggcggcggcaacggcagcaagaactggagcgaggacgacctgcagctgctgatcaaggccgtgaacctgttccccgccggcaccaacagcagatgggaggtgatcgccaactacatgaacatccacagcagcagcggcgtgaagagaaccgccaaggacgtgatcggcaaggccaagagcctgcagaagctggacccccaccagaaggacgacatcaacaagaaggccttcgacaagttcaagaaggagcacggcgtggtgccccaggccgacaacgccacccccagcgagagattcgagggcccctacaccgacttcaccccctggaccaccgaggagcagaagctgctggagcaggccctgaagacctaccccgtgaacacccccgagagatgggagaagatcgccgaggccgtgcccggcagaaccaagaaggactgcatgaagagatacaaggagctggtggagatggtgaaggccaagaaggccgcccaggagcaggtgctgaacgccagcagagccaagaagtag

SEQ ID NO: 79525 - DNA, 1866 bp, Artificial Sequence
  Description of Artificial Sequence: Synthetic coding sequence
atgctgctgctgcccagcgccgccgacggcagaggcaccgccatcacccacgccctgaccagcgccagcaccctgtgccaggtggagcccgtgggcagatggttcgaggccttcgtgaagagaagaaacagaaacgccagcgccagcttccaggagctggaggacaagaaggagctgagcgaggagagcgaggacgaggagctgcagctggaggagttccccatgctgaagaccctggaccccaaggactggaagaaccaggaccactacgccgtgctgggcctgggccacgtgagatacaaggccacccagagacagatcaaggccgcccacaaggccatggtgctgaagcaccaccccgacaagagaaaggccgccggcgagcccatcaaggagggcgacaacgactacttcacctgcatcaccaaggcctacgagatgctgagcgaccccgtgaagagaagagccttcaacagcgtggaccccaccttcgacaacagcgtgcccagcaagagcgaggccaaggacaacttcttcgaggtgttcacccccgtgttcgagagaaacagcagatggagcaacaagaagaacgtgcccaagctgggcgacatgaacagcagcttcgaggacgtggacatcttctacagcttctggtacaacttcgacagctggagagagttcagctacctggacgaggaggagaaggagaaggccgagtgcagagacgagagaagatggatcgagaagcagaacagagccaccagagcccagagaaagaaggaggagatgaacagaatcagaaccctggtggacaacgcctacagctgcgaccccagaatcaagaagttcaaggaggaggagaaggccaagaaggaggccgagaagaaggccaaggccgaggccaagagaaaggagcaggaggccaaggagaagcagagacaggccgagctggaggccgccagactggccaaggagaaggaggaggaggaggtgagacagcaggccctgctggccaagaaggagaaggacatccagaagaaggccatcaagaaggagagacagaagctgagaaacagctgcaagacctggaaccacttcagcgacaacgaggccgagagagtgaagatgatggaggaggtggagaagctgtgcgacagactggagctggccagcctgcagtgcctgaacgagaccctgaccagctgcaccaaggaggtgggcaaggccgccctggagaagcagatcgaggagatcaacgagcagatcagaaaggagaaggaggaggccgaggccagaatgagacaggccagcaagaacaccgagaagagcaccggcggcggcggcaacggcagcaagaactggagcgaggacgacctgcagctgctgatcaaggccgtgaacctgttccccgccggcaccaacagcagatgggaggtgatcgccaactacatgaacatccacagcagcagcggcgtgaagagaaccgccaaggacgtgatcggcaaggccaagagcctgcagaagctggacccccaccagaaggacgacatcaacaagaaggccttcgacaagttcaagaaggagcacggcgtggtgccccaggccgacaacgccacccccagcgagagattcgagggcccctacaccgacttcaccccctggaccaccgaggagcagaagctgctggagcaggccctgaagacctaccccgtgaacacccccgagagatgggagaagatcgccgaggccgtgcccggcagaaccaagaaggactgcatgaagagatacaaggagctggtggagatggtgaaggccaagaaggccgcccaggagcaggtgctgaacgccagcagagccaagaagtag

SEQ ID NO: 79526 - DNA, 609 bp, Artificial Sequence
  Description of Artificial Sequence: Synthetic coding sequence
atgctgctgctgcccagcgccgccgacggcagaggcaccgccatcacccacgccctgaccagcgccagcaccctgtgccaggtggagcccgtgggcagatggttcgaggccttcgtgaagagaagaaacagaaacgccagcgccagcttccaggagctggaggacaagaaggagctgagcgaggagagcgaggacgaggagctgcagctggaggagttccccatgctgaagaccctggaccccaaggactggaagaaccaggaccactacgccgtgctgggcctgggccacgtgagatacaaggccacccagagacagatcaaggccgcccacaaggccatggtgctgaagcaccaccccgacaagagaaaggccgccggcgagcccatcaaggagggcgacaacgactacttcacctgcatcaccaaggcctacgagatgctgagcgaccccgtgaagagaagagccttcaacagcgtggaccccaccttcgacaacagcgtgcccagcaagagcgaggccaaggacaacttcttcgaggtgttcacccccgtgttcgagagaaacagcagagtgagcatcagcaagaagaagaagaagaagagatag

SEQ ID NO: 79527 - DNA, 822 bp, Artificial Sequence
  Description of Artificial Sequence: Synthetic coding sequence
atggaggccaacatgcccaagagaaaggagcccggcagaagcctgagaatcaaggtgatcagcatgggcaacgccgaggtgggcaagagctgcatcatcaagagatactgcgagaagagattcgtgagcaagtacctggccaccatcggcatcgactacggcgtgaccaaggtgcacgtgagagacagagagatcaaggtgaacatcttcgacatggccggccaccccttcttctacgaggtgagaaacgagttctacaaggacacccagggcgtgatcctggtgtacgacgtgggccagaaggacagcttcgacgccctggacgcctggctggccgagatgaagcaggagctgggcccccacggcaacatggagaacatcatcttcgtggtgtgcgccaacaagatcgactgcaccaagcacagatgcgtggacgagagcgagggcagactgtgggccgagagcaagggcttcctgtacttcgagaccagcgcccagaccggcgagggcatcaacgagatgttccagaccttctacatcagcatcgtggacctgtgcgagaacggcggcaagagacccaccaccaacagcagcgccagcttcaccaaggagcaggccgacgccatcagaagaatcagaaacagcaaggacagctgggacatgctgggcgtgaagcccggcgccagcagagacgaggtgaacaaggcctacagaaagctggccgtgctgctgcaccccgacaagtgcgtggcccccggcagcgaggacgccttcaaggccgtggtgaacgccagaaccgccctgctgaagaacatcaagtag

SEQ ID NO: 79528 - DNA, 609 bp, Artificial Sequence
  Description of Artificial Sequence: Synthetic coding sequence
atggccggccaccccttcttctacgaggtgagaaacgagttctacaaggacacccagggcgtgatcctggtgtacgacgtgggccagaaggacagcttcgacgccctggacgcctggctggccgagatgaagcaggagctgggcccccacggcaacatggagaacatcatcttcgtggtgtgcgccaacaagatcgactgcaccaagcacagatgcgtggacgagagcgagggcagactgtgggccgagagcaagggcttcctgtacttcgagaccagcgcccagaccggcgagggcatcaacgagatgttccagaccttctacatcagcatcgtggacctgtgcgagaacggcggcaagagacccaccaccaacagcagcgccagcttcaccaaggagcaggccgacgccatcagaagaatcagaaacagcaaggacagctgggacatgctgggcgtgaagcccggcgccagcagagacgaggtgaacaaggcctacagaaagctggccgtgctgctgcaccccgacaagtgcgtggcccccggcagcgaggacgccttcaaggccgtggtgaacgccagaaccgccctgctgaagaacatcaagtag

SEQ ID NO: 79529 - DNA, 1515 bp, Artificial Sequence
  Description of Artificial Sequence: Synthetic coding sequence
atggtggcccccggcagcgtgaccagcagactgggcagcgtgttccccttcctgctggtgctggtggacctgcagtacgagggcgccgagtgcggcgtgaacgccgacgtggagaagcacctggagctgggcaagaagctgctggccgccggccagctggccgacgccctgagccagttccacgccgccgtggacggcgaccccgacaactacatcgcctactacagaagagccaccgtgttcctggccatgggcaagagcaaggccgccctgcccgacctgaccaaggtgatccagctgaagatggacttcaccgccgccagactgcagagaggccacctgctgctgaagcagggcaagctggacgaggccgaggacgacttcaagaaggtgctgaagagcaaccccagcgagaacgaggagaaggaggcccagagccagctgatcaagagcgacgagatgcagagactgagaagccaggccctgaacgccttcggcagcggcgactacaccgccgccatcgccttcctggacaagatcctggaggtgtgcgtgtgggacgccgagctgagagagctgagagccgagtgcttcatcaaggagggcgagcccagaaaggccatcagcgacctgaaggccgccagcaagctgaagaacgacaacaccgaggccttctacaagatcagcaccctgtactaccagctgggcgaccacgagctgagcctgagcgaggtgagagagtgcctgaagctggaccaggaccacaagagatgcttcgcccactacaagcaggtgaagaagctgaacaagctgatcgagagcgccgaggagctgatcagagacggcagatacaccgacgccaccagcaagtacgagagcgtgatgaagaccgagcccagcatcgccgagtacaccgtgagaagcaaggagagaatctgccactgcttcagcaaggacgagaagcccgtggaggccatcagagtgtgcagcgaggtgctgcagatggagcccgacaacgtgaacgccctgaaggacagagccgaggcctacctgatcgaggagatgtacgacgaggccatccaggactacgagaccgcccaggagcacaacgagaacgaccagcagatcagagagggcctggagaaggcccagagactgctgaagcagagccagaagagagactactacaagatcctgggcgtgaagagaaacgccaagaagcaggagatcatcaaggcctacagaaagctggccctgcagtggcaccccgacaacttccagaacgaggaggagaagaagaaggccgagaagaagttcatcgacatcgccgccgccaaggaggtgctgagcgaccccgagatgagaaagaagttcgacgacggcgaggaccccctggacgccgagagccagcagggcggcggcggcaaccccttccacagaagctggaacagctggcagggcttcaaccccttcagcagcggcggccccttcagattcaagttccacttcaactag

SEQ ID NO: 79530 - DNA, 597 bp, Artificial Sequence
  Description of Artificial Sequence: Synthetic coding sequence
atggccgaccagagacagagaagcctgagcaccagcggcgagagcctgtaccacgtgctgggcctggacaagaacgccaccagcgacgacatcaagaagagctacagaaagctggccctgaagtaccaccccgacaagaaccccgacaaccccgaggccgccgacaagttcaaggagatcaacaacgcccacgccatcctgaccgacgccaccaagagaaacatctacgacaagtacggcagcctgggcctgtacgtggccgagcagttcggcgaggagaacgtgaacacctacttcgtgctgagcagctggtgggccaaggccctgttcgtgttctgcggcctgctgacctgctgctactgctgctgctgcctgtgctgctgcttcaactgctgctgcggcaagtgcaagcccaaggcccccgagggcgaggagaccgagttctacgtgagccccgaggacctggaggcccagctgcagagcgacgagagagaggccaccgacacccccatcgtgatccagcccgccagcgccaccgagaccacccagctgaccgccgacagccaccccagctaccacaccgacggcttcaactag

SEQ ID NO: 79531 - DNA, 504 bp, Artificial Sequence
  Description of Artificial Sequence: Synthetic coding sequence
atggccgaccagagacagagaagcctgagcaccagcggcgagagcctgtaccacgtgctgggcctggacaagaacgccaccagcgacgacatcaagaagagctacagaaagctggccctgaagtaccaccccgacaagaaccccgacaaccccgaggccgccgacaagttcaaggagatcaacaacgcccacgccatcctgaccgacgccaccaagagaaacatctacgacaagtacggcagcctgggcctgtacgtggccgagcagttcggcgaggagaacgtgaacacctacttcgtgctgagcagctggtgggccaaggccctgttcgtgttctgcggcctgctgacctgctgctactgctgctgctgcctgtgctgctgcttcaactgctgctgcggcaagtgcaagcccaaggcccccgagggcgaggagaccgagttctacgtgagccccgaggacctggaggcccagctgcagagcgacgagagaggcggccactag

SEQ ID NO: 79532 - DNA, 600 bp, Artificial Sequence
  Description of Artificial Sequence: Synthetic coding sequence
atggcctgcaacatccccaaccagagacagagaaccctgagcaccaccggcgaggccctgtacgagatcctgggcctgcacaagggcgccagcaacgaggagatcaagaagacctacagaaagctggccctgaagcaccaccccgacaagaaccccgacgaccccgccgccaccgagaagttcaaggagatcaacaacgcccacgccatcctgaccgacatcagcaagagaagcatctacgacaagtacggcagcctgggcctgtacgtggccgagcagttcggcgacgagaacgtgaacacctacttcatgctgagcagctggtgggccaaggccctgttcgtgatcgtgggcctgctgaccggctgctacttctgctgctgcctgtgctgctgctgcaactgctgctgcggccactgcagacccgagagcagcgtgcccgaggaggacttctacgtgagccccgaggacctggaggagcagatcaagagcgacatggagaaggacgtggacttccccgtgttcctgcagcccaccaacgccaacgagaagacccagctgatcaaggagggcagcagaagctactgcaccgacagctag

SEQ ID NO: 79533 - DNA, 570 bp, Artificial Sequence
  Description of Artificial Sequence: Synthetic coding sequence
atgagcaccgtgaaggaggccgcccacagactgagcaagagcgagatgagcctgtacgccgtgctggacctgaagaagggcgccagccccgaggacttcaagaagagctacagccacagcgccctgctgccccacccccccttcgagtaccacctgggcagaaagctggccctgagataccaccccgacaagaaccccggcaacgcccaggccgccgagatcttcaaggagatcaacgccgcccacgccatcctgagcgacagcaagaagagaaagatctacgaccagcacggcagcctgggcatctacctgtacgaccacttcggcgaggagggcgtgagatactacttcatcctgaacagctgctggttcaagaccctggtgatcctgtgcaccctgctgacctgctgctgcttctgctgctgctgctgcttctgctgcggcgccctgaagcccccccccgagcaggacagcggcagaaagtaccagcagaacgtgcagagccagccccccagaagcggcgccaagtgcgacttcagaagcgaggagaacagcgaggacgacttctag

SEQ ID NO: 79534 - DNA, 570 bp, Artificial Sequence; identical to SEQ ID NO: 79533
  Description of Artificial Sequence: Synthetic coding sequence

SEQ ID NO: 79535 - DNA, 2703 bp, Artificial Sequence
  Description of Artificial Sequence: Synthetic coding sequence
atggagcccagctacggcggcggcctgttcgacatggtgaagggcggcgccggcagactgttcagcaacctgaaggacaacctgaaggacaccctgaaggacaccagcagcagagtgatccagagcgtgaccagctacaccaagggcgacctggacttcacctacgtgaccagcagaatcatcgtgatgagcttccccctggacaacgtggacatcggcttcagaaaccaggtggacgacatcagaagcttcctggacagcagacacctggaccactacaccgtgtacaacctgagccccaagagctacagaaccgccaagttccacagcagagtgagcgagtgcagctggcccatcagacaggcccccagcctgcacaacctgttcgccgtgtgcagaaacatgtacaactggctgctgcagaaccccaagaacgtgtgcgtggtgcactgcctggacggcagagccgccagcagcatcctggtgggcgccatgttcatcttctgcaacctgtacagcacccccggccccgccatcagactgctgtacgccaagagacccggcatcggcctgagccccagccacagaagatacctgggctacatgtgcgacctgctggccgacaagccctacagaccccacttcaagcccctgaccatcaagagcatcaccgtgagccccatccccttcttcaacaagcagagaaacggctgcagaccctactgcgacgtgctgatcggcgagaccaagatctacagcacctgcaccgacttcgagagaatgaaggagtacagagtgcaggacggcaagatcttcatccccctgaacatcaccgtgcagggcgacgtggtggtgagcatgtaccacctgagaagcaccatcggcagcagactgcaggccaaggtgaccaacacccagatcttccagctgcagttccacaccggcttcatccccctggacaccaccgtgctgaagttcaccaagcccgagctggacgcctgcgacgtgcccgagaagtacccccagctgttccaggtgaccctggacgtggagctgcagccccacgacaaggtgatcgacctgacccccccctgggagcactactgcaccaaggacgtgaaccccagcatcctgttcagcagccaccaggagcaccaggacaccctggccctgggcggccaggcccccatcgacatcccccccgacaaccccagacactacggccagagcggcttcttcgccagcctgtgctggcaggaccagaagagcgagaagagcttctgcgaggaggaccacgccgccctggtgaaccaggagagcgagcagagcgacgacgagctgctgaccctgagcagcccccacggcaacgccaacggcgacaagccccacggcgtgaagaagcccagcaagaagcagcaggagcccgccgccccccccccccccgaggacgtggacctgctgggcctggagggcagcgccatgagcaacagcttcagcccccccgccgccccccccaccaacagcgagctgctgagcgacctgttcggcggcggcggcgccgccggccccacccaggccggccagagcggcgtggaggacgtgttccaccccagcggccccgccagcacccagagcacccccagaagaagcgccaccagcaccagcgccagccccaccctgagagtgggcgagggcgccaccttcgaccccttcggcgcccccagcaagcccagcggccaggacctgctgggcagcttcctgaacaccagcagcgccagcagcgaccccttcctgcagcccaccagaagccccagccccaccgtgcacgccagcagcacccccgccgtgaacatccagcccgacgtgagcggcggctgggactggcacgccaagcccggcggcttcggcatgggcagcaagagcgccgccaccagccccaccggcagcagccacggcacccccacccaccagagcaagccccagaccctggaccccttcgccgacctgggcaccctgggcagcagcagcttcgccagcaagcccaccacccccaccggcctgggcggcggcttcccccccctgagcagcccccagaaggccagcccccagcccatgggcggcggctggcagcagggcggcgcctacaactggcagcagccccagcccaagccccagcccagcatgccccacagcagcccccagaacagacccaactacaacgtgagcttcagcgccatgcccggcggccagaacgagagaggcaagggcagcagcaacctggagggcaagcagaaggccgccgacttcgaggacctgctgagcggccagggcttcaacgcccacaaggacaagaagggccccagaaccatcgccgagatgagaaaggaggagatggccaaggagatggaccccgagaagctgaagatcctggagtggatcgagggcaaggagagaaacatcagagccctgctgagcaccatgcacaccgtgctgtgggccggcgagaccaagtggaagcccgtgggcatggccgacctggtgacccccgagcaggtgaagaaggtgtacagaaaggccgtgctggtggtgcaccccgacaaggccaccggccagccctacgagcagtacgccaagatgatcttcatggagctgaacgacgcctggagcgagttcgagaaccagggccagaagcccctgtactag

SEQ ID NO: 79536 - DNA, 2913 bp, Artificial Sequence
  Description of Artificial Sequence: Synthetic coding sequence
atgagcctgctgggcagctacagaaagaagaccagcaacgacggctacgagagcctgcagctggtggacagcaacggcgacctgagcgccggcagcggcggcgtgggcggcaagcagagagtgaacgccggcgccgccgccagaagccccgccagacagccccccgacagagccagcaccatggacagcagcggcgccagcagccccgacatggagcccagctacggcggcggcctgttcgacatggtgaagggcggcgccggcagactgttcagcaacctgaaggacaacctgaaggacaccctgaaggacaccagcagcagagtgatccagagcgtgaccagctacaccaagggcgacctggacttcacctacgtgaccagcagaatcatcgtgatgagcttccccctggacaacgtggacatcggcttcagaaaccaggtggacgacatcagaagcttcctggacagcagacacctggaccactacaccgtgtacaacctgagccccaagagctacagaaccgccaagttccacagcagagtgagcgagtgcagctggcccatcagacaggcccccagcctgcacaacctgttcgccgtgtgcagaaacatgtacaactggctgctgcagaaccccaagaacgtgtgcgtggtgcactgcctggacggcagagccgccagcagcatcctggtgggcgccatgttcatcttctgcaacctgtacagcacccccggccccgccatcagactgctgtacgccaagagacccggcatcggcctgagccccagccacagaagatacctgggctacatgtgcgacctgctggccgacaagccctacagaccccacttcaagcccctgaccatcaagagcatcaccgtgagccccatccccttcttcaacaagcagagaaacggctgcagaccctactgcgacgtgctgatcggcgagaccaagatctacagcacctgcaccgacttcgagagaatgaaggagtacagagtgcaggacggcaagatcttcatccccctgaacatcaccgtgcagggcgacgtggtggtgagcatgtaccacctgagaagcaccatcggcagcagactgcaggccaaggtgaccaacacccagatcttccagctgcagttccacaccggcttcatccccctggacaccaccgtgctgaagttcaccaagcccgagctggacgcctgcgacgtgcccgagaagtacccccagctgttccaggtgaccctggacgtggagctgcagccccacgacaaggtgatcgacctgacccccccctgggagcactactgcaccaaggacgtgaaccccagcatcctgttcagcagccaccaggagcaccaggacaccctggccctgggcggccaggcccccatcgacatcccccccgacaaccccagacactacggccagagcggcttcttcgccagcctgtgctggcaggaccagaagagcgagaagagcttctgcgaggaggaccacgccgccctggtgaaccaggagagcgagcagagcgacgacgagctgctgaccctgagcagcccccacggcaacgccaacggcgacaagccccacggcgtgaagaagcccagcaagaagcagcaggagcccgccgccccccccccccccgaggacgtggacctgctgggcctggagggcagcgccatgagcaacagcttcagcccccccgccgccccccccaccaacagcgagctgctgagcgacctgttcggcggcggcggcgccgccggccccacccaggccggccagagcggcgtggaggacgtgttccaccccagcggccccgccagcacccagagcacccccagaagaagcgccaccagcaccagcgccagccccaccctgagagtgggcgagggcgccaccttcgaccccttcggcgcccccagcaagcccagcggccaggacctgctgggcagcttcctgaacaccagcagcgccagcagcgaccccttcctgcagcccaccagaagccccagccccaccgtgcacgccagcagcacccccgccgtgaacatccagcccgacgtgagcggcggctgggactggcacgccaagcccggcggcttcggcatgggcagcaagagcgccgccaccagccccaccggcagcagccacggcacccccacccaccagagcaagccccagaccctggaccccttcgccgacctgggcaccctgggcagcagcagcttcgccagcaagcccaccacccccaccggcctgggcggcggcttcccccccctgagcagcccccagaaggccagcccccagcccatgggcggcggctggcagcagggcggcgcctacaactggcagcagccccagcccaagccccagcccagcatgccccacagcagcccccagaacagacccaactacaacgtgagcttcagcgccatgcccggcggccagaacgagagaggcaagggcagcagcaacctggagggcaagcagaaggccgccgacttcgaggacctgctgagcggccagggcttcaacgcccacaaggacaagaagggccccagaaccatcgccgagatgagaaaggaggagatggccaaggagatggaccccgagaagctgaagatcctggagtggatcgagggcaaggagagaaacatcagagccctgctgagcaccatgcacaccgtgctgtgggccggcgagaccaagtggaagcccgtgggcatggccgacctggtgacccccgagcaggtgaagaaggtgtacagaaaggccgtgctggtggtgcaccccgacaaggccaccggccagccctacgagcagtacgccaagatgatcttcatggagctgaacgacgcctggagcgagttcgagaaccagggccagaagcccctgtactag

SEQ ID NO: 79537 - DNA, 2742 bp, Artificial Sequence
  Description of Artificial Sequence: Synthetic coding sequence
atgaaggacagcgagaacaagggcgccagcagccccgacatggagcccagctacggcggcggcctgttcgacatggtgaagggcggcgccggcagactgttcagcaacctgaaggacaacctgaaggacaccctgaaggacaccagcagcagagtgatccagagcgtgaccagctacaccaagggcgacctggacttcacctacgtgaccagcagaatcatcgtgatgagcttccccctggacaacgtggacatcggcttcagaaaccaggtggacgacatcagaagcttcctggacagcagacacctggaccactacaccgtgtacaacctgagccccaagagctacagaaccgccaagttccacagcagagtgagcgagtgcagctggcccatcagacaggcccccagcctgcacaacctgttcgccgtgtgcagaaacatgtacaactggctgctgcagaaccccaagaacgtgtgcgtggtgcactgcctggacggcagagccgccagcagcatcctggtgggcgccatgttcatcttctgcaacctgtacagcacccccggccccgccatcagactgctgtacgccaagagacccggcatcggcctgagccccagccacagaagatacctgggctacatgtgcgacctgctggccgacaagccctacagaccccacttcaagcccctgaccatcaagagcatcaccgtgagccccatccccttcttcaacaagcagagaaacggctgcagaccctactgcgacgtgctgatcggcgagaccaagatctacagcacctgcaccgacttcgagagaatgaaggagtacagagtgcaggacggcaagatcttcatccccctgaacatcaccgtgcagggcgacgtggtggtgagcatgtaccacctgagaagcaccatcggcagcagactgcaggccaaggtgaccaacacccagatcttccagctgcagttccacaccggcttcatccccctggacaccaccgtgctgaagttcaccaagcccgagctggacgcctgcgacgtgcccgagaagtacccccagctgttccaggtgaccctggacgtggagctgcagccccacgacaaggtgatcgacctgacccccccctgggagcactactgcaccaaggacgtgaaccccagcatcctgttcagcagccaccaggagcaccaggacaccctggccctgggcggccaggcccccatcgacatcccccccgacaaccccagacactacggccagagcggcttcttcgccagcctgtgctggcaggaccagaagagcgagaagagcttctgcgaggaggaccacgccgccctggtgaaccaggagagcgagcagagcgacgacgagctgctgaccctgagcagcccccacggcaacgccaacggcgacaagccccacggcgtgaagaagcccagcaagaagcagcaggagcccgccgccccccccccccccgaggacgtggacctgctgggcctggagggcagcgccatgagcaacagcttcagcccccccgccgccccccccaccaacagcgagctgctgagcgacctgttcggcggcggcggcgccgccggccccacccaggccggccagagcggcgtggaggacgtgttccaccccagcggccccgccagcacccagagcacccccagaagaagcgccaccagcaccagcgccagccccaccctgagagtgggcgagggcgccaccttcgaccccttcggcgcccccagcaagcccagcggccaggacctgctgggcagcttcctgaacaccagcagcgccagcagcgaccccttcctgcagcccaccagaagccccagccccaccgtgcacgccagcagcacccccgccgtgaacatccagcccgacgtgagcggcggctgggactggcacgccaagcccggcggcttcggcatgggcagcaagagcgccgccaccagccccaccggcagcagccacggcacccccacccaccagagcaagccccagaccctggaccccttcgccgacctgggcaccctgggcagcagcagcttcgccagcaagcccaccacccccaccggcctgggcggcggcttcccccccctgagcagcccccagaaggccagcccccagcccatgggcggcggctggcagcagggcggcgcctacaactggcagcagccccagcccaagccccagcccagcatgccccacagcagcccccagaacagacccaactacaacgtgagcttcagcgccatgcccggcggccagaacgagagaggcaagggcagcagcaacctggagggcaagcagaaggccgccgacttcgaggacctgctgagcggccagggcttcaacgcccacaaggacaagaagggccccagaaccatcgccgagatgagaaaggaggagatggccaaggagatggaccccgagaagctgaagatcctggagtggatcgagggcaaggagagaaacatcagagccctgctgagcaccatgcacaccgtgctgtgggccggcgagaccaagtggaagcccgtgggcatggccgacctggtgacccccgagcaggtgaagaaggtgtacagaaaggccgtgctggtggtgcaccccgacaaggccaccggccagccctacgagcagtacgccaagatgatcttcatggagctgaacgacgcctggagcgagttcgagaaccagggccagaagcccctgtactag

SEQ ID NO: 79538 - DNA, 783 bp, Artificial Sequence
  Description of Artificial Sequence: Synthetic coding sequence
atgggcctgctggacctgtgcgaggaggtgttcggcaccgccgacctgtacagagtgctgggcgtgagaagagaggccagcgacggcgaggtgagaagaggctaccacaaggtgagcctgcaggtgcaccccgacagagtgggcgagggcgacaaggaggacgccaccagaagattccagatcctgggcaaggtgtacagcgtgctgagcgacagagagcagagagccgtgtacgacgagcagggcaccgtggacgaggacagccccgtgctgacccaggacagagactgggaggcctactggagactgctgttcaagaagatcagcctggaggacatccaggccttcgagaagacctacaagggcagcgaggaggagctggccgacatcaagcaggcctacctggacttcaagggcgacatggaccagatcatggagagcgtgctgtgcgtgcagtacaccgaggagcccagaatcagaaacatcatccagcaggccatcgacgccggcgaggtgcccagctacaacgccttcgtgaaggagagcaagcagaagatgaacgccagaaagagaagagcccaggaggaggccaaggaggccgagatgagcagaaaggagctgggcctggacgagggcgtggacagcctgaaggccgccatccagagcagacagaaggacagacagaaggagatggacaacttcctggcccagatggaggccaagtactgcaagagcagcaagggcggcggcaagaagagcgccctgaagaaggagaagaagtag

SEQ ID NO: 79539 - DNA, 1029 bp, Artificial Sequence
  Description of Artificial Sequence: Synthetic coding sequence
atgctggagaacagcctgtacagccccacctgggagggcagccagttctgggtgaccgtgcagagaaccgaggccgccgagagatgcggcctgcacggcagctacgtgctgagagtggaggccgagagactgaccctgctgaccgtgggcgcccagagccagatcctggagcccctgctgagctggccctacaccctgctgagaagatacggcagagacaaggtgatgttcagcttcgaggccggcagaagatgccccagcggccccggcaccttcaccttccagaccgcccagggcaacgacatcttccaggccgtggagaccgccatccacagacagaaggcccagggcaaggccggccagggccacgacgtgctgagagccgacagccacgagggcgaggtggccgagggcaagctgcccagcccccccggcccccaggagctgctggacagcccccccgccctgtacgccgagcccctggacagcctgagaatcgccccctgccccagccaggacagcctgtacagcgaccccctggacagcaccagcgcccaggccggcgagggcgtgcagagaaagaagcccctgtactgggacctgtacgagcacgcccagcagcagctgctgaaggccaagctgaccgaccccaaggaggaccccatctacgacgagcccgagggcctggcccccgtgcccccccagggcctgtacgacctgcccagagagcccaaggacgcctggtggtgccaggccagagtgaaggaggagggctacgagctgccctacaaccccgccaccgacgactacgccgtgcccccccccagaagcaccaagcccctgctggcccccaagccccagggccccgccttccccgagcccggcaccgccaccggcagcggcatcaagagccacaacagcgccctgtacagccaggtgcagaagagcggcgccagcggcagctgggactgcggcctgagcagagtgggcaccgacaagaccggcgtgaagagcgagggcagcacctag

SEQ ID NO: 79540 - DNA, 855 bp, Artificial Sequence
  Description of Artificial Sequence: Synthetic coding sequence
atggagcccggcatgctgggcccccacaacctgccccaccacgagcccatcagcttcggcatcgaccagatcctgagcggccccgagacccccggcggcggcctgggcctgggcagaggcggccagggccacggcgagaacggcgccttcagcggcggctaccacggcgccagcggctacggccccgccggcagcctggcccccctgcccggcagcagcggcgtgggccccggcggcgtgatcagagtgcccgcccacagacccctgcccgtgcccccccccgccggcggcgcccccgccgtgcccggccccagcggcctgggcggcgccggcggcctggccggcctgaccttcccctggatggacagcggcagaagattcgccaaggacagactgaccgccgccctgagccccttcagcggcaccagaagaatcggccacccctaccagaacagaaccccccccaagagaaagaagcccagaaccagcttcagcagaagccaggtgctggagctggagagaagattcctgagacagaagtacctggccagcgccgagagagccgccctggccaaggccctgagaatgaccgacgcccaggtgaagacctggttccagaacagaagaaccaagtggagaagacagaccgccgaggagagagaggccgagagacacagagccggcagactgctgctgcacctgcagcaggacgccctgcccagacccctgagaccccccctgccccccgaccccctgtgcctgcacaacagcagcctgttcgccctgcagaacctgcagccctgggccgaggacaacaaggtggccagcgtgagcggcctggccagcgtggtgtag

SEQ ID NO: 79541 - DNA, 1239 bp, Artificial Sequence
  Description of Artificial Sequence: Synthetic coding sequence
atgggcgacggcgccgtgaagcagggcttcctgtacctgcagcagcagcagaccttcggcaagaagtggagaagattcggcgccagcctgtacggcggcagcgactgcgccctggccagactggagctgcaggagggccccgagaagcccagaagatgcgaggccgccagaaaggtgatcagactgagcgactgcctgagagtggccgaggccggcggcgaggccagcagccccagagacaccagcgccttcttcctggagaccaaggagagactgtacctgctggccgcccccgccgccgagagaggcgactgggtgcaggccatctgcctgctggccttccccggccagagaaaggagctgagcggccccgagggcaagcagagcagaccctgcatggaggagaacgagctgtacagcagcgccgtgaccgtgggcccccacaaggagttcgccgtgaccatgagacccaccgaggccagcgagagatgccacctgagaggcagctacaccctgagagccggcgagagcgccctggagctgtggggcggccccgagcccggcacccagctgtacgactggccctacagattcctgagaagattcggcagagacaaggtgaccttcagcttcgaggccggcagaagatgcgtgagcggcgagggcaacttcgagttcgagaccagacagggcaacgagatcttcctggccctggaggaggccatcagcgcccagaagaacgccgcccccgccaccccccagccccagcccgccaccatccccgccagcctgcccagacccgacagcccctacagcagaccccacgacagcctgcccccccccagccccaccacccccgtgcccgcccccagacccagaggccaggagggcgagtacgccgtgcccttcgacgccgtggccagaagcctgggcaagaacttcagaggcatcctggccgtgcccccccagctgctggccgaccccctgtacgacagcatcgaggagaccctgccccccagacccgaccacatctacgacgagcccgagggcgtggccgccctgagcctgtacgacagcccccaggagcccagaggcgaggcctggagaagacaggccaccgccgacagagaccccgccggcctgcagcacgtgcagcccgccggccaggacttcagcgccagcggctggcagcccggcaccgagtacgacaacgtggtgctgaagaagggccccaagtag

SEQ ID NO: 79542 - DNA, 777 bp, Artificial Sequence
  Description of Artificial Sequence: Synthetic coding sequence
atgagacccaccgaggccagcgagagatgccacctgagaggcagctacaccctgagagccggcgagagcgccctggagctgtggggcggccccgagcccggcacccagctgtacgactggccctacagattcctgagaagattcggcagagacaaggtgaccttcagcttcgaggccggcagaagatgcgtgagcggcgagggcaacttcgagttcgagaccagacagggcaacgagatcttcctggccctggaggaggccatcagcgcccagaagaacgccgcccccgccaccccccagccccagcccgccaccatccccgccagcctgcccagacccgacagcccctacagcagaccccacgacagcctgcccccccccagccccaccacccccgtgcccgcccccagacccagaggccaggagggcgagtacgccgtgcccttcgacgccgtggccagaagcctgggcaagaacttcagaggcatcctggccgtgcccccccagctgctggccgaccccctgtacgacagcatcgaggagaccctgccccccagacccgaccacatctacgacgagcccgagggcgtggccgccctgagcctgtacgacagcccccaggagcccagaggcgaggcctggagaagacaggccaccgccgacagagaccccgccggcctgcagcacgtgcagcccgccggccaggacttcagcgccagcggctggcagcccggcaccgagtacgacaacgtggtgctgaagaagggccccaagtag

SEQ ID NO: 79543 - DNA, 993 bp, Artificial Sequence
  Description of Artificial Sequence: Synthetic coding sequence
atggaccccctggagacccccatcaaggacggcatcctgtaccagcagcacgtgaagttcggcaagaagtgctggagaaaggtgtgggccctgctgtacgccggcggccccagcggcgtggccagactggagagctgggaggtgagagacggcggcctgggcgccgccggcgacagaagcgccggccccggcagaagaggcgagagaagagtgatcagactggccgactgcgtgagcgtgctgcccgccgacggcgagagctgccccagagacaccggcgccttcctgctgaccaccaccgagagaagccacctgctggccgcccagcacagacaggcctggatgggccccatctgccagctggccttccccggcaccggcgaggccagcagcggcagcaccgacgcccagagccccaagagaggcctggtgcccatggaggagaacagcatctacagcagctggcaggaggtgggcgagttccccgtggtggtgcagagaaccgaggccgccaccagatgccagctgaagggccccgccctgctggtgctgggccccgacgccatccagctgagagaggccaagggcacccaggccctgtacagctggccctaccacttcctgagaaagttcggcagcgacaagatcctgctgggcacccccggcgtgagcctgctgatctgcaagggcgagagaaccgacgacgtgagcggcatcatcctggacgagagcctgctgagagcctacagcgtgcccggcgccggcggccacagcagagtgcaggacagcctgggccccgtgctgagagagcccaccttccagggcgagagaagcttcctgaagaccagcatgctgagaagcctgctgtgcagctgcagctggagacaccccagaagccagcccagaacccaggccagctgcctgcagggcagcgactgccccgccccccacagaaacagcaccagcgccgcccacaccctgggcaccagctag

SEQ ID NO: 79544 - DNA, 1491 bp, Artificial Sequence
  Description of Artificial Sequence: Synthetic coding sequence
atgaccagaggcgccagactgagaagcgacgccagagcccagctgaaccagctgagcctggacggcggcaccggcagcggccagaagggcaagtgcgaggagttccccagcagcctgagcagcgtgagccccggcctggaggccgccgccctgctgctggccgtgaccatggaccccctggagacccccatcaaggacggcatcctgtaccagcagcacgtgaagttcggcaagaagtgctggagaaaggtgtgggccctgctgtacgccggcggccccagcggcgtggccagactggagagctgggaggtgagagacggcggcctgggcgccgccggcgacagaagcgccggccccggcagaagaggcgagagaagagtgatcagactggccgactgcgtgagcgtgctgcccgccgacggcgagagctgccccagagacaccggcgccttcctgctgaccaccaccgagagaagccacctgctggccgcccagcacagacaggcctggatgggccccatctgccagctggccttccccggcaccggcgaggccagcagcggcagcaccgacgcccagagccccaagagaggcctggtgcccatggaggagaacagcatctacagcagctggcaggaggtgggcgagttccccgtggtggtgcagagaaccgaggccgccaccagatgccagctgaagggccccgccctgctggtgctgggccccgacgccatccagctgagagaggccaagggcacccaggccctgtacagctggccctaccacttcctgagaaagttcggcagcgacaagggcgtgttcagcttcgaggccggcagaagatgccacagcggcgagggcctgttcgccttcagcaccccctgcgcccccgacctgtgcagagccgtggccggcgccatcgccagacagagagagagactgcccgagctgaccagaccccagccctgccccctgcccagagccaccagcctgcccagcctggacacccccggcgagctgagagagatgccccccggccccgagccccccaccagcagaaagatgcacctggccgagcccggcccccagagcctgcccctgctgctgggccccgagcccaacgacctggccagcggcctgtacgccagcgtgtgcaagagagccagcggcccccccggcaacgagcacctgtacgagaacctgtgcgtgctggaggccagccccaccctgcacggcggcgagcccgagccccacgagggccccggcagcagaagccccaccaccagccccatctaccacaacggccaggacctgagctggcccggccccgccaacgacagcaccctggaggcccagtacagaagactgctggagctggaccaggtggagggcaccggcagacccgacccccaggccggcttcaaggccaagctggtgaccctgctgagcagagagagaagaaagggccccgccccctgcgacagaccctag

SEQ ID NO: 79545 - DNA, 687 bp, Artificial Sequence
  Description of Artificial Sequence: Synthetic coding sequence
atggaccccctggagacccccatcaaggacggcatcctgtaccagcagcacgtgaagttcggcaagggcaccggcgaggccagcagcggcagcaccgacgcccagagccccaagagaggcctggtgcccatggaggagaacagcatctacagcagctggcaggaggtgggcgagttccccgtggtggtgcagagaaccgaggccgccaccagatgccagctgaagggccccgccctgctggtgctgggccccgacgccatccagctgagagaggccaagggcacccaggccctgtacagctggccctaccacttcctgagaaagttcggcagcgacaagatcctgctgggcacccccggcgtgagcctgctgatctgcaagggcgagagaaccgacgacgtgagcggcatcatcctggacgagagcctgctgagagcctacagcgtgcccggcgccggcggccacagcagagtgcaggacagcctgggccccgtgctgagagagcccaccttccagggcgagagaagcttcctgaagaccagcatgctgagaagcctgctgtgcagctgcagctggagacaccccagaagccagcccagaacccaggccagctgcctgcagggcagcgactgccccgccccccacagaaacagcaccagcgccgcccacaccctgggcaccagctag

SEQ ID NO: 79546 - DNA, 435 bp, Artificial Sequence
  Description of Artificial Sequence: Synthetic coding sequence
atggaccccctggagacccccatcaaggacggcatcctgtaccagcagcacgtgaagttcggcaagaagtgctggagaaaggtgtgggccctgctgtacgccggcggccccagcggcgtggccagactggagagctgggaggtgagagacggcggcctgggcgccgccggcgacagaagcgccggccccggcagaagaggcgagagaagagtgatcagactggccgactgcgtgagcgtgctgcccgccgacggcgagagctgccccagagacaccggcgccttcctgctgaccaccaccgagagaagccacctgctggccgcccagcacagacaggcctggatgggccccatctgccagctggccttccccggcaccggcgaggccagcagcggcagcaccgacgcccagagccccaagagaggcctggtgtag

SEQ ID NO: 79547 - DNA, 471 bp, Artificial Sequence
  Description of Artificial Sequence: Synthetic coding sequence
atggaccccctggagacccccatcaaggacggcatcctgtaccagcagcacgtgaagttcggcaagaagtgctggagaaaggtgtgggccctgctgtacgccggcggccccagcggcgtggccagactggagagctgggaggtgagagacggcggcctgggcgccgccggcgacagaagcgccggccccggcagaagaggcgagagaagagtgatcagactggccgactgcgtgagcgtgctgcccgccgacggcgagagctgccccagagacaccggcgccttcctgctgaccaccaccgagagaagccacctgctggccgcccagcacagacaggcctggatgggccccatctgccagctggccttccccggcaccggcgaggccagcagcggcagcaccgacgcccagagccccaagagaggcctggtgcccatggaggagaacagcatctacagcagctggcagtag

SEQ ID NO: 79548 - DNA, 132 bp, Artificial Sequence
  Description of Artificial Sequence: Synthetic coding sequence
atggaccccctggagacccccatcaaggacggcatcctgtaccagcagcacgtgaagttcggcaagaagtgctggagaaaggtgtgggccctgctgtacgccggcggccccagcggcgtggccagactgtag

SEQ ID NO: 79549 - DNA, 642 bp, Artificial Sequence
  Description of Artificial Sequence: Synthetic coding sequence
atggaccccctggagacccccatcaaggacggcatcctgtaccagcagcacgtgaagttcggcaagaagtgctggagaaaggtgtgggccctgctgtacgccggcggccccagcggcgtggccagactggagagctgggaggtgagagacggcggcctgggcgccgccggcgacagaagcgccggccccggcagaagaggcgagagaagagtgatcagactggccgactgcgtgagcgtgctgcccgccgacggcgagagctgccccagagacaccggcgccttcctgctgaccaccaccgagagaagccacctgctggccgcccagcacagacaggcctggatgggccccatctgccagctggccttccccggcaccggcgaggccagcagcggcagcaccgacgcccagagccccaagagaggcctggtgcccatggaggagaacagcatctacagcagctggcaggaggtgggcgagttccccgtggtggtgcagagaaccgaggccgccaccagatgccagctgaagggccccgccctgctggtgctgggccccgacgccatccagctgagagaggccaagggcacccaggccctgtacagctggccctaccacttcctgagaaagttcggcagctag

SEQ ID NO: 79550 - DNA, 42 bp, Artificial Sequence
  Description of Artificial Sequence: Synthetic coding sequence
atggaccccctggagacccccatcaaggacggcatcctgtag

SEQ ID NO: 79551 - DNA, 258 bp, Artificial Sequence
  Description of Artificial Sequence: Synthetic coding sequence
atggaccccctggagacccccatcaaggacggcatcctgtaccagcagcacgtgaagttcggcaagaagtgctggagaaaggtgtgggccctgctgtacgccggcggccccagcggcgtggccagactggagagctgggaggtgagagacggcggcctgggcgccgccggcgacagaagcgccggccccggcagaagaggcgagagaagagtgatcagactggccgactgcgtgagcgtgctgcccgccgacggctag

SEQ ID NO: 79552 - DNA, 981 bp, Artificial Sequence
  Description of Artificial Sequence: Synthetic coding sequence
atggccaccaacttcagcgacatcgtgaagcagggctacgtgaagatgaagagcagaaagctgggcatctacagaagatgctggctggtgttcagaaagagcagcagcaagggcccccagagactggagaagtaccccgacgagaagagcgtgtgcctgagaggctgccccaaggtgaccgagatcagcaacgtgaagtgcgtgaccagactgcccaaggagaccaagagacaggccgtggccatcatcttcaccgacgacagcgccagaaccttcacctgcgacagcgagctggaggccgaggagtggtacaagaccctgagcgtggagtgcctgggcagcagactgaacgacatcagcctgggcgagcccgacctgctggcccccggcgtgcagtgcgagcagaccgacagattcaacgtgttcctgctgccctgccccaacctggacgtgtacggcgagtgcaagctgcagatcacccacgagaacatctacctgtgggacatccacaaccccagagtgaagctggtgagctggcccctgtgcagcctgagaagatacggcagagacgccaccagattcaccttcgaggccggcagaatgtgcgacgccggcgagggcctgtacaccttccagacccaggagggcgagcagatctaccagagagtgcacagcgccaccctggccatcgccgagcagcacaagagagtgctgctggagatggagaagaacgtgagactgctgaacaagggcaccgagcactacagctacccctgcacccccaccaccatgctgcccagaagcgcctactggcaccacatcaccggcagccagaacatcgccgaggccagcagctacgccggcgagggctacggcgccgcccaggccagcagcgagaccgacctgctgaacagattcatcctgctgaagcccaagcccagccagggcgacagcagcgaggccaagacccccagccagtag

SEQ ID NO: 79553 - DNA, 921 bp, Artificial Sequence
  Description of Artificial Sequence: Synthetic coding sequence
atggccagcaacttcaacgacatcgtgaagcagggctacgtgagaatcagaagcagaagactgggcatctaccagagatgctggctggtgttcaagaaggccagcagcaagggccccaagagactggagaagttcagcgacgagagagccgcctacttcagatgctaccacaaggtgaccgagctgaacaacgtgaagaacgtggccagactgcccaagagcaccaagaagcacgccatcggcatctacttcaacgacgacaccagcaagaccttcgcctgcgagagcgacctggaggccgacgagtggtgcaaggtgctgcagatggagtgcgtgggcaccagaatcaacgacatcagcctgggcgagcccgacctgctggccaccggcgtggagagagagcagagcgagagattcaacgtgtacctgatgcccagccccaacctggacgtgcacggcgagtgcgccctgcagatcacctacgagtacatctgcctgtgggacgtgcagaaccccagagtgaagctgatcagctggcccctgagcgccctgagaagatacggcagagacaccacctggttcaccttcgaggccggcagaatgtgcgagaccggcgagggcctgttcatcttccagaccagagacggcgaggccatctaccagaaggtgcacagcgccgccctggccatcgccgagcagcacgagagactgctgcagagcgtgaagaacagcatgctgcagatgaagatgagcgagagagccgccagcctgagcaccatggtgcccctgcccagaagcgcctactggcagcacatcaccagacagcacagcaccggccagctgtacagactgcaggacgtgagcagccccctgaagctgcacagaaccgagaccttccccgcctacagaagcgagcactag

SEQ ID NO: 79554 - DNA, 1515 bp, Artificial Sequence
  Description of Artificial Sequence: Synthetic coding sequence
atgaccgaggccgccctggtggagggccaggtgaagctgagagacggcaagaagtggaagagcagatggctggtgctgagaaagcccagccccgtggccgactgcctgctgatgctggtgtacaaggacaagagcgagagaatcaagggcctgagagagagaagcagcctgaccctggaggacatctgcggcctggagcccggcctgccctacgagggcctggtgcacaccctggccatcgtgtgcctgagccaggccatcatgctgggcttcgacagccacgaggccatgtgcgcctgggacgccagaatcagatacgccctgggcgaggtgcacagattccacgtgaccgtggcccccggcaccaagctggagagcggccccgccaccctgcacctgtgcaacgacgtgctggtgctggccagagacatcccccccgccgtgaccggccagtggaagctgagcgacctgagaagatacggcgccgtgcccagcggcttcatcttcgagggcggcaccagatgcggctactgggccggcgtgttcttcctgagcagcgccgagggcgagcagatcagcttcctgttcgactgcatcgtgagaggcatcagccccaccaagggccccttcggcctgagacccgtgctgcccgaccccagcccccccggccccagcaccgtggaggagagagtggcccaggaggccctggagaccctgcagctggagaagagactgagcctgctgagccacgccggcagacccggcagcggcggcgacgacagaagcctgagcagcagcagcagcgaggccagccacctggacgtgagcgccagcagcagactgaccgcctggcccgagcagagcagcagcagcgccagcaccagccaggagggccccagacccgccgccgcccaggccgccggcgaggccatggtgggcgccagcagacccccccccaagcccctgagacccagacagctgcaggaggtgggcagacagagcagcagcgacagcggcatcgccaccggcagccacagcagctacagcagcagcctgagcagctacgccggcagcagcctggacgtgtggagagccaccgacgagctgggcagcctgctgagcctgcccgccgccggcgcccccgagcccagcctgtgcacctgcctgcccggcaccgtggagtaccaggtgcccaccagcctgagagcccactacgacacccccagaagcctgtgcctggcccccagagaccacagcccccccagccagggcagccccggcaacagcgccgccagagacagcggcggccagaccagcgccggctgccccagcggctggctgggcaccagaagaagaggcctggtgatggaggccccccagggcagcgaggccaccctgcccggccccgcccccggcgagccctgggaggccggcggcccccacgccggccccccccccgccttcttcagcgcctgccccgtgtgcggcggcctgaaggtgaacccccccccctag

SEQ ID NO: 79555 - DNA, 1827 bp, Artificial Sequence
  Description of Artificial Sequence: Synthetic coding sequence
atgaccgaggccgccctggtggagggccaggtgaagctgagagacggcaagaagtggaagagcagatggctggtgctgagaaagcccagccccgtggccgactgcctgctgatgctggtgtacaaggacaagagcgagagaatcaagggcctgagagagagaagcagcctgaccctggaggacatctgcggcctggagcccggcctgccctacgagggcctggtgcacaccctggccatcgtgtgcctgagccaggccatcatgctgggcttcgacagccacgaggccatgtgcgcctgggacgccagaatcagatacgccctgggcgaggtgcacagattccacgtgaccgtggcccccggcaccaagctggagagcggccccgccaccctgcacctgtgcaacgacgtgctggtgctggccagagacatcccccccgccgtgaccggccagtggaagctgagcgacctgagaagatacggcgccgtgcccagcggcttcatcttcgagggcggcaccagatgcggctactgggccggcgtgttcttcctgagcagcgccgagggcgagcagatcagcttcctgttcgactgcatcgtgagaggcatcagccccaccaagggccccttcggcctgagacccgtgctgcccgaccccagcccccccggccccagcaccgtggaggagagagtggcccaggaggccctggagaccctgcagctggagaagagactgagcctgctgagccacgccggcagacccggcagcggcggcgacgacagaagcctgagcagcagcagcagcgaggccagccacctggacgtgagcgccagcagcagactgaccgcctggcccgagcagagcagcagcagcgccagcaccagccaggagggccccagacccgccgccgcccaggccgccggcgaggccatggtgggcgccagcagacccccccccaagcccctgagacccagacagctgcaggaggtgggcagacagagcagcagcgacagcggcatcgccaccggcagccacagcagctacagcagcagcctgagcagctacgccggcagcagcctggacgtgtggagagccaccgacgagctgggcagcctgctgagcctgcccgccgccggcgcccccgagcccagcctgtgcacctgcctgcccggcaccgtggagtaccaggtgcccaccagcctgagagcccactacgacacccccagaagcctgtgcctggcccccagagaccacagcccccccagccagggcagccccggcaacagcgccgccagagacagcggcggccagaccagcgccggctgccccagcggctggctgggcaccagaagaagaggcctggtgatggaggccccccagggcagcgaggccaccctgcccggccccgcccccggcgagccctgggaggccggcggcccccacgccggccccccccccgccttcttcagcgcctgccccgtgtgcggcggcctgaagggcgccgccgccagcgcccccggccccgccaccgcccacagcggcagccccggccccgtggccgtggacagccccggccccgagagacccagaggcgagagccccacctacgtgaacatccccgtgagccccagcagcagaaagcagctgcactacatgggcctggagctgcaggaggccagcgagggcgtgagaggcgccggcgccagcctgtacgcccagatcgacatcatggccaccgagaccgcccacagagtgggcgtgagacacgccagagccagagaggagcagctgagcgagctggagcagagaaaggccgccccccagtag

SEQ ID NO: 79556 - DNA, 768 bp, Artificial Sequence
  Description of Artificial Sequence: Synthetic coding sequence
atgaccgaggccgccctggtggagggccaggtgaagctgagagacggcaagaagtggaagagcagatggctggtgctgagaaagcccagccccgtggccgactgcctgctgatgctggtgtacaaggacaagagcgagagaatcaagggcctgagagagagaagcagcctgaccctggaggacatctgcggcctggagcccggcctgccctacgagggcctggtgcacaccctggccatcgtgtgcctgagccaggccatcatgctgggcttcgacagccacgaggccatgtgcgcctgggacgccagaatcagatacgccctgggcgaggtgcacagattccacgtgaccgtggcccccggcaccaagctggagagcggccccgccaccctgcacctgtgcaacgacgtgctggtgctggccagagacatcccccccgccgtgaccggccagtggaagctgagcgacctgagaagatacggcgccgtgcccagcggcttcatcttcgagggcggcaccagaggctggagactgctgcccgtgctgggcagaggcggcgccgaccagctgcccgtgagactgcacagacccagacacctgccccaccagggccccctgtgggccgccgccggcagcaccagacccaagagccccggcaccctggactgcggcggcgcctgcggccccggcagccccggcaaccccaccgccggcgaggccgccgagccccccctgacctgcggccaggccggccagtggagaggctag

SEQ ID NO: 79557 - DNA, 1371 bp, Artificial Sequence
  Description of Artificial Sequence: Synthetic coding sequence
atgggctacttcagatgcgccagagccggcagcttcggcagaagaagaaagatggagcccagcaccgccgccagagcctgggccctgttctggctgctgctgcccctgctgggcgccgtgtgcgccagcggccccagaaccctggtgctgctggacaacctgaacgtgagagagacccacagcctgttcttcagaagcctgaaggacagaggcttcgagctgaccttcaagaccgccgacgaccccagcctgagcctgatcaagtacggcgagttcctgtacgacaacctgatcatcttcagccccagcgtggaggacttcggcggcaacatcaacgtggagaccatcagcgccttcatcgacggcggcggcagcgtgctggtggccgccagcagcgacatcggcgaccccctgagagagctgggcagcgagtgcggcatcgagttcgacgaggagaagaccgccgtgatcgaccaccacaactacgacatcagcgacctgggccagcacaccctgatcgtggccgacaccgagaacctgctgaaggcccccaccatcgtgggcaagagcagcctgaaccccatcctgttcagaggcgtgggcatggtggccgaccccgacaaccccctggtgctggacatcctgaccggcagcagcaccagctacagcttcttccccgacaagcccatcacccagtacccccacgccgtgggcaagaacaccctgctgatcgccggcctgcaggccagaaacaacgccagagtgatcttcagcggcagcctggacttcttcagcgacagcttcttcaacagcgccgtgcagaaggccgcccccggcagccagagatacagccagaccggcaactacgagctggccgtggccctgagcagatgggtgttcaaggaggagggcgtgctgagagtgggccccgtgagccaccacagagtgggcgagaccgccccccccaacgcctacaccgtgaccgacctggtggagtacagcatcgtgatccagcagctgagcaacggcaagtgggtgcccttcgacggcgacgacatccagctggagttcgtgagaatcgaccccttcgtgagaaccttcctgaagaagaagggcggcaagtacagcgtgcagttcaagctgcccgacgtgtacggcgtgttccagttcaaggtggactacaacagactgggctacacccacctgtacagcagcacccaggtgagcgtgagacccctgcagcacacccagtacgagagattcatccccagcgcctacccctactacgccagcgccttcagcatgatgctgggcctgttcatcttcagcatcgtgttcctgcacatgaaggagaaggagaagagcgactag

SEQ ID NO: 79558 - DNA, 1260 bp, Artificial Sequence
  Description of Artificial Sequence: Synthetic coding sequence
atgggctacttcagatgcgccagagccggcagcttcggcagaagaagaaagatggagcccagcaccgccgccagagcctgggccctgttctggctgctgctgcccctgctgggcgccgtgtgcgccagcggccccagaaccctggtgctgctggacaacctgaacgtgagagagacccacagcctgttcttcagaagcctgaaggacttcggcggcaacatcaacgtggagaccatcagcgccttcatcgacggcggcggcagcgtgctggtggccgccagcagcgacatcggcgaccccctgagagagctgggcagcgagtgcggcatcgagttcgacgaggagaagaccgccgtgatcgaccaccacaactacgacatcagcgacctgggccagcacaccctgatcgtggccgacaccgagaacctgctgaaggcccccaccatcgtgggcaagagcagcctgaaccccatcctgttcagaggcgtgggcatggtggccgaccccgacaaccccctggtgctggacatcctgaccggcagcagcaccagctacagcttcttccccgacaagcccatcacccagtacccccacgccgtgggcaagaacaccctgctgatcgccggcctgcaggccagaaacaacgccagagtgatcttcagcggcagcctggacttcttcagcgacagcttcttcaacagcgccgtgcagaaggccgcccccggcagccagagatacagccagaccggcaactacgagctggccgtggccctgagcagatgggtgttcaaggaggagggcgtgctgagagtgggccccgtgagccaccacagagtgggcgagaccgccccccccaacgcctacaccgtgaccgacctggtggagtacagcatcgtgatccagcagctgagcaacggcaagtgggtgcccttcgacggcgacgacatccagctggagttcgtgagaatcgaccccttcgtgagaaccttcctgaagaagaagggcggcaagtacagcgtgcagttcaagctgcccgacgtgtacggcgtgttccagttcaaggtggactacaacagactgggctacacccacctgtacagcagcacccaggtgagcgtgagacccctgcagcacacccagtacgagagattcatccccagcgcctacccctactacgccagcgccttcagcatgatgctgggcctgttcatcttcagcatcgtgttcctgcacatgaaggagaaggagaagagcgactag

SEQ ID NO: 79559 - DNA, 279 bp, Artificial Sequence
  Description of Artificial Sequence: Synthetic coding sequence
atgaccaagctggcccagtggctgtggggcctggccatcctgggcagcacctgggtggccctgaccaccggcgccctgggcctggagctgcccctgagctgccaggaggtgctgtggcccctgcccgcctacctgctggtgagcgccggctgctacgccctgggcaccgtgggctacagagtggccaccttccacgactgcgaggacgccgccagagagctgcagagccagatccaggaggccagagccgacctggccagaagaggcctgagattctag

SEQ ID NO: 79560 - DNA, 369 bp, Artificial Sequence
  Description of Artificial Sequence: Synthetic coding sequence
atgctgagcgtgggcggcctgagactgagcctggtgagattcagcttcctgctgctgagaggcgccctgctgcccagcctggccgtgaccatgaccaagctggcccagtggctgtggggcctggccatcctgggcagcacctgggtggccctgaccaccggcgccctgggcctggagctgcccctgagctgccaggaggtgctgtggcccctgcccgcctacctgctggtgagcgccggctgctacgccctgggcaccgtgggctacagagtggccaccttccacgactgcgaggacgccgccagagagctgcagagccagatccaggaggccagagccgacctggccagaagaggcctgagattctag

SEQ ID NO: 79561 - DNA, 279 bp, Artificial Sequence; identical to SEQ ID NO: 79559
  Description of Artificial Sequence: Synthetic coding sequence

SEQ ID NO: 79562 - DNA, 1191 bp, Artificial Sequence
  Description of Artificial Sequence: Synthetic coding sequence
atggaccccagaggcaccaagagaggcgccgagaagaccgaggtggccgagcccagaaacaagctgcccagacccgcccccagcctgcccaccgaccccgccctgtacagcggccccttccccttctacagaagacccagcgagctgggctgcttcagcctggacgcccagagacagtaccacggcgacgccagagccctgagatactacagccccccccccaccaacggccccggccccaacttcgacctgagagacggctaccccgacagataccagcccagagacgaggaggtgcaggagagactggaccacctgctgtgctggctgctggagcacagaggcagactggagggcggccccggctggctggccgaggccatcgtgacctggagaggccacctgaccaagctgctgaccaccccctacgagagacaggagggctggcagctggccgccagcagattccagggcaccctgtacctgagcgaggtggagacccccaacgccagagcccagagactggccagaccccccctgctgagagagctgatgtacatgggctacaagttcgagcagtacatgtgcgccgacaagcccggcagcagccccgaccccagcggcgaggtgaacaccaacgtggccttctgcagcgtgctgagaagcagactgggcagccaccccctgctgttcagcggcgaggtggactgcaccgacccccaggcccccagcacccagccccccacctgctacgtggagctgaagaccagcaaggagatgcacagccccggccagtggagaagcttctacagacacaagctgctgaagtggtgggcccagagcttcctgcccggcgtgcccaacgtggtggccggcttcagaaaccccgacggcttcgtgagcagcctgaagaccttccccaccatgaagatgttcgagtacgtgagaaacgacagagacggctggaaccccagcgtgtgcatgaacttctgcgccgccttcctgagcttcgcccagagcaccgtggtgcaggacgaccccagactggtgcacctgttcagctgggagcccggcggccccgtgaccgtgagcgtgcaccaggacgccccctacgccttcctgcccatctggtacgtggaggccatgacccaggacctgcccagcccccccaagacccccagccccaagtag

SEQ ID NO: 79563 - DNA, 1191 bp, Artificial Sequence; identical to SEQ ID NO: 79562
  Description of Artificial Sequence: Synthetic coding sequence

SEQ ID NO: 79564 - DNA, 1191 bp, Artificial Sequence; identical to SEQ ID NO: 79562
  Description of Artificial Sequence: Synthetic coding sequence

SEQ ID NO: 79565 - DNA, 1191 bp, Artificial Sequence; identical to SEQ ID NO: 79562
  Description of Artificial Sequence: Synthetic coding sequence

SEQ ID NO: 79566 - DNA, 1191 bp, Artificial Sequence; identical to SEQ ID NO: 79562
  Description of Artificial Sequence: Synthetic coding sequence

SEQ ID NO: 79567 - DNA, 1191 bp, Artificial Sequence; identical to SEQ ID NO: 79562
  Description of Artificial Sequence: Synthetic coding sequence

SEQ ID NO: 79568 - DNA, 1191 bp, Artificial Sequence
  Description of Artificial Sequence: Synthetic coding sequence
atggaccccagaggcaccaagagaggcgccgagaagaccgaggtggccgagcccagaaacaagctgcccagacccgcccccagcctgcccaccgaccccgccctgtacagcggccccttccccttctacagaagacccagcgagctgggctgcttcagcctggacgcccagagacagtaccacggcgacgccagagccctgagatactacagccccccccccaccaacggccccggccccaacttcgacctgagagacggctaccccgacagataccagcccagagacgaggaggtgcaggagagactggaccacctgctgtgctggctgctggagcacagaggcagactggagggcggccccggctggctggccgaggccatcgtgacctggagaggccacctgaccaagctgctgaccaccccctacgagagacaggagggctggcagctggccgccagcagattccagggcaccctgtacctgagcgaggtggagacccccaacgccagagcccagagactggccagaccccccctgctgagagagctgatgtacatgggctacaagttcgagcagtacatgtgcgccgacaagcccggcagcagccccgaccccagcggcgaggtgaacaccaacgtggccttctgcagcgtgctgagaagcagactgggcagccaccccctgctgttcagcggcgaggtggactgcaccgacccccaggcccccagcacccagccccccacctgctacgtggagctgaagaccagcaaggagatgcagagccccggccagtggagaagcttctacagacacaagctgctgaagtggtgggcccagagcttcctgcccggcgtgcccaacgtggtggccggcttcagaaaccccgacggcttcgtgagcagcctgaagaccttccccaccatgaagatgttcgagtacgtgagaaacgacagagacggctggaaccccagcgtgtgcatgaacttctgcgccgccttcctgagcttcgcccagagcaccgtggtgcaggacgaccccagactggtgcacctgttcagctgggagcccggcggccccgtgaccgtgagcgtgcaccaggacgccccctacgccttcctgcccatctggtacgtggaggccatgacccaggacctgcccagcccccccaagacccccagccccaagtag

SEQ ID NO: 79569 - DNA, 1191 bp, Artificial Sequence; identical to SEQ ID NO: 79562
  Description of Artificial Sequence: Synthetic coding sequence

SEQ ID NO: 79570 - DNA, 1191 bp, Artificial Sequence; identical to SEQ ID NO: 79562
  Description of Artificial Sequence: Synthetic coding sequence

SEQ ID NO: 79571 - DNA, 1191 bp, Artificial Sequence; identical to SEQ ID NO: 79562
  Description of Artificial Sequence: Synthetic coding sequence

SEQ ID NO: 79572 - DNA, 1191 bp, Artificial Sequence; identical to SEQ ID NO: 79562
  Description of Artificial Sequence: Synthetic coding sequence

SEQ ID NO: 79573 - DNA, 1191 bp, Artificial Sequence; identical to SEQ ID NO: 79568
  Description of Artificial Sequence: Synthetic coding sequence

SEQ ID NO: 79574 - DNA, 1191 bp, Artificial Sequence; identical to SEQ ID NO: 79562
  Description of Artificial Sequence: Synthetic coding sequence

SEQ ID NO: 79575 - DNA, 1191 bp, Artificial Sequence; identical to SEQ ID NO: 79562
  Description of Artificial Sequence: Synthetic coding sequence

SEQ ID NO: 79576 - DNA, 1191 bp, Artificial Sequence; identical to SEQ ID NO: 79562
  Description of Artificial Sequence: Synthetic coding sequence

SEQ ID NO: 79577 - DNA, 1191 bp, Artificial Sequence; identical to SEQ ID NO: 79562
  Description of Artificial Sequence: Synthetic coding sequence

SEQ ID NO: 79578 - DNA, 1191 bp, Artificial Sequence; identical to SEQ ID NO: 79562
  Description of Artificial Sequence: Synthetic coding sequence

SEQ ID NO: 79579 - DNA, 1191 bp, Artificial Sequence; identical to SEQ ID NO: 79568
  Description of Artificial Sequence: Synthetic coding sequence

SEQ ID NO: 79580 - DNA, 1443 bp, Artificial Sequence
  Description of Artificial Sequence: Synthetic coding sequence
atgaacgccagcgagttcagaagaagaggcaaggagatggtggactacatggccaactacatggagggcatcgagggcagacaggtgtaccccgacgtggagcccggctacctgagacccctgatccccgccgccgccccccaggagcccgacaccttcgaggacatcatcaacgacgtggagaagatcatcatgcccggcgtgacccactggcacagcccctacttcttcgcctacttccccaccgccagcagctaccccgccatgctggccgacatgctgtgcggcgccatcggctgcatcggcttcagctgggccgccagccccgcctgcaccgagctggagaccgtgatgatggactggctgggcaagatgctggagctgcccaaggccttcctgaacgagaaggccggcgagggcggcggcgtgatccagggcagcgccagcgaggccaccctggtggccctgctggccgccagaaccaaggtgatccacagactgcaggccgccagccccgagctgacccaggccgccatcatggagaagctggtggcctacagcagcgaccaggcccacagcagcgtggagagagccggcctgatcggcggcgtgaagctgaaggccatccccagcgacggcaacttcgccatgagagccagcgccctgcaggaggccctggagagagacaaggccgccggcctgatccccttcttcatggtggccaccctgggcaccaccacctgctgcagcttcgacaacctgctggaggtgggccccatctgcaacaaggaggacatctggctgcacgtggacgccgcctacgccggcagcgccttcatctgccccgagttcagacacctgctgaacggcgtggagttcgccgacagcttcaacttcaacccccacaagtggctgctggtgaacttcgactgcagcgccatgtgggtgaagaagagaaccgacctgaccggcgccttcagactggaccccacctacctgaagcacagccaccaggacagcggcctgatcaccgactacagacactggcagatccccctgggcagaagattcagaagcctgaagatgtggttcgtgttcagaatgtacggcgtgaagggcctgcaggcctacatcagaaagcacgtgcagctgagccacgagttcgagagcctggtgagacaggaccccagattcgagatctgcgtggaggtgatcctgggcctggtgtgcttcagactgaagggcagcaacaaggtgaacgaggccctgctgcagagaatcaacagcgccaagaagatccacctggtgccctgccacctgagagacaagttcgtgctgagattcgccatctgcagcagaaccgtggagagcgcccacgtgcagagagcctgggagcacatcaaggagctggccgccgacgtgctgagagccgagagagagtag

SEQ ID NO: 79581 - DNA, 96 bp, Artificial Sequence
  Description of Artificial Sequence: Synthetic coding sequence
atgaacgccagcgagttcagaagaagaggcaaggagatggtggactacatggccaactacatggagggcatcgagggcagacaggtgtacccctag

SEQ ID NO: 79582 - DNA, 51 bp, Artificial Sequence
  Description of Artificial Sequence: Synthetic coding sequence
atgaacgccagcgagttcagaagaagaggcaaggagatggtggactactag

SEQ ID NO: 79583 - DNA, 1443 bp, Artificial Sequence; identical to SEQ ID NO: 79580
  Description of Artificial Sequence: Synthetic coding sequence

SEQ ID NO: 79584 - DNA, 1017 bp, Artificial Sequence
  Description of Artificial Sequence: Synthetic coding sequence
atgaacgccagcgagttcagaagaagaggcaaggagatggtggactacatggccaactacatggagggcatcgagggcagacaggtgtaccccgacgtggagcccggctacctgagacccctgatccccgccgccgccccccaggagcccgacaccttcgaggacatcatcaacgacgtggagaagatcatcatgcccggcgtgacccactggcacagcccctacttcttcgcctacttccccaccgccagcagctaccccgccatgctggccgacatgctgtgcggcgccatcggctgcatcggcttcagctgggccgccagccccgcctgcaccgagctggagaccgtgatgatggactggctgggcaagatgctggagctgcccaaggccttcctgaacgagaaggccggcgagggcggcggcgtgatccagggcagcgccagcgaggccaccctggtggccctgctggccgccagaaccaaggtgatccacagactgcaggccgccagccccgagctgacccaggccgccatcatggagaagctggtggcctacagcagcgaccaggcccacagcagcgtggagagagccggcctgatcggcggcgtgaagctgaaggccatccccagcgacggcaacttcgccatgagagccagcgccctgcaggaggccctggagagagacaaggccgccggcctgatccccttcttcatggtggccaccctgggcaccaccacctgctgcagcttcgacaacctgctggaggtgggccccatctgcaacaaggaggacatctggctgcacgtggacgccgcctacgccggcagcgccttcatctgccccgagttcagacacctgctgaacggcgtggagttcgccgacagcttcaacttcaacccccacaagtggctgctggtgaacttcgactgcagcgccatgtggagcagacagcccgtgagaatgctgagactgaagaagacctgcctggtgagcgccgtggtgagaagaagctag

SEQ ID NO: 79585 - DNA, 1209 bp, Artificial Sequence
  Description of Artificial Sequence: Synthetic coding sequence
atgaacgccagcgagttcagaagaagaggcaaggagatggtggactacatggccaactacatggagggcatcgagggcagacaggtgtaccccgacgtggagcccggctacctgagacccctgatccccgccgccgccccccaggagcccgacaccttcgaggacatcatcaacgacgtggagaagatcatcatgcccggcggcagcgccagcgaggccaccctggtggccctgctggccgccagaaccaaggtgatccacagactgcaggccgccagccccgagctgacccaggccgccatcatggagaagctggtggcctacagcagcgaccaggcccacagcagcgtggagagagccggcctgatcggcggcgtgaagctgaaggccatccccagcgacggcaacttcgccatgagagccagcgccctgcaggaggccctggagagagacaaggccgccggcctgatccccttcttcatggtggccaccctgggcaccaccacctgctgcagcttcgacaacctgctggaggtgggccccatctgcaacaaggaggacatctggctgcacgtggacgccgcctacgccggcagcgccttcatctgccccgagttcagacacctgctgaacggcgtggagttcgccgacagcttcaacttcaacccccacaagtggctgctggtgaacttcgactgcagcgccatgtgggtgaagaagagaaccgacctgaccggcgccttcagactggaccccacctacctgaagcacagccaccaggacagcggcctgatcaccgactacagacactggcagatccccctgggcagaagattcagaagcctgaagatgtggttcgtgttcagaatgtacggcgtgaagggcctgcaggcctacatcagaaagcacgtgcagctgagccacgagttcgagagcctggtgagacaggaccccagattcgagatctgcgtggaggtgatcctgggcctggtgtgcttcagactgaagggcagcaacaaggtgaacgaggccctgctgcagagaatcaacagcgccaagaagatccacctggtgccctgccacctgagagacaagttcgtgctgagattcgccatctgcagcagaaccgtggagagcgcccacgtgcagagagcctgggagcacatcaaggagctggccgccgacgtgctgagagccgagagagagtag

SEQ ID NO: 79586 - DNA, 1164 bp, Artificial Sequence
  Description of Artificial Sequence: Synthetic coding sequence
atgaacgccagcgagttcagaagaagaggcaaggagatggtggactacatggccaactacatggagggcatcgagggcagacaggtgtaccccgacgtggagcccggctacctgagacccctgatccccgccgccgccccccaggagcccgacaccttcgaggacatcatcaacgacgtggagaagatcatcatgcccggcgtgacccactggcacagcccctacttcttcgcctacttccccaccgccagcagctaccccgccatgctggccgacatgctgtgcggcgccatcggctgcatcggcttcagctgggccgccagccccgcctgcaccgagctggagaccgtgatgatggactggctgggcaagatgctggagctgcccaaggccttcctgaacgagaaggccggcgagggcggcggcgtgatccagatggtggccaccctgggcaccaccacctgctgcagcttcgacaacctgctggaggtgggccccatctgcaacaaggaggacatctggctgcacgtggacgccgcctacgccggcagcgccttcatctgccccgagttcagacacctgctgaacggcgtggagttcgccgacagcttcaacttcaacccccacaagtggctgctggtgaacttcgactgcagcgccatgtgggtgaagaagagaaccgacctgaccggcgccttcagactggaccccacctacctgaagcacagccaccaggacagcggcctgatcaccgactacagacactggcagatccccctgggcagaagattcagaagcctgaagatgtggttcgtgttcagaatgtacggcgtgaagggcctgcaggcctacatcagaaagcacgtgcagctgagccacgagttcgagagcctggtgagacaggaccccagattcgagatctgcgtggaggtgatcctgggcctggtgtgcttcagactgaagggcagcaacaaggtgaacgaggccctgctgcagagaatcaacagcgccaagaagatccacctggtgccctgccacctgagagacaagttcgtgctgagattcgccatctgcagcagaaccgtggagagcgcccacgtgcagagagcctgggagcacatcaaggagctggccgccgacgtgctgagagccgagagagagtag

SEQ ID NO: 79587 - DNA, 735 bp, Artificial Sequence
  Description of Artificial Sequence: Synthetic coding sequence
atgagagaggccgccttcatgtacagcaccgccgtggccatcttcctggtgatcctggtggccgccctgcagggcagcgcccccagagagagccccctgccctaccacatccccctggaccccgagggcagcctggagctgagctggaacgtgagctacacccaggaggccatccacttccagctgctggtgagaagactgaaggccggcgtgctgttcggcatgagcgacagaggcgagctggagaacgccgacctggtggtgctgtggaccgacggcgacaccgcctacttcgccgacggcaccgtgcacctggtgtacggcatcctggaggagcccttcagaagcctggaggccatcaacggcagcggcctgcagatgggcctgcagagagtgcagctgctgaagcccaacatccccgagcccgagctgcccagcgacgcctgcaccatggaggtgcaggcccccaacatccagatccccagccaggagaccacctactggtgctacatcaaggagctgcccaagggcttcagcagacaccacatcatcaagtacgagcccatcgtgaccaagggcaacgaggccctggtgcaccacatggaggtgttccagtgcgcccccgagatggacagcgtgccccacttcagcggcccctgcgacagcaagatgaagcccgacagactgaactactgcagacacgtgctggccgcctgggccctgggcgccaagtag

SEQ ID NO: 79588 - DNA, 1854 bp, Artificial Sequence
  Description of Artificial Sequence: Synthetic coding sequence
atgcccgccctgagcagatgggccagcctgcccggccccagcatgagagaggccgccttcatgtacagcaccgccgtggccatcttcctggtgatcctggtggccgccctgcagggcagcgcccccagagagagccccctgccctaccacatccccctggaccccgagggcagcctggagctgagctggaacgtgagctacacccaggaggccatccacttccagctgctggtgagaagactgaaggccggcgtgctgttcggcatgagcgacagaggcgagctggagaacgccgacctggtggtgctgtggaccgacggcgacaccgcctacttcgccgacgcctggagcgaccagaagggccagatccacctggacccccagcaggactaccagctgctgcaggtgcagagaacccccgagggcctgaccctgctgttcaagagacccttcggcacctgcgaccccaaggactacctgatcgaggacggcaccgtgcacctggtgtacggcatcctggaggagcccttcagaagcctggaggccatcaacggcagcggcctgcagatgggcctgcagagagtgcagctgctgaagcccaacatccccgagcccgagctgcccagcgacgcctgcaccatggaggtgcaggcccccaacatccagatccccagccaggagaccacctactggtgctacatcaaggagctgcccaagggcttcagcagacaccacatcatcaagtacgagcccatcgtgaccaagggcaacgaggccctggtgcaccacatggaggtgttccagtgcgcccccgagatggacagcgtgccccacttcagcggcccctgcgacagcaagatgaagcccgacagactgaactactgcagacacgtgctggccgcctgggccctgggcgccaaggccttctactaccccgaggaggccggcctggccttcggcggccccggcagcagcagatacctgagactggaggtgcactaccacaaccccctggtgatcgagggcagaaacgacagcagcggcatcagactgtactacaccgccaagctgagaagattcaacgccggcatcatggagctgggcctggtgtacacccccgtgatggccatcccccccagagagaccgccttcatcctgaccggctactgcaccgacaagtgcacccagctggccctgccccccagcggcatccacatcttcgccagccagctgcacacccacctgaccggcagaaaggtggtgaccgtgctggtgagagacggcagagagtgggagatcgtgaaccaggacaaccactacagcccccacttccaggagatcagaatgctgaagaaggtggtgagcgtgcaccccggcgacgtgctgatcaccagctgcacctacaacaccgaggacagagagctggccaccgtgggcggcttcggcatcctggaggagatgtgcgtgaactacgtgcactactacccccagacccagctggagctgtgcaagagcgccgtggacgccggcttcctgcagaagtacttccacctgatcaacagattcaacaacgaggacgtgtgcacctgcccccaggccagcgtgagccagcagttcaccagcgtgccctggaacagcttcaacagagacgtgctgaaggccctgtacagcttcgcccccatcagcatgcactgcaacaagagcagcgccgtgagattccagggcgagtggaacctgcagcccctgcccaaggtgatcagcaccctggaggagcccaccccccagtgccccaccagccagggcagaagccccgccggccccaccgtggtgagcatcggcggcggcaagggctag

SEQ ID NO: 79589 - DNA, 1341 bp, Artificial Sequence
  Description of Artificial Sequence: Synthetic coding sequence
atgagaaccctgaacaccagcgccatggacggcaccggcctggtggtggagagagacttcagcgtgagaatcctgaccgcctgcttcctgagcctgctgatcctgagcaccctgctgggcaacaccctggtgtgcgccgccgtgatcagattcagacacctgagaagcaaggtgaccaacttcttcgtgatcagcctggccgtgagcgacctgctggtggccgtgctggtgatgccctggaaggccgtggccgagatcgccggcttctggcccttcggcagcttctgcaacatctgggtggccttcgacatcatgtgcagcaccgccagcatcctgaacctgtgcgtgatcagcgtggacagatactgggccatcagcagccccttcagatacgagagaaagatgacccccaaggccgccttcatcctgatcagcgtggcctggaccctgagcgtgctgatcagcttcatccccgtgcagctgagctggcacaaggccaagcccaccagccccagcgacggcaacgccaccagcctggccgagaccatcgacaactgcgacagcagcctgagcagaacctacgccatcagcagcagcgtgatcagcttctacatccccgtggccatcatgatcgtgacctacaccagaatctacagaatcgcccagaagcagatcagaagaatcgccgccctggagagagccgccgtgcacgccaagaactgccagaccaccaccggcaacggcaagcccgtggagtgcagccagcccgagagcagcttcaagatgagcttcaagagagagaccaaggtgctgaagaccctgagcgtgatcatgggcgtgttcgtgtgctgctggctgcccttcttcatcctgaactgcatcctgcccttctgcggcagcggcgagacccagcccttctgcatcgacagcaacaccttcgacgtgttcgtgtggttcggctgggccaacagcagcctgaaccccatcatctacgccttcaacgccgacttcagaaaggccttcagcaccctgctgggctgctacagactgtgccccgccaccaacaacgccatcgagaccgtgagcatcaacaacaacggcgccgccatgttcagcagccaccacgagcccagaggcagcatcagcaaggagtgcaacctggtgtacctgatcccccacgccgtgggcagcagcgaggacctgaagaaggaggaggccgccggcatcgccagacccctggagaagctgagccccgccctgagcgtgatcctggactacgacaccgacgtgagcctggagaagatccagcccatcacccagaacggccagcaccccacctag

SEQ ID NO: 79590 - DNA, 1341 bp, Artificial Sequence; identical to SEQ ID NO: 79589
  Description of Artificial Sequence: Synthetic coding sequence

SEQ ID NO: 79591 - DNA, 1245 bp, Artificial Sequence
  Description of Artificial Sequence: Synthetic coding sequence
atggaccccctgaacctgagctggtacgacgacgacctggagagacagaactggagcagacccttcaacggcagcgacggcaaggccgacagaccccactacaactactacgccaccctgctgaccctgctgatcgccgtgatcgtgttcggcaacgtgctggtgtgcatggccgtgagcagagagaaggccctgcagaccaccaccaactacctgatcgtgagcctggccgtggccgacctgctggtggccaccctggtgatgccctgggtggtgtacctggaggtggtgggcgagtggaagttcagcagaatccactgcgacatcttcgtgaccctggacgtgatgatgtgcaccgccagcatcctgaacctgtgcgccatcagcatcgacagatacaccgccgtggccatgcccatgctgtacaacaccagatacagcagcaagagaagagtgaccgtgatgatcagcatcgtgtgggtgctgagcttcaccatcagctgccccctgctgttcggcctgaacaacgccgaccagaacgagtgcatcatcgccaaccccgccttcgtggtgtacagcagcatcgtgagcttctacgtgcccttcatcgtgaccctgctggtgtacatcaagatctacatcgtgctgagaagaagaagaaagagagtgaacaccaagagaagcagcagagccttcagagcccacctgagagcccccctgaaggaggccgccagaagagcccaggagctggagatggagatgctgagcagcaccagcccccccgagagaaccagatacagccccatcccccccagccaccaccagctgaccctgcccgaccccagccaccacggcctgcacagcacccccgacagccccgccaagcccgagaagaacggccacgccaaggaccaccccaagatcgccaagatcttcgagatccagaccatgcccaacggcaagaccagaaccagcctgaagaccatgagcagaagaaagctgagccagcagaaggagaagaaggccacccagatgctggccatcgtgctgggcgtgttcatcatctgctggctgcccttcttcatcacccacatcctgaacatccactgcgactgcaacatcccccccgtgctgtacagcgccttcacctggctgggctacgtgaacagcgccgtgaaccccatcatctacaccaccttcaacatcgagttcagaaaggccttcctgaagatcctgcactgctag

SEQ ID NO: 79592 - DNA, 1338 bp, Artificial Sequence
  Description of Artificial Sequence: Synthetic coding sequence
atggaccccctgaacctgagctggtacgacgacgacctggagagacagaactggagcagacccttcaacggcagcgacggcaaggccgacagaccccactacaactactacgccaccctgctgaccctgctgatcgccgtgatcgtgttcggcaacgtgctggtgtgcatggccgtgagcagagagaaggccctgcagaccaccaccaactacctgatcgtgagcctggccgtggccgacctgctggtggccaccctggtgatgccctgggtggtgtacctggaggtggtgggcgagtggaagttcagcagaatccactgcgacatcttcgtgaccctggacgtgatgatgtgcaccgccagcatcctgaacctgtgcgccatcagcatcgacagatacaccgccgtggccatgcccatgctgtacaacaccagatacagcagcaagagaagagtgaccgtgatgatcagcatcgtgtgggtgctgagcttcaccatcagctgccccctgctgttcggcctgaacaacgccgaccagaacgagtgcatcatcgccaaccccgccttcgtggtgtacagcagcatcgtgagcttctacgtgcccttcatcgtgaccctgctggtgtacatcaagatctacatcgtgctgagaagaagaagaaagagagtgaacaccaagagaagcagcagagccttcagagcccacctgagagcccccctgaagggcaactgcacccaccccgaggacatgaagctgtgcaccgtgatcatgaagagcaacggcagcttccccgtgaacagaagaagagtggtgcaggaggccgccagaagagcccaggagctggagatggagatgctgagcagcaccagcccccccgagagaaccagatacagccccatcccccccagccaccaccagctgaccctgcccgaccccagccaccacggcctgcacagcacccccgacagccccgccaagcccgagaagaacggccacgccaaggaccaccccaagatcgccaagatcttcgagatccagaccatgcccaacggcaagaccagaaccagcctgaagaccatgagcagaagaaagctgagccagcagaaggagaagaaggccacccagatgctggccatcgtgctgggcgtgttcatcatctgctggctgcccttcttcatcacccacatcctgaacatccactgcgactgcaacatcccccccgtgctgtacagcgccttcacctggctgggctacgtgaacagcgccgtgaaccccatcatctacaccaccttcaacatcgagttcagaaaggccttcctgaagatcctgcactgctag

SEQ ID NO: 79593 - DNA, 1332 bp, Artificial Sequence
  Description of Artificial Sequence: Synthetic coding sequence
atggaccccctgaacctgagctggtacgacgacgacctggagagacagaactggagcagacccttcaacggcagcgacggcaaggccgacagaccccactacaactactacgccaccctgctgaccctgctgatcgccgtgatcgtgttcggcaacgtgctggtgtgcatggccgtgagcagagagaaggccctgcagaccaccaccaactacctgatcgtgagcctggccgtggccgacctgctggtggccaccctggtgatgccctgggtggtgtacctggaggtggtgggcgagtggaagttcagcagaatccactgcgacatcttcgtgaccctggacgtgatgatgtgcaccgccagcatcctgaacctgtgcgccatcagcatcgacagatacaccgccgtggccatgcccatgctgtacaacaccagatacagcagcaagagaagagtgaccgtgatgatcagcatcgtgtgggtgctgagcttcaccatcagctgccccctgctgttcggcctgaacaacgccgaccagaacgagtgcatcatcgccaaccccgccttcgtggtgtacagcagcatcgtgagcttctacgtgcccttcatcgtgaccctgctggtgtacatcaagatctacatcgtgctgagaagaagaagaaagagagtgaacaccaagagaagcagcagagccttcagagcccacctgagagcccccctgaagggcaactgcacccaccccgaggacatgaagctgtgcaccgtgatcatgaagagcaacggcagcttccccgtgaacagaagaagagtggaggccgccagaagagcccaggagctggagatggagatgctgagcagcaccagcccccccgagagaaccagatacagccccatcccccccagccaccaccagctgaccctgcccgaccccagccaccacggcctgcacagcacccccgacagccccgccaagcccgagaagaacggccacgccaaggaccaccccaagatcgccaagatcttcgagatccagaccatgcccaacggcaagaccagaaccagcctgaagaccatgagcagaagaaagctgagccagcagaaggagaagaaggccacccagatgctggccatcgtgctgggcgtgttcatcatctgctggctgcccttcttcatcacccacatcctgaacatccactgcgactgcaacatcccccccgtgctgtacagcgccttcacctggctgggctacgtgaacagcgccgtgaaccccatcatctacaccaccttcaacatcgagttcagaaaggccttcctgaagatcctgcactgctag

SEQ ID NO: 79594 - DNA, 1338 bp, Artificial Sequence; identical to SEQ ID NO: 79592
  Description of Artificial Sequence: Synthetic coding sequence

SEQ ID NO: 79595 - DNA, 24 bp, Artificial Sequence
  Description of Artificial Sequence: Synthetic coding sequence
atggaccccctgaacctgagctag

SEQ ID NO: 79596 - DNA, 1332 bp, Artificial Sequence; identical to SEQ ID NO: 79593
  Description of Artificial Sequence: Synthetic coding sequence

SEQ ID NO: 79597 - DNA, 534 bp, Artificial Sequence
  Description of Artificial Sequence: Synthetic coding sequence
atggaccccctgaacctgagctggtacgacgacgacctggagagacagaactggagcagacccttcaacggcagcgacggcaaggccgacagaccccactacaactactacgccaccctgctgaccctgctgatcgccgtgatcgtgttcggcaacgtgctggtgtgcatggccgtgagcagagagaaggccctgcagaccaccaccaactacctgatcgtgagcctggccgtggccgacctgctggtggccaccctggtgatgccctgggtggtgtacctggaggtggtgggcgagtggaagttcagcagaatccactgcgacatcttcgtgaccctggacgtgatgatgtgcaccgccagcatcctgaacctgtgcgccatcagcatcgacagatacaccgccgtggccatgcccatgctgtacaacaccagatacagcagcaagagaagagtgaccgtgatgatcagcatcgtgtgggtgctgagcttcaccatcagctgccccctgctgttcggcctgaacaacgcctag

SEQ ID NO: 79598 - DNA, 1329 bp, Artificial Sequence
  Description of Artificial Sequence: Synthetic coding sequence
atggaccccctgaacctgagctggtacgacgacgacctggagagacagaactggagcagacccttcaacggcagcgacggcaaggccgacagaccccactacaactactacgccaccctgctgaccctgctgatcgccgtgatcgtgttcggcaacgtgctggtgtgcatggccgtgagcagagagaaggccctgcagaccaccaccaactacctgatcgtgagcctggccgtggccgacctgctggtggccaccctggtgatgccctgggtggtgtacctggaggtgggcgagtggaagttcagcagaatccactgcgacatcttcgtgaccctggacgtgatgatgtgcaccgccagcatcctgaacctgtgcgccatcagcatcgacagatacaccgccgtggccatgcccatgctgtacaacaccagatacagcagcaagagaagagtgaccgtgatgatcagcatcgtgtgggtgctgagcttcaccatcagctgccccctgctgttcggcctgaacaacgccgaccagaacgagtgcatcatcgccaaccccgccttcgtggtgtacagcagcatcgtgagcttctacgtgcccttcatcgtgaccctgctggtgtacatcaagatctacatcgtgctgagaagaagaagaaagagagtgaacaccaagagaagcagcagagccttcagagcccacctgagagcccccctgaagggcaactgcacccaccccgaggacatgaagctgtgcaccgtgatcatgaagagcaacggcagcttccccgtgaacagaagaagagtggaggccgccagaagagcccaggagctggagatggagatgctgagcagcaccagcccccccgagagaaccagatacagccccatcccccccagccaccaccagctgaccctgcccgaccccagccaccacggcctgcacagcacccccgacagccccgccaagcccgagaagaacggccacgccaaggaccaccccaagatcgccaagatcttcgagatccagaccatgcccaacggcaagaccagaaccagcctgaagaccatgagcagaagaaagctgagccagcagaaggagaagaaggccacccagatgctggccatcgtgctgggcgtgttcatcatctgctggctgcccttcttcatcacccacatcctgaacatccactgcgactgcaacatcccccccgtgctgtacagcgccttcacctggctgggctacgtgaacagcgccgtgaaccccatcatctacaccaccttcaacatcgagttcagaaaggccttcctgaagatcctgcactgctag

SEQ ID NO: 79599 - DNA, 1029 bp, Artificial Sequence
  Description of Artificial Sequence: Synthetic coding sequence
atggccagcctgagccagctgagcggccacctgaactacacctgcggcgccgagaacagcaccggcgccagccaggccagaccccacgcctactacgccctgagctactgcgccctgatcctggccatcgtgttcggcaacggcctggtgtgcatggccgtgctgaaggagagagccctgcagaccaccaccaactacctggtggtgagcctggccgtggccgacctgctggtggccaccctggtgatgccctgggtggtgtacctggaggtgaccggcggcgtgtggaacttcagcagaatctgctgcgacgtgttcgtgaccctggacgtgatgatgtgcaccgccagcatcctgaacctgtgcgccatcagcatcgacagatacaccgccgtggtgatgcccgtgcactaccagcacggcaccggccagagcagctgcagaagagtggccctgatgatcaccgccgtgtgggtgctggccttcgccgtgagctgccccctgctgttcggcttcaacaccaccggcgaccccaccgtgtgcagcatcagcaaccccgacttcgtgatctacagcagcgtggtgagcttctacctgcccttcggcgtgaccgtgctggtgtacgccagaatctacgtggtgctgaagcagagaagaagaaagagaatcctgaccagacagaacagccagtgcaacagcgtgagacccggcttcccccagcagaccctgagccccgaccccgcccacctggagctgaagagatactacagcatctgccaggacaccgccctgggcggccccggcttccaggagagaggcggcgagctgaagagagaggagaagaccagaaacagcctgagcgccaccagcggcgaggagggcaaccccaacggcggccactgcgcctggggcctgcactgcctgctggccgccctgctgctggacccctgcagccagtaccccctgcccgacatgcccagagtgcccagagccctgcagtgccacgacatggccggcctgagagagtag

SEQ ID NO: 79600 - DNA, 1104 bp, Artificial Sequence
  Description of Artificial Sequence: Synthetic coding sequence
atggccagcctgagccagctgagcggccacctgaactacacctgcggcgccgagaacagcaccggcgccagccaggccagaccccacgcctactacgccctgagctactgcgccctgatcctggccatcgtgttcggcaacggcctggtgtgcatggccgtgctgaaggagagagccctgcagaccaccaccaactacctggtggtgagcctggccgtggccgacctgctggtggccaccctggtgatgccctgggtggtgtacctggaggtgaccggcggcgtgtggaacttcagcagaatctgctgcgacgtgttcgtgaccctggacgtgatgatgtgcaccgccagcatcctgaacctgtgcgccatcagcatcgacagatacaccgccgtggtgatgcccgtgcactaccagcacggcaccggccagagcagctgcagaagagtggccctgatgatcaccgccgtgtgggtgctggccttcgccgtgagctgccccctgctgttcggcttcaacaccaccggcgaccccaccgtgtgcagcatcagcaaccccgacttcgtgatctacagcagcgtggtgagcttctacctgcccttcggcgtgaccgtgctggtgtacgccagaatctacgtggtgctgaagcagagaagaagaaagagaatcctgaccagacagaacagccagtgcaacagcgtgagacccggcttcccccagcagaccctgagccccgaccccgcccacctggagctgaagagatactacagcatctgccaggacaccgccctgggcggccccggcttccaggagagaggcggcgagctgaagagagaggagaagaccagaaacagcctgatgcccctgagagagaagaaggccacccagatggtggccatcgtgctgggcgccttcatcgtgtgctggctgcccttcttcctgacccacgtgctgaacacccactgccagacctgccacgtgagccccgagctgtacagcgccaccacctggctgggctacgtgaacagcgccctgaaccccgtgatctacaccaccttcaacatcgagttcagaaaggccttcctgaagatcctgagctgctag

SEQ ID NO: 79601 - DNA, 1203 bp, Artificial Sequence
  Description of Artificial Sequence: Synthetic coding sequence
atggccagcctgagccagctgagcggccacctgaactacacctgcggcgccgagaacagcaccggcgccagccaggccagaccccacgcctactacgccctgagctactgcgccctgatcctggccatcgtgttcggcaacggcctggtgtgcatggccgtgctgaaggagagagccctgcagaccaccaccaactacctggtggtgagcctggccgtggccgacctgctggtggccaccctggtgatgccctgggtggtgtacctggaggtgaccggcggcgtgtggaacttcagcagaatctgctgcgacgtgttcgtgaccctggacgtgatgatgtgcaccgccagcatcctgaacctgtgcgccatcagcatcgacagatacaccgccgtggtgatgcccgtgcactaccagcacggcaccggccagagcagctgcagaagagtggccctgatgatcaccgccgtgtgggtgctggccttcgccgtgagctgccccctgctgttcggcttcaacaccaccggcgaccccaccgtgtgcagcatcagcaaccccgacttcgtgatctacagcagcgtggtgagcttctacctgcccttcggcgtgaccgtgctggtgtacgccagaatctacgtggtgctgaagcagagaagaagaaagagaatcctgaccagacagaacagccagtgcaacagcgtgagacccggcttcccccagcagaccctgagccccgaccccgcccacctggagctgaagagatactacagcatctgccaggacaccgccctgggcggccccggcttccaggagagaggcggcgagctgaagagagaggagaagaccagaaacagcctgagccccaccatcgcccccaagctgagcctggaggtgagaaagctgagcaacggcagactgagcaccagcctgaagctgggccccctgcagcccagaggcgtgcccctgagagagaagaaggccacccagatggtggccatcgtgctgggcgccttcatcgtgtgctggctgcccttcttcctgacccacgtgctgaacacccactgccagacctgccacgtgagccccgagctgtacagcgccaccacctggctgggctacgtgaacagcgccctgaaccccgtgatctacaccaccttcaacatcgagttcagaaaggccttcctgaagatcctgagctgctag

SEQ ID NO: 79602 - DNA, 1203 bp, Artificial Sequence; identical to SEQ ID NO: 79601
  Description of Artificial Sequence: Synthetic coding sequence

SEQ ID NO: 79603 - DNA, 1203 bp, Artificial Sequence; identical to SEQ ID NO: 79601
  Description of Artificial Sequence: Synthetic coding sequence

SEQ ID NO: 79604 - DNA, 1260 bp, Artificial Sequence
  Description of Artificial Sequence: Synthetic coding sequence
atgggcaacagaagcaccgccgacgccgacggcctgctggccggcagaggccccgccgccggcgccagcgccggcgccagcgccggcctggccggccagggcgccgccgccctggtgggcggcgtgctgctgatcggcgccgtgctggccggcaacagcctggtgtgcgtgagcgtggccaccgagagagccctgcagacccccaccaacagcttcatcgtgagcctggccgccgccgacctgctgctggccctgctggtgctgcccctgttcgtgtacagcgaggtgcagggcggcgcctggctgctgagccccagactgtgcgacgccctgatggccatggacgtgatgctgtgcaccgccagcatcttcaacctgtgcgccatcagcgtggacagattcgtggccgtggccgtgcccctgagatacaacagacagggcggcagcagaagacagctgctgctgatcggcgccacctggctgctgagcgccgccgtggccgcccccgtgctgtgcggcctgaacgacgtgagaggcagagaccccgccgtgtgcagactggaggacagagactacgtggtgtacagcagcgtgtgcagcttcttcctgccctgccccctgatgctgctgctgtactgggccaccttcagaggcctgcagagatgggaggtggccagaagagccaagctgcacggcagagcccccagaagacccagcggccccggcccccccagccccaccccccccgcccccagactgccccaggacccctgcggccccgactgcgccccccccgcccccggcctgcccagaggcccctgcggccccgactgcgcccccgccgcccccagcctgccccaggacccctgcggccccgactgcgccccccccgcccccggcctgccccccgacccctgcggcagcaactgcgccccccccgacgccgtgagagccgccgccctgcccccccagacccccccccagaccagaagaagaagaagagccaagatcaccggcagagagagaaaggccatgagagtgctgcccgtggtggtgggcgccttcctgctgtgctggacccccttcttcgtggtgcacatcacccaggccctgtgccccgcctgcagcgtgccccccagactggtgagcgccgtgacctggctgggctacgtgaacagcgccctgaaccccgtgatctacaccgtgttcaacgccgagttcagaaacgtgttcagaaaggccctgagagcctgctgctag

SEQ ID NO: 79605 - DNA, 1434 bp, Artificial Sequence
  Description of Artificial Sequence: Synthetic coding sequence
atgctgccccccggcagcaacggcaccgcctaccccggccagttcgccctgtaccagcagctggcccagggcaacgccgtgggcggcagcgccggcgccccccccctgggccccagccaggtggtgaccgcctgcctgctgaccctgctgatcatctggaccctgctgggcaacgtgctggtgtgcgccgccatcgtgagaagcagacacctgagagccaacatgaccaacgtgttcatcgtgagcctggccgtgagcgacctgttcgtggccctgctggtgatgccctggaaggccgtggccgaggtggccggctactggcccttcggcgccttctgcgacgtgtgggtggccttcgacatcatgtgcagcaccgccagcatcctgaacctgtgcgtgatcagcgtggacagatactgggccatcagcagacccttcagatacaagagaaagatgacccagagaatggccctggtgatggtgggcctggcctggaccctgagcatcctgatcagcttcatccccgtgcagctgaactggcacagagaccaggccgccagctggggcggcctggacctgcccaacaacctggccaactggaccccctgggaggaggacttctgggagcccgacgtgaacgccgagaactgcgacagcagcctgaacagaacctacgccatcagcagcagcctgatcagcttctacatccccgtggccatcatgatcgtgacctacaccagaatctacagaatcgcccaggtgcagatcagaagaatcagcagcctggagagagccgccgagcacgcccagagctgcagaagcagcgccgcctgcgcccccgacaccagcctgagagccagcatcaagaaggagaccaaggtgctgaagaccctgagcgtgatcatgggcgtgttcgtgtgctgctggctgcccttcttcatcctgaactgcatggtgcccttctgcagcggccaccccgagggcccccccgccggcttcccctgcgtgagcgagaccaccttcgacgtgttcgtgtggttcggctgggccaacagcagcctgaaccccgtgatctacgccttcaacgccgacttccagaaggtgttcgcccagctgctgggctgcagccacttctgcagcagaacccccgtggagaccgtgaacatcagcaacgagctgatcagctacaaccaggacatcgtgttccacaaggagatcgccgccgcctacatccacatgatgcccaacgccgtgacccccggcaacagagaggtggacaacgacgaggaggagggccccttcgacagaatgttccagatctaccagaccagccccgacggcgaccccgtggccgagagcgtgtgggagctggactgcgagggcgagatcagcctggacaagatcacccccttcacccccaacggcttccactag

SEQ ID NO: 79606 - DNA, 438 bp, Artificial Sequence
  Description of Artificial Sequence: Synthetic coding sequence
atggaccccgaggagcaggagctgctgaacgactacagatacagaagctacagcagcgtgatcgagaaggccctgagaaacttcgagagcagcagcgagtgggccgacctgatcagcagcctgggcaagctgaacaaggccctgcagagcaacctgagatacagcctgctgcccagaagactgctgatcagcaagagactggcccagtgcctgcaccccgccctgcccagcggcgtgcacctgaaggccctggagacctacgagatcatcttcaagatcgtgggcaccaagtggctggccaaggacctgttcctgtacagctgcggcctgttccccctgctggcccacgccgccgtgagcgtgagacccgtgctgctgaccctgtacgagaagtacttcctgcccctgcagaagctgctgctgcccagcctgcagtag

SEQ ID NO: 79607 - DNA, 6897 bp, Artificial Sequence
  Description of Artificial Sequence: Synthetic coding sequence
atggaccccgaggagcaggagctgctgaacgactacagatacagaagctacagcagcgtgatcgagaaggccctgagaaacttcgagagcagcagcgagtgggccgacctgatcagcagcctgggcaagctgaacaaggccctgcagagcaacctgagatacagcctgctgcccagaagactgctgatcagcaagagactggcccagtgcctgcaccccgccctgcccagcggcgtgcacctgaaggccctggagacctacgagatcatcttcaagatcgtgggcaccaagtggctggccaaggacctgttcctgtacagctgcggcctgttccccctgctggcccacgccgccgtgagcgtgagacccgtgctgctgaccctgtacgagaagtacttcctgcccctgcagaagctgctgctgcccagcctgcaggccttcatcgtgggcctgctgcccggcctggaggagggcagcgagatcagcgacagaaccgacgccctgctgctgagactgagcctggtggtgggcaaggaggtgttctacaccgccctgtggggcagcgtgctggccagccccagcatcagactgcccgccagcgtgttcgtggtgggccacatcaacagagacgcccccggcagagagcagaagtacatgctgggcaccaaccaccagctgaccgtgaagagcctgagagccagcctgctggacagcaacgtgctggtgcagagaaacaacctggagatcgtgctgttcttcttccccttctacacctgcctggacagcaacgagagagccatccccctgctgagaagcgacatcgtgagaatcctgagcgccgccacccagaccctgctgagaagagacatgagcctgaacagaagactgtacgcctggctgctgggcagcgacatcaagggcaacaccgtggtgcccgagagcgagatcagcaacagctacgaggaccagagcagctacttcttcgagaagtacagcaaggacctgctggtggagggcctggccgagatcctgcaccagaagttcatcgacgccgacgtggaggagagacaccacgcctacctgaagcccttcagagtgctgatcagcctgctggacaagcccgagatcggcccccaggtggtgggcaacctgttcctggaggtgatcagagccttctacagctactgcagagacgccctgggcagcgacctgaagctgagctacacccagagcggcaacagcctgatcagcgccatcaaggagaacagaaacgccagcgagatcgtgaagaccgtgaacctgctgatcaccagcctgagcaccgacttcctgtgggactacatgaccagatgcttcgaggagtgcttcagacccgtgaagcagagatacagcgtgagaaacagcgtgagccccccccccaccgtgagcgagctgtgcgccctgctggtgttcctgctggacgtgatccccctggagctgtacagcgaggtgcagacccagtacctgccccaggtgctgggctgcctggtgcagcccctggccgaggacatggaggccctgagcctgcccgagctgacccacgccctgaagacctgcttcaaggtgctgagcaaggtgcagatgccccccagctacctggacaccgagagcaccagcggcaccagcagccccgtgaagggcgagaacggcaagatcatcctggagaccaaggccgtgatccccggcgacgaggacgccagcttcccccccctgaagagcgaggacagcggcatcggcctgagcgccagcagccccgagctgagcgagcacctgagagtgcccagagtgagcctggagagagacgacgtgtggaagaagggcggcagcatgcagagaaccttcctgtgcatccaggagctgatcgccaacttcgccagcaagaacatcttcggcgtgcagctgaccgccagcggcgaggagagcaagagcgaggagcccgccggcaagagagacagagacggcacccagagcctggccgccaacgacagcagcagaaagaacagctgggagcccaagcccatcaccgtgccccagttcaagcagatgctgagcgacctgttcaccgccagaggcagccccttcaagaccaagagcagcgagagccccagcagcagccccagcagccccgccagaaagaacggcggcgagtgggacgtggagaaggtggtgatcgacctgggcggcagcagagaggagagaagagaggccttcgccgccgcctgccacctgctgctggactgcgccaccttccccgtgtacctgagcgaggaggagaccgagcagctgtgcgccaccctgttccagctgcccggcgccggcgacagcagcttccccagctggctgaagagcctgatgaccatctgctgctgcgtgaccgactgctacctgcagaacgtggccatcagcaccctgctggaggtgatcaaccacagccagagcctggccctggtgatcgaggacaagatgaagagatacaagagcagcggccacaaccccttcttcggcaagctgcagatggtgaccgtgccccccatcgcccccggcatcctgaaggtgatcgccgagaagaccgacttctaccagagagtggccagagtgctgtggaaccagctgaacaaggagaccagagagcaccacgtgacctgcgtggagctgttctacagactgcactgcctggcccccaccgccaacatctgcgaggacatcatctgccacgccctgctggaccccgacaagggcaccagactggaggccctgttcagattcagcgtgatctggcacctgaccagagagatccagggcagcagagtgaccagccacaacagaagcttcgacagaagcctgttcgtggtgctggacagcctggcctgcaccgacggcgccatcggcgccgccgcccagggctggctggtgagagccctgagcctgggcgacgtggccagaatcctggagcccgtgctgctgctgctgctgcagcccaagacccagagaaccagcatccactgcctgaagcaggagaacagcgccgacgacctgcacagatggttcaacagaaagaagaccagcttcagagaggcctgcgccgtgcccgagccccaggagagcggcagcgaggagcacctgcccctgagccagttcaccaccgtggacagagaggccatctgggccgaggtggagaaggagcccgagaagtaccccctgagaggcgagctgagcgaggaggagctgccctactacgtggagctgcccgacagaaccgcccacggcgcccccgacagcagcgagcacaccgagagcgccgacaccagcagctgccacaccgacagcgagaacaccagcagcttcagcagccccagccacgacctgcaggagctgagcaacgaggagaactgctgcgcccccatccccatgggcggcagagcctaccccaagagaagcgccctgctggccgccttccagagcgagagcttcaaggccggcgccaagctgagcctggtgagagtggacagcgacaagacccaggccagcgagagcttcagcagcgacgaggaggccgacctggagctgcaggccctgaccaccagcagactgctgaagcagcagagagagagacaggaggccgtggaggccctgttcaagcacatcctgctgtacctgcagccctacgacagcagaagagtgctgtacgccttcagcgtgctggaggccgtgctgaagaccaaccccaaggagttcatcgaggccgtgagcagaaccagcatggacaccagcagcaccgcccacctgaacctgatcagcaacctgctggccagacaccaggaggccctgatcggccagagcttctacggcaagctgcagacccaggtgcccaacgtgtgcccccacagcctgctgctggagctgctgacctacctgtgcctgagcttcctgagaagctactacccctgctacctgaaggtgagccacagagacatcctgggcaacagagacgtgcaggtgaagagcgtggaggtgctgatcagaatcatgatgcagctggtgagcgtggccaagagcagcgagggcaagaacgtggagttcatccacagcctgctgcagagatgcaaggtgcaggagttcgtgctgctgagcctgagcgccagcatgtacaccagccagaagagatacggcctggccaccgcccaccacggcagagccctgcccgaggacagcctgttcgaggagagcctgatcaacctgggccaggaccagatctggagcgagcaccccctgcagatcgagctgctgaagctgctgcaggtgctgatcgtgctggagcaccacctgggcagagcccacgaggaggccgagaaccagcccgacctgagcagagagtggcagagagccctgaacttccagcaggccatcagcgccctgcagtacgtgcagccccaccccctgaccagccagggcctgctggtgagcgccgtggtgagaggcctgcagcccgcctacggctacggcatgcaccccgcctgggtgagcctggtgacccacagcctgccctacttcggcaagagcctgggctggaccgtgacccccttcgtggtgcagatctgcaagaacctggacgacctggtgaagcagtacgagagcgagagcgtgaagctgagcgtgagcaccaccagcaagagagagaacatcagccccgactaccccctgaccctgctggagggcctgaccaccatcagccacttctgcctgctggagcaggccaaccagaacaagaagaccatggccgccggcgaccccgccaacctgagaaacgccagaaacgccatcctggaggagctgcccagaaccgtgaacaccatggccctgctgtggaacgtgctgagaaaggaggagacccagaagagacccgtggacctgctgggcgccaccaagggcagcagcagcgtgtacttcaagaccaccaagaccatcagacagaagatcctggacttcctgaaccccctgaccgcccacctgggcgtgcagctgaccgccgccgtggccgccgtgtggagcagaaagaaggcccagagacacagcaagatgaagatcatccccaccgccagcgccagccagctgaccctggtggacctggtgtgcgccctgagcaccctgcagaccgacaccctgctgcacctggtgaaggaggtggtgaagagacccccccaggtgaagggcggcgacgagaagagccccctggtggacatccccgtgctgcagttctgctacgccttcctgcagagactgcccgtgcccgccctgcaggagaacttcagcagcctgctgggcgtgctgaaggagagcgtgcagctgaacctggccccccccggctacttcctgctgctgagcatgctgaacgacttcgtgaccagaacccccaacctggagaacaagaaggaccagaaggacctgcaggagatcacccagaagatcctggaggccgtgggcaacatcgccggcagcagcctggagcagaccagctggctgagcagaaacctggaggtgaaggcccagccccaggccagcctggaggagagcgacgccgaggaggacctgtacgacgccgccgccgccagcgccatggtgagcagcagcgcccccagcgtgtacagcgtgcaggccctgagcctgctggccgaggtgctggccagcctgctggacatggtgtacagaagcgacgagaaggagaaggccgtgcccctgatcagcagactgctgtactacgtgttcccctacctgagaaaccacagcgcctacaacgcccccagcttcagagccggcgcccagctgctgagcagcctgagcggctacgcctacaccaagagagcctggagaaaggaggtgctggagctgttcctggaccccgccttcttccagatggacaccagctgcgtgcactggaagagcatcatcgaccacctgctgacccacgagaagaccatgttcaaggacctgatgaacatgcagagcagcagcctgaagctgttcagcagcttcgagcagaaggccatgctgctgaagagacaggccttcgccgtgttcagcggcgagctggaccagtaccacctgtacctgcccctgatccaggagagactgaccgacaacctgagagtgggccagaccagcatcgtggccgcccagatgttcctgttcttcagagtgctgctgctgagaatcagcccccagcacctgaccagcctgtggcccatcatggtgagcgagctgatccagaccttcacccagctggaggaggacctgaaggacgaggacgagagcctgagaagcaccaacaaggtgaacagaaccaaggtgagcgtgcccgacgccaacggccccagcgtgggcgagatcccccagagcgagctgatcctgtacctgagcgcctgcaagttcctggacaccgccctgagcttcccccccgacaagatgcccctgttccagatctacagatgggccttcatccccgaggtggacaccgagggccccgccttcctgagcgacgtggaggagaaccaccaggagtgcaagccccacaccgtgagaatcctggagctgctgaagctgaagttcggcgagatcagcagcagcgacgagatcaccatgaagagcgagttccccctgctgagacagcacagcgtgagcagcatcagacagctgatgcccttcttcatgaccctgaacggcgccttcaagacccagagacagctgcccgccgacagccccggcacccccttcctggacttccccgtgaccgacagccccagaatcctgaagcagctggaggagtgcatcgagtacgacttcctggagcaccccgagtgctag

SEQ ID NO: 79608 - DNA, 792 bp, Artificial Sequence
  Description of Artificial Sequence: Synthetic coding sequence
atgttctacttccactgccccccccagctggagggcaccgccaccttcggcaaccacagcagcggcgacttcgacgacggcttcctgagaagaaagcagagaagaaacagaaccaccttcaccctgcagcagctggaggccctggaggccgtgttcgcccagacccactaccccgacgtgttcaccagagaggagctggccatgaagatcaacctgaccgaggccagagtgcaggtgtggttccagaacagaagagccaagtggagaaagaccgagagaggcgccagcgaccaggagcccggcgccaaggagcccatggccgaggtgacccccccccccgtgagaaacatcaacagccccccccccggcgaccaggccagaagcaagaaggaggccctggaggcccagcagagcctgggcagaaccgtgggccccgccggccccttcttccccagctgcctgcccggcaccctgctgaacaccgccacctacgcccaggccctgagccacgtggccagcctgaagggcggccccctgtgcagctgctgcgtgcccgaccccatgggcctgagcttcctgcccacctacggctgccagagcaacagaaccgccagcgtggccaccctgagaatgaaggccagagagcacagcgaggccgtgctgcagagcgccaacctgctgcccagcaccagcagcagccccggccccgtggccaagcccgccccccccgacggcagccaggagaagaccagccccaccaaggagcagagcgaggccgagaagagcgtgtag

SEQ ID NO: 79609 - DNA, 807 bp, Artificial Sequence
  Description of Artificial Sequence: Synthetic coding sequence
atggtgctgatgagctgcgaccagagactgatcagcctgctgctggtgggcaccgccaccttcggcaaccacagcagcggcgacttcgacgacggcttcctgagaagaaagcagagaagaaacagaaccaccttcaccctgcagcagctggaggccctggaggccgtgttcgcccagacccactaccccgacgtgttcaccagagaggagctggccatgaagatcaacctgaccgaggccagagtgcaggtgtggttccagaacagaagagccaagtggagaaagaccgagagaggcgccagcgaccaggagcccggcgccaaggagcccatggccgaggtgacccccccccccgtgagaaacatcaacagccccccccccggcgaccaggccagaagcaagaaggaggccctggaggcccagcagagcctgggcagaaccgtgggccccgccggccccttcttccccagctgcctgcccggcaccctgctgaacaccgccacctacgcccaggccctgagccacgtggccagcctgaagggcggccccctgtgcagctgctgcgtgcccgaccccatgggcctgagcttcctgcccacctacggctgccagagcaacagaaccgccagcgtggccaccctgagaatgaaggccagagagcacagcgaggccgtgctgcagagcgccaacctgctgcccagcaccagcagcagccccggccccgtggccaagcccgccccccccgacggcagccaggagaagaccagccccaccaaggagcagagcgaggccgagaagagcgtgtag

SEQ ID NO: 79610 - DNA, 384 bp, Artificial Sequence
  Description of Artificial Sequence: Synthetic coding sequence
atgaagctgaacgtggacggcctgctggtgtacttcccctacgactacatctaccccgagcagttcagctacatgagagagctgaagagaaccctggacgccaagggccacggcgtgctggagatgcccagcggcaccggcaagaccgtgagcctgctggccctgatcatggcctaccagagagcctaccccctggaggtgaccaagctgatctactgcagcagaaccgtgcccgagatcgagaaggtgatcgaggagctgagaaagctgctgaacttctacgagaagcaggagggcgagaagctgcccttcctgggcctggccctgagcagcagaaagaacctgtgcatccaccccgagaccaccagcgccagcaccccctag

SEQ ID NO: 79611 - DNA, 4614 bp, Artificial Sequence
  Description of Artificial Sequence: Synthetic coding sequence
atgggcgagaagctggagctgagactgaagagccccgtgggcgccgagcccgccgtgtacccctggcccctgcccgtgtacgacaagcaccacgacgccgcccacgagatcatcgagaccatcagatgggtgtgcgaggagatccccgacctgaagctggccatggagaactacgtgctgatcgactacgacaccaagagcttcgagagcatgcagagactgtgcgacaagtacaacagagccatcgacagcatccaccagctgtggaagggcaccacccagcccatgaagctgaacaccagacccagcaccggcctgctgagacacatcctgcagcaggtgtacaaccacagcgtgaccgaccccgagaagctgaacaactacgagcccttcagccccgaggtgtacggcgagaccagcttcgacctggtggcccagatgatcgacgagatcaagatgaccgacgacgacctgttcgtggacctgggcagcggcgtgggccaggtggtgctgcaggtggccgccgccaccaactgcaagcaccactacggcgtggagaaggccgacatccccgccaagtacgccgagaccatggacagagagttcagaaagtggatgaagtggtacggcaagaagcacgccgagtacaccctggagagaggcgacttcctgagcgaggagtggagagagagaatcgccaacaccagcgtgatcttcgtgaacaacttcgccttcggccccgaggtggaccaccagctgaaggagagattcgccaacatgaaggagggcggcagaatcgtgagcagcaagcccttcgcccccctgaacttcagaatcaacagcagaaacctgagcgacatcggcaccatcatgagagtggtggagctgagccccctgaagggcagcgtgagctggaccggcaagcccgtgagctactacctgcacaccatcgacagaaccatcctggagaactacttcagcagcctgaagaaccccaagctgagagaggagcaggaggccgccagaagaagacagcagagagagagcaagagcaacgccgccacccccaccaagggccccgagggcaaggtggccggccccgccgacgcccccatggacagcggcgccgaggaggagaaggccggcgccgccaccgtgaagaagcccagccccagcaaggccagaaagaagaagctgaacaagaagggcagaaagatggccggcagaaagagaggcagacccaagaagatgaacaccgccaaccccgagagaaagcccaagaagaaccagaccgccctggacgccctgcacgcccagaccgtgagccagaccgccgccagcagcccccaggacgcctacagaagcccccacagccccttctaccagctgccccccagcgtgcagagacacagccccaaccccctgctggtggcccccaccccccccgccctgcagaagctgctggagagcttcaagatccagtacctgcagttcctggcctacaccaagaccccccagtacaaggccagcctgcaggagctgctgggccaggagaaggagaagaacgcccagctgctgggcgccgcccagcagctgctgagccactgccaggcccagaaggaggagatcagaagactgttccagcagaagctggacgagctgggcgtgaaggccctgacctacaacgacctgatccaggcccagaaggagatcagcgcccacaaccagcagctgagagagcagagcgagcagctggagcaggacaacagagccctgagaggccagagcctgcagctgctgaaggccagatgcgaggagctgcagctggactgggccaccctgagcctggagaagctgctgaaggagaagcaggccctgaagagccagatcagcgagaagcagagacactgcctggagctgcagatcagcatcgtggagctggagaagagccagagacagcaggagctgctgcagctgaagagctgcgtgccccccgacgacgccctgagcctgcacctgagaggcaagggcgccctgggcagagagctggagcccgacgccagcagactgcacctggagctggactgcaccaagttcagcctgccccacctgagcagcatgagccccgagctgagcatgaacggccaggccgccggctacgagctgtgcggcgtgctgagcagacccagcagcaagcagaacaccccccagtacctggccagccccctggaccaggaggtggtgccctgcacccccagccacgtgggcagacccagactggagaagctgagcggcctggccgcccccgactacaccagactgagccccgccaagatcgtgctgagaagacacctgagccaggaccacaccgtgcccggcagacccgccgccagcgagctgcacagcagagccgagcacaccaaggagaacggcctgccctaccagagccccagcgtgcccggcagcatgaagctgagcccccaggaccccagacccctgagccccggcgccctgcagctggccggcgagaagagcagcgagaagggcctgagagagagagcctacggcagcagcggcgagctgatcaccagcctgcccatcagcatccccctgagcaccgtgcagcccaacaagctgcccgtgagcatccccctggccagcgtggtgctgcccagcagagccgagagagccagaagcacccccagccccgtgctgcagcccagagaccccagcagcaccctggagaagcagatcggcgccaacgcccacggcgccggcagcagaagcctggccctggcccccgccggcttcagctacgccggcagcgtggccatcagcggcgccctggccggcagccccgccagcctgacccccggcgccgagcccgccaccctggacgagagcagcagcagcggcagcctgttcgccaccgtgggcagcagaagcagcaccccccagcaccccctgctgctggcccagcccagaaacagcctgcccgccagccccgcccaccagctgagcagcagccccagactgggcggcgccgcccagggccccctgcccgaggccagcaagggcgacctgcccagcgacagcggcttcagcgaccccgagagcgaggccaagagaagaatcgtgttcaccatcaccaccggcgccggcagcgccaagcagagccccagcagcaagcacagccccctgaccgccagcgccagaggcgactgcgtgcccagccacggccaggacagcagaagaagaggcagaagaaagagagccagcgccggcacccccagcctgagcgccggcgtgagccccaagagaagagccctgcccagcgtggccggcctgttcacccagcccagcggcagccccctgaacctgaacagcatggtgagcaacatcaaccagcccctggagatcaccgccatcagcagccccgagaccagcctgaagagcagccccgtgccctaccaggaccacgaccagccccccgtgctgaagaaggagagacccctgagccagaccaacggcgcccactacagccccctgaccagcgacgaggagcccggcagcgaggacgagcccagcagcgccagaatcgagagaaagatcgccaccatcagcctggagagcaagagcccccccaagaccctggagaacggcggcggcctggccggcagaaagcccgcccccgccggcgagcccgtgaacagcagcaagtggaagagcaccttcagccccatcagcgacatcggcctggccaagagcgccgacagccccctgcaggccagcagcgccctgagccagaacagcctgttcaccttcagacccgccctggaggagcccagcgccgacgccaagctggccgcccaccccagaaagggcttccccggcagcctgagcggcgccgacggcctgagccccggcaccaaccccgccaacggctgcaccttcggcggcggcctggccgccgacctgagcctgcacagcttcagcgacggcgccagcctgccccacaagggccccgaggccgccggcctgagcagccccctgagcttccccagccagagaggcaaggagggcagcgacgccaaccccttcctgagcaagagacagctggacggcctggccggcctgaagggcgagggcagcagaggcaaggaggccggcgagggcggcctgcccctgtgcggccccaccgacaagacccccctgctgagcggcaaggccgccaaggccagagacagagaggtggacctgaagaacggccacaacctgttcatcagcgccgccgccgtgccccccggcagcctgctgagcggccccggcctggcccccgccgccagcagcgccggcggcgccgccagcagcgcccagacccacagaagcttcctgggccccttcccccccggcccccagttcgccctgggccccatgagcctgcaggccaacctgggcagcgtggccggcagcagcgtgctgcagagcctgttcagcagcgtgcccgccgccgccggcctggtgcacgtgagcagcgccgccaccagactgaccaacagccacgccatgggcagcttcagcggcgtggccggcggcaccgtgggcggcaactag

SEQ ID NO: 79612 - DNA, 1203 bp, Artificial Sequence
  Description of Artificial Sequence: Synthetic coding sequence
atgagaggcagaagaggcgacagaatgaccatcaacatccaggagcacatggccatcaacgtgtgccccggccccatcagacccatcagacagatcagcgactacttccccagaggccccggccccgagggcggcggcggcggcggcggcgaggcccccgcccacctggtgcccctggccctggccccccccgccgccctgctgggcgccaccacccccgaggacggcgccgaggtggacagctacgacagcgacgacgccaccgccctgggcaccctggagttcgacctgctgtacgacagagccagctgcaccctgcactgcagcatcctgagagccaagggcctgaagcccatggacttcaacggcctggccgacccctacgtgaagctgcacctgctgcccggcgcctgcaaggccaacaagctgaagaccaagacccagagaaacaccctgaaccccgtgtggaacgaggacctgacctacagcggcatcaccgacgacgacatcacccacaaggtgctgagaatcgccgtgtgcgacgaggacaagctgagccacaacgagttcatcggcgagatcagagtgcccctgagaagactgaagcccagccagaagaagcacttcaacatctgcctggagagacaggtgcccctggccagccccagcagcatgagcgccgccctgagaggcatcagctgctacctgaaggagctggagcaggccgagcagggccagggcctgctggaggagagaggcagaatcctgctgagcctgagctacagcagcagaagaagaggcctgctggtgggcatcctgagatgcgcccacctggccgccatggacgtgaacggctacagcgacccctacgtgaagacctacctgagacccgacgtggacaagaagagcaagcacaagacctgcgtgaagaagaagaccctgaaccccgagttcaacgaggagttcttctacgagatcgagctgagcaccctggccaccaagaccctggaggtgaccgtgtgggactacgacatcggcaagagcaacgacttcatcggcggcgtgagcctgggccccggcgccagaggcgaggccagaaagcactggagcgactgcctgcagcagcccgacgccgccctggagagatggcacaccctgaccagcgagctgccccccgccgccggcgccctgagcagcgcctag

SEQ ID NO: 79613 - DNA, 927 bp, Artificial Sequence
  Description of Artificial Sequence: Synthetic coding sequence
atgaccctgagaagaagaggcgagaaggccaccatcagcatccaggagcacatggccatcgacgtgtgccccggccccatcagacccatcaagcagatcagcgactacttccccagattccccagaggcctgccccccgacgccggccccagagccgccgccccccccgacgcccccgccagacccgccgtggccggcgccggcagaagaagccccagcgacggcgccagagaggacgacgaggacgtggaccagctgttcggcgcctacggcagcagccccggccccagccccggccccagccccgccagaccccccgccaagccccccgaggacgagcccgacgccgacggctacgagagcgacgactgcaccgccctgggcaccctggacttcagcctgctgtacgaccaggagaacaacgccctgcactgcaccatcaccaaggccaagggcctgaagcccatggaccacaacggcctggccgacccctacgtgaagctgcacctgctgcccggcgccagcaaggccaacaagctgagaaccaagaccctgagaaacaccctgaaccccacctggaacgagaccctgacctactacggcatcaccgacgaggacatgatcagaaagaccctgagaatcagcgtgtgcgacgaggacaagttcagacacaacgagttcatcggcgagaccagagtgcccctgaagaagctgaagcccaaccacaccaagaccttcagcatctgcctggagaagcagctgcccgtggacaagaccgaggacaagagcctggaggagagaggcagaatcctgatcagcctgaagtacagcagccagaagcagggcctgctggtgggcatcgtgagatgcgcccacctggccgccatggacgccaacggctacagcgacccctacgtgaagacctag

SEQ ID NO: 79614 - DNA, 927 bp, Artificial Sequence; identical to SEQ ID NO: 79613
  Description of Artificial Sequence: Synthetic coding sequence

SEQ ID NO: 79615 - DNA, 1275 bp, Artificial Sequence
  Description of Artificial Sequence: Synthetic coding sequence
atggccctgcccacccccagcgacagcaccctgcccgccgaggccagaggcagaggcagaagaagaagactggtgtggacccccagccagagcgaggccctgagagcctgcttcgagagaaacccctaccccggcatcgccaccagagagagactggcccaggccatcggcatccccgagcccagagtgcagatctggttccagaacgagagaagcagacagctgagacagcacagaagagagagcagaccctggcccggcagaagaggcccccccgagggcagaagaaagagaaccgccgtgaccggcagccagaccgccctgctgctgagagccttcgagaaggacagattccccggcatcgccgccagagaggagctggccagagagaccggcctgcccgagagcagaatccagatctggttccagaacagaagagccagacaccccggccagggcggcagagcccccgcccaggccggcggcctgtgcagcgccgcccccggcggcggccaccccgcccccagctgggtggccttcgcccacaccggcgcctggggcaccggcctgcccgccccccacgtgccctgcgcccccggcgccctgccccagggcgccttcgtgagccaggccgccagagccgcccccgccctgcagcccagccaggccgcccccgccgagggcgtgagccagcccgcccccgccagaggcgacttcgcctacgccgcccccgccccccccgacggcgccctgagccacccccaggcccccagatggcccccccaccccggcaagagcagagaggacagagacccccagagagacggcctgcccggcccctgcgccgtggcccagcccggccccgcccaggccggcccccagggccagggcgtgctggccccccccaccagccagggcagcccctggtggggctggggcagaggcccccaggtggccggcgccgcctgggagccccaggccggcgccgccccccccccccagcccgccccccccgacgccagcgccagcgccagacagggccagatgcagggcatccccgcccccagccaggccctgcaggagcccgccccctggagcgccctgccctgcggcctgctgctggacgagctgctggccagccccgagttcctgcagcaggcccagcccctgctggagaccgaggcccccggcgagctggaggccagcgaggaggccgccagcctggaggcccccctgagcgaggaggagtacagagccctgctggaggagctgtag

SEQ ID NO: 79616 - DNA, 1458 bp, Artificial Sequence
  Description of Artificial Sequence: Synthetic coding sequence
atgaagggctggagcctgcccgcctgcggccccctgcagggcagactggccggctggctggccgtgagagccggcctgctggccgcccccgccgccgtgcacagccccgccgaggtgcacggcagcccccccgccagcctgtgccccagacccagcgtgaagttcagacccggcctgaccgccatggccctgcccacccccagcgacagcaccctgcccgccgaggccagaggcagaggcagaagaagaagactggtgtggacccccagccagagcgaggccctgagagcctgcttcgagagaaacccctaccccggcatcgccaccagagagagactggcccaggccatcggcatccccgagcccagagtgcagatctggttccagaacgagagaagcagacagctgagacagcacagaagagagagcagaccctggcccggcagaagaggcccccccgagggcagaagaaagagaaccgccgtgaccggcagccagaccgccctgctgctgagagccttcgagaaggacagattccccggcatcgccgccagagaggagctggccagagagaccggcctgcccgagagcagaatccagatctggttccagaacagaagagccagacaccccggccagggcggcagagcccccgcccaggccggcggcctgtgcagcgccgcccccggcggcggccaccccgcccccagctgggtggccttcgcccacaccggcgcctggggcaccggcctgcccgccccccacgtgccctgcgcccccggcgccctgccccagggcgccttcgtgagccaggccgccagagccgcccccgccctgcagcccagccaggccgcccccgccgagggcgtgagccagcccgcccccgccagaggcgacttcgcctacgccgcccccgccccccccgacggcgccctgagccacccccaggcccccagatggcccccccaccccggcaagagcagagaggacagagacccccagagagacggcctgcccggcccctgcgccgtggcccagcccggccccgcccaggccggcccccagggccagggcgtgctggccccccccaccagccagggcagcccctggtggggctggggcagaggcccccaggtggccggcgccgcctgggagccccaggccggcgccgccccccccccccagcccgccccccccgacgccagcgccagcgccagacagggccagatgcagggcatccccgcccccagccaggccctgcaggagcccgccccctggagcgccctgccctgcggcctgctgctggacgagctgctggccagccccgagttcctgcagcaggcccagcccctgctggagaccgaggcccccggcgagctggaggccagcgaggaggccgccagcctggaggcccccctgagcgaggaggagtacagagccctgctggaggagctgtag

SEQ ID NO: 79617 - DNA, 1326 bp, Artificial Sequence
  Description of Artificial Sequence: Synthetic coding sequence
atgaagaccctgcccctgcacagccactgcaccgagatgcagagactgctgcccaagctggagatgctgaccctgggcagcagcttctgcagcctgcagggcgagttctgccaggccatggacagcttcaccaccgtgagccacgtgggcatgtgcgaggagaccgacgccagcttcaacgtgttcagccccaagttccagttcgacagaagccactgccagagcctgagattccaccagaacatggagctggacttcggccacttcgacgagagagacaagaccagcagaaacatgagaggcagcagaatgaacggcctgcccagccccacccacagcgcccactgcagcttctacagaaccagaaccctgcaggccctgagcaacgagaagaaggccaagaaggtgagattctacagaaacggcgacagatacttcaagggcatcgtgtacgccgtgagcagcgacagattcagaagcttcgacgccctgctggccgacctgaccagaagcctgagcgacaacatcaacctgccccagggcgtgagatacatctacaccatcgacggcagcagaaagatcggcagcatggacgagctggaggagggcgagagctacgtgtgcagcagcgacaacttcttcaagaaggtggagtacaccaagaacgtgaaccccaactggagcgtgaacgtgaagaccagcgccaacatgaaggccccccagagcctggccagcagcaacagcgcccaggccagagagaacaaggacttcgtgagacccaagctggtgaccatcatcagaagcggcgtgaagcccagaaaggccgtgagagtgctgctgaacaagaagaccgcccacagcttcgagcaggtgctgaccgacatcaccgaggccatcaagctggagaccggcgtggtgaagaagctgtacaccctggacggcaagcaggtgacctgcctgcacgacttcttcggcgacgacgacgtgttcatcgcctgcggccccgagaagttcagatacgcccaggacgacttcagcctggacgagaacgagtgcagagtgatgaagggcaaccccagcgccaccgccggccccaaggccagccccaccccccagaagaccagcgccaagagccccggccccatgagaagaagcaagagccccgccgacagcgccaacggcaccagcagcagccagctgagcacccccaagagcaagcagagccccatcagcacccccaccagccccggcagcctgagaaagcacaaggacctgtacctgcccctgagcctggacgacagcgacagcctgggcgacagcatgtag

SEQ ID NO: 79618 - DNA, 1098 bp, Artificial Sequence
  Description of Artificial Sequence: Synthetic coding sequence
atggagctggacttcggccacttcgacgagagagacaagaccagcagaaacatgagaggcagcagaatgaacggcctgcccagccccacccacagcgcccactgcagcttctacagaaccagaaccctgcaggccctgagcaacgagaagaaggccaagaaggtgagattctacagaaacggcgacagatacttcaagggcatcgtgtacgccgtgagcagcgacagattcagaagcttcgacgccctgctggccgacctgaccagaagcctgagcgacaacatcaacctgccccagggcgtgagatacatctacaccatcgacggcagcagaaagatcggcagcatggacgagctggaggagggcgagagctacgtgtgcagcagcgacaacttcttcaagaaggtggagtacaccaagaacgtgaaccccaactggagcgtgaacgtgaagaccagcgccaacatgaaggccccccagagcctggccagcagcaacagcgcccaggccagagagaacaaggacttcgtgagacccaagctggtgaccatcatcagaagcggcgtgaagcccagaaaggccgtgagagtgctgctgaacaagaagaccgcccacagcttcgagcaggtgctgaccgacatcaccgaggccatcaagctggagaccggcgtggtgaagaagctgtacaccctggacggcaagcaggtgacctgcctgcacgacttcttcggcgacgacgacgtgttcatcgcctgcggccccgagaagttcagatacgcccaggacgacttcagcctggacgagaacgagtgcagagtgatgaagggcaaccccagcgccaccgccggccccaaggccagccccaccccccagaagaccagcgccaagagccccggccccatgagaagaagcaagagccccgccgacagcggcaacgaccaggacgccaacggcaccagcagcagccagctgagcacccccaagagcaagcagagccccatcagcacccccaccagccccggcagcctgagaaagcacaaggacctgtacctgcccctgagcctggacgacagcgacagcctgggcgacagcatgtag

SEQ ID NO: 79619 - DNA, 1098 bp, Artificial Sequence; identical to SEQ ID NO: 79618
  Description of Artificial Sequence: Synthetic coding sequence

SEQ ID NO: 79620 - DNA, 1317 bp, Artificial Sequence
  Description of Artificial Sequence: Synthetic coding sequence
tgatgcaccgagatgcagagactgctgcccaagctggagatgctgaccctgggcagcagcttctgcagcctgcagggcgagttctgccaggccatggacagcttcaccaccgtgagccacgtgggcatgtgcgaggagaccgacgccagcttcaacgtgttcagccccaagttccagttcgacagaagccactgccagagcctgagattccaccagaacatggagctggacttcggccacttcgacgagagagacaagaccagcagaaacatgagaggcagcagaatgaacggcctgcccagccccacccacagcgcccactgcagcttctacagaaccagaaccctgcaggccctgagcaacgagaagaaggccaagaaggtgagattctacagaaacggcgacagatacttcaagggcatcgtgtacgccgtgagcagcgacagattcagaagcttcgacgccctgctggccgacctgaccagaagcctgagcgacaacatcaacctgccccagggcgtgagatacatctacaccatcgacggcagcagaaagatcggcagcatggacgagctggaggagggcgagagctacgtgtgcagcagcgacaacttcttcaagaaggtggagtacaccaagaacgtgaaccccaactggagcgtgaacgtgaagaccagcgccaacatgaaggccccccagagcctggccagcagcaacagcgcccaggccagagagaacaaggacttcgtgagacccaagctggtgaccatcatcagaagcggcgtgaagcccagaaaggccgtgagagtgctgctgaacaagaagaccgcccacagcttcgagcaggtgctgaccgacatcaccgaggccatcaagctggagaccggcgtggtgaagaagctgtacaccctggacggcaagcaggtgacctgcctgcacgacttcttcggcgacgacgacgtgttcatcgcctgcggccccgagaagttcagatacgcccaggacgacttcagcctggacgagaacgagtgcagagtgatgaagggcaaccccagcgccaccgccggccccaaggccagccccaccccccagaagaccagcgccaagagccccggccccatgagaagaagcaagagccccgccgacagcggcaacgaccaggacgccaacggcaccagcagcagccagctgagcacccccaagagcaagcagagccccatcagcacccccaccagccccggcagcctgagaaagcacaaggacctgtacctgcccctgagcctggacgacagcgacagcctgggcgacagcatgtag

SEQ ID NO: 79621 - DNA, 1083 bp, Artificial Sequence
  Description of Artificial Sequence: Synthetic coding sequence
atggagctggacttcggccacttcgacgagagagacaagaccagcagaaacatgagaggcagcagaatgaacggcctgcccagccccacccacagcgcccactgcagcttctacagaaccagaaccctgcaggccctgagcaacgagaagaaggccaagaaggtgagattctacagaaacggcgacagatacttcaagggcatcgtgtacgccgtgagcagcgacagattcagaagcttcgacgccctgctggccgacctgaccagaagcctgagcgacaacatcaacctgccccagggcgtgagatacatctacaccatcgacggcagcagaaagatcggcagcatggacgagctggaggagggcgagagctacgtgtgcagcagcgacaacttcttcaagaaggtggagtacaccaagaacgtgaaccccaactggagcgtgaacgtgaagaccagcgccaacatgaaggccccccagagcctggccagcagcaacagcgcccaggccagagagaacaaggacttcgtgagacccaagctggtgaccatcatcagaagcggcgtgaagcccagaaaggccgtgagagtgctgctgaacaagaagaccgcccacagcttcgagcaggtgctgaccgacatcaccgaggccatcaagctggagaccggcgtggtgaagaagctgtacaccctggacggcaagcaggtgacctgcctgcacgacttcttcggcgacgacgacgtgttcatcgcctgcggccccgagaagttcagatacgcccaggacgacttcagcctggacgagaacgagtgcagagtgatgaagggcaaccccagcgccaccgccggccccaaggccagccccaccccccagaagaccagcgccaagagccccggccccatgagaagaagcaagagccccgccgacagcgccaacggcaccagcagcagccagctgagcacccccaagagcaagcagagccccatcagcacccccaccagccccggcagcctgagaaagcacaaggacctgtacctgcccctgagcctggacgacagcgacagcctgggcgacagcatgtag

SEQ ID NO: 79622 - DNA, 342 bp, Artificial Sequence
  Description of Artificial Sequence: Synthetic coding sequence
atggagctggacttcggccacttcgacgagagagacaagaccagcagaaacatgagaggcagcagaatgaacggcctgcccagccccacccacagcgcccactgcagcttctacagaaccagaaccctgcaggccctgagcaacgagaagaaggccaagaaggtgagattctacagaaacggcgacagatacttcaagggcatcgtgtacgccgtgagcagcgacagattcagaagcttcgacgccctgctggccgacctgaccagaagcctgagcgacaacatcaacctgccccagggcgtgagatacatctacaccatcgacggcagcagaaagatctag

SEQ ID NO: 79623 - DNA, 1083 bp, Artificial Sequence; identical to SEQ ID NO: 79621
  Description of Artificial Sequence: Synthetic coding sequence

SEQ ID NO: 79624 - DNA, 1065 bp, Artificial Sequence
  Description of Artificial Sequence: Synthetic coding sequence
atggccaagaccggcgccgaggaccacagagaggccctgagccagagcagcctgagcctgctgaccgaggccatggaggtgctgcagcagagcagccccgagggcaccctggacggcaacaccgtgaaccccatctacaagtacatcctgaacgacctgcccagagagttcatgagcagccaggccaaggccgtgatcaagaccaccgacgactacctgcagagccagttcggccccaacagactggtgcacagcgccgccgtgagcgagggcagcggcctgcaggactgcagcacccaccagaccgccagcgaccacagccacgacgagatcagcgacctggacagctacaagagcaacagcaagaacaacagctgcagcatcagcgccagcaagagaaacagacccgtgagcgcccccgtgggccagctgagagtggccgagttcagcagcctgaagttccagagcgccagaaactggcagaagctgagccagagacacaagctgcagcccagagtgatcaaggtgaccgcctacaagaacggcagcagaaccgtgttcgccagagtgaccgtgcccaccatcaccctgctgctggaggagtgcaccgagaagctgaacctgaacatggccgccagaagagtgttcctggccgacggcaaggaggccctggagcccgaggacatcccccacgaggccgacgtgtacgtgagcaccggcgagcccttcctgaaccccttcaagaagatcaaggaccacctgctgctgatcaagaaggtgacctggaccatgaacggcctgatgctgcccaccgacatcaagagaagaaagaccaagcccgtgctgagcatcagaatgaagaagctgaccgagagaaccagcgtgagaatcctgttcttcaagaacggcatgggccaggacggccacgagatcaccgtgggcaaggagaccatgaagaaggtgctggacacctgcaccatcagaatgaacctgaacctgcccgccagatacttctacgacctgtacggcagaaagatcgaggacatcagcaagggcaagcactag

SEQ ID NO: 79625 - DNA, 690 bp, Artificial Sequence
  Description of Artificial Sequence: Synthetic coding sequence
atgaagatgtggaacaactggggctggtgcggcggcagaagaagaggctgcaccaagatcctgagcaccaagaagggcatccagatgagcatcaagaacaagcacctgatcgtgatccccgccttcagccacaccatgagccagctggacttcgacttccactgcgtgttcgtgagcatcgacgagggcatcttcaaggccggcgccgagagaagcgagaccagaggcgccgccgaggtgcaggaggacgaggacacccaggtggaggtgcccgtggaccagagacccgccgagatcgtggacgaggaggaggacggcgagaaggccaacaaggacgccgagcagaaggaggacttcagcggcatgaacggcgacctggaggaggagggcggcagagaggccaccgacgcccccgagcaggtggaggagatcctggaccacagcgagcagcaggccagacccgccagagtgaacggcggcaccgacgaggagaacggcgaggagctgcagcaggtgaacaacgagctgcagctggtgctggacaaggagagaaagagccagggcgccggcagcggccaggacgaggccgacgtggacccccagagaccccccagacccgaggtgaagatcaccagccccgaggagaacgagaacaaccagcagaacaaggactacgccgccgtggcctag

SEQ ID NO: 79626 - DNA, 1431 bp, Artificial Sequence
  Description of Artificial Sequence: Synthetic coding sequence
atgagcggcagcagcgccagaagcagccacctgagccagcccgtggtgaagagcgtgctggtgtacagaaacggcgaccccttctacgccggcagaagagtggtgatccacgagaagaaggtgagcagcttcgaggtgttcctgaaggaggtgaccggcggcgtgcaggcccccttcggcgccgtgagaaacatctacacccccagaaccggccacagaatcagaaagctggaccagatccagagcggcggcaactacgtggccggcggccaggaggccttcaagaagctgaactacctggacatcggcgagatcaagaagagacccatggaggtggtgaacaccgaggtgaagcccgtgatccacagcagaatcaacgtgagcgccagattcagaaagcccctgcaggagccctgcaccatcttcctgatcgccaacggcgacctgatcaaccccgccagcagactgctgatccccagaaagaccctgaaccagtgggaccacgtgctgcagatggtgaccgagaagatcaccctgagaagcggcgccgtgcacagactgtacaccctggagggcaagctggtggagagcggcgccgagctggagaacggccagttctacgtggccgtgggcagagacaagttcaagaagctgccctacagcgagctgctgttcgacaagagcaccatgagaagacccttcggccagaaggccagcagcctgccccccatcgtgggcagcagaaagagcaagggcagcggcaacgacagacacagcaagagcaccgtgggcagcagcgacaacagcagcccccagcccctgaagagaaagggcaagaaggaggacgtgaacagcgagaagctgaccaagctgaagcagaacgtgaagctgaagaacagccaggagaccatccccaacagcgacgagggcatcttcaaggccggcgccgagagaagcgagaccagaggcgccgccgaggtgcaggaggacgaggacacccaggtggaggtgcccgtggaccagagacccgccgagatcgtggacgaggaggaggacggcgagaaggccaacaaggacgccgagcagaaggaggacttcagcggcatgaacggcgacctggaggaggagggcggcagagaggccaccgacgcccccgagcaggtggaggagatcctggaccacagcgagcagcaggccagacccgccagagtgaacggcggcaccgacgaggagaacggcgaggagctgcagcaggtgaacaacgagctgcagctggtgctggacaaggagagaaagagccagggcgccggcagcggccaggacgaggccgacgtggacccccagagaccccccagacccgaggtgaagatcaccagccccgaggagaacgagaacaaccagcagaacaaggactacgccgccgtggcctag

SEQ ID NO: 79627 - DNA, 267 bp, Artificial Sequence
  Description of Artificial Sequence: Synthetic coding sequence
tgagtggtgatccacgagaagaaggtgagcagcttcgaggtgttcctgaaggaggtgaccggcggcgtgcaggcccccttcggcgccgtgagaaacatctacacccccagaaccggccacagaatcagaaagctggaccagatccagagcggcggcaactacgtggccggcggccaggaggccttcaagaagctgaactacctggacatcggcgagatcaagaagagacccatggaggtggtgaacaccgagctgcacgtgctgtag

SEQ ID NO: 79628 - DNA, 363 bp, Artificial Sequence
  Description of Artificial Sequence: Synthetic coding sequence
atgagcggcagcagcgccagaagcagccacctgagccagcccgtggtgaagagcgtgctggtgtacagaaacggcgaccccttctacgccggcagaagagtggtgatccacgagaagaaggtgagcagcttcgaggtgttcctgaaggaggtgaccggcggcgtgcaggcccccttcggcgccgtgagaaacatctacacccccagaaccggccacagaatcagaaagctggaccagatccagagcggcggcaactacgtggccggcggccaggaggccttcaagaagctgaactacctggacatcggcgagatcaagaagagacccatggaggtggtgaacaccgagctgcacgtgctgtag

SEQ ID NO: 79629 - DNA, 1947 bp, Artificial Sequence
  Description of Artificial Sequence: Synthetic coding sequence
atgaagaagcccatctgcaagaccaccgagccctacgcccccgtgagactgagagtgctgcagaacggcgagaagaacaagaacagaagcgtgaccatcctgggccccgacatcagccccggcagaaagacccagtgcaccgagatcctgaacctgcccagcgccgccagaagactgtacaacgagaagggcaaggagatcttcgccctgaaggacctgcagagagacgagctggtgtacgtgagctgcggcgagctgtggatcaaccccgacctgagcatcgcccagcagaagaagcagatcttcctgagaaacctggagagcgacatcgccaagatccagatcttctgcagcacccacaagatcgaggccctggtgctggaggtgcagagcgacatcgtgagcggcagcaagctggccgtgcacaagcccgtggccatcttcggcgaggagaagcaggtgaccgagcccgaggagaagcagatgcaggaggaccccctgaccaccgagaacgccagcagcgagatcctggacagccacgtgagagcccacctgagaatgaaggcctgccacaccctgcccagatacgcctggcaggagaccagccacgacttcgacgaggacgacagcctgcccaagaagaccgagaagggcctgttcgagaacgtggagccccagaagaagcacagctgcagccccaagcacagcaagctgcacaagcactgccaccagcagttcgagtacagagacggccagatcatcagccacgccgccccccagctggtgctgggcgtgcagggccccaacctgagaagcggcatggaggtggtgctggtggagaagaagagcgacggcagccaccagagatggatccaccaggaggacagcagaaccttccacctggtgagcaaccccgacctggtgctggccgtgagcatgaccaagaccagaaacgaggtgtgcggctaccccgtgatcgtgcagaagtacaagccctacaacaacggcgccgccaaccagaagtggcactacatgaagaacatcaaggccctggtggccttccacagcaccgccctggacaaggagatcaccagcgccaactacgccggcgtgtgcaccagcagcgtgatcaaggaggagaacatcgaccagcccggctactgctacctgagccccgacggcaagagaaagaccatgctgtgcctggcctgcggccagagcatgagaaccgagaagggcctgaagcagctgctgcccggcgtgcccttcctgtgcatcagcggcaccaagacccagaagcccttcctgcagggccccttcaaggtgatcagcgtggccgaggtggacctgagctgcgacaaggccgagaagaccctgagctactaccaggccagactgctgagcctgagaatgaagacctgcacccaggccgccagccacagcggcatggccgccacccaccagaaggccgtgaagatcatcgcctacaagaacggcgacggctacagaaacggcaagctgatcgtggccggcaccttccccatgctgctgaccgagtgcaccgagcagctgggcctggccagagccgccagcaaggtgtacaccaaggacggcacccccatcttcaccctgagagacctggtgctgtgggccctggacgagagcttcctgcagagagacagcgagaagcagaagcaggacgccgcccccgtgggcaaggagcagatcatcgtggagaagaaccccagaatgaaggtgaagaacagactgttcgccaagagcgtgaccagcgacagcctggacggcatcgacaagagcctgctgaccctgatcctgagaaaccccatcgccatctgggtgagctgcggcgagcccttcctgccccccaacgagagcagaaagatcagagagaccgagctggccaagaagggccagaacttcggctag

SEQ ID NO: 79630 - DNA, 1365 bp, Artificial Sequence
  Description of Artificial Sequence: Synthetic coding sequence
atgaagaacatcaaggccctggtggccttccacagcaccgccctggacaaggagatcaccagcgccaactacgccggcgtgtgcaccagcagcgtgatcaaggaggagaacatcgaccagcccggctactgctacctgagccccgacggcaagagaaagaccatgctgtgcctggcctgcggccagagcatgagaaccgagaagggcctgaagcagctgctgcccggcgtgcccttcctgtgcatcagcggcaccaagacccagaagcccttcctgcagggccccttcaaggtgatcagcgtggccgaggtggacctgagctgcgacaaggccgagaagaccctgagctactaccaggccagactgctgagcctgagaatgaagacctgcacccaggccgccagccacagcggcatggccgccacccaccagaaggccgtgaagatcatcgcctacaagaacggcgacggctacagaaacggcaagctgatcgtggccggcaccttccccatgctgctgaccgagtgcaccgagcagctgggcctggccagagccgccagcaaggtgtacaccaaggacggcacccccatcttcaccctgagagacctggtgctgtgggccctggacgagagcttcctgcagagagacagcgagaagcagaagcaggacgccgcccccgtgggcaaggagcagatcatcgtggagagcatggaggagaaccccagaatgaaggtgaagaacagactgttcgccaagagcgtgaccagcgacagcctggacggcatcgacaagagcctgctgaccctgatcctgagaaaccccatcgccatctgggtgagctgcggcgagcccttcctgccccccaacgccctgcagaaggccgagaagctggagaagcagaactggctgaagaaggacagaatcctggccgacctggacaccatgagacacaagatgagacagctgaagggcagaagagtggccgcctgccagcccgccaccatggtgcccaccaagagccccgtgcagcccgtggtggtggagggcggctggaccgagcagacccagcaggagatcaagctgatggagctgatcagacacaccgaggcccacctgagcgagatccaggagatggagagcaagatcaacttccccatcgccaccaagagaatcgccgtgaagcccagcaacctgtacaagcagcccaacaccaagagagtgtggatctacctgaacggcggcagacccgaggacggcacctacgcctggggcaagaccatcagcgaggtgagcctgctgtacctgaagacctggatcttcatctggagcagaaaggtgttcttctacttcctgatcaccgcctag

SEQ ID NO: 79631 - DNA, 2190 bp, Artificial Sequence
  Description of Artificial Sequence: Synthetic coding sequence
atgagcttcggcagagacatggagctggagcacttcgacgagagagacaaggcccagagatacagcagaggcagcagagtgaacggcctgcccagccccacccacagcgcccactgcagcttctacagaaccagaaccctgcagaccctgagcagcgagaagaaggccaagaaggtgagattctacagaaacggcgacagatacttcaagggcatcgtgtacgccatcagccccgacagattcagaagcttcgaggccctgctggccgacctgaccagaaccctgagcgacaacgtgaacctgccccagggcgtgagaaccatctacaccatcgacggcctgaagaagatcagcagcctggaccagctggtggagggcgagagctacgtgtgcggcagcatcgagcccttcaagaagctggagtacaccaagaacgtgaaccccaactggagcgtgaacgtgaagaccaccagcgccagcagagccgtgagcagcctggccaccgccaagggcagccccagcgaggtgagagagaacaaggacttcatcagacccaagctggtgaccatcatcagaagcggcgtgaagcccagaaaggccgtgagaatcctgctgaacaagaagaccgcccacagcttcgagcaggtgctgaccgacatcaccgacgccatcaagctggacagcggcgtggtgaagagactgtacaccctggacggcaagcaggtgatgtgcctgcaggacttcttcggcgacgacgacatcttcatcgcctgcggccccgagaagttcagataccaggacgacttcctgctggacgagagcgagtgcagagtggtgaagagcaccagctacaccaagatcgccagcagcagcagaagaagcaccaccaagagccccggccccagcagaagaagcaagagccccgccagcaccagcagcgtgaacggcacccccggcagccagctgagcacccccagaagcggcaagagccccagccccagccccaccagccccggcagcctgagaaagcagagaagcagccagcacggcggcagcagcaccagcctggccagcaccaaggtgtgcagcagcatggacgagaacgacggccccggcgaggaggtgagcgaggagggcttccagatccccgccaccatcaccgagagatacaaggtgggcagaaccatcggcgacggcaacttcgccgtggtgaaggagtgcgtggagagaagcaccgccagagagtacgccctgaagatcatcaagaagagcaagtgcagaggcaaggagcacatgatccagaacgaggtgagcatcctgagaagagtgaagcaccccaacatcgtgctgctgatcgaggagatggacgtgcccaccgagctgtacctggtgatggagctggtgaagggcggcgacctgttcgacgccatcaccagcaccaacaagtacaccgagagagacgccagcggcatgctgtacaacctggccagcgccatcaagtacctgcacagcctgaacatcgtgcacagagacatcaagcccgagaacctgctggtgtacgagcaccaggacggcagcaagagcctgaagctgggcgacttcggcctggccaccatcgtggacggccccctgtacaccgtgtgcggcacccccacctacgtggcccccgagatcatcgccgagaccggctacggcctgaaggtggacatctgggccgccggcgtgatcacctacatcctgctgtgcggcttcccccccttcagaggcagcggcgacgaccaggaggtgctgttcgaccagatcctgatgggccaggtggacttccccagcccctactgggacaacgtgagcgacagcgccaaggagctgatcaccatgatgctgctggtggacgtggaccagagattcagcgccgtgcaggtgctggagcacccctgggtgaacgacgacggcctgcccgagaacgagcaccagctgagcgtggccggcaagatcaagaagcacttcaacaccggccccaagcccaacagcaccgccgccggcgtgagcgtgatcgccctggaccacggcttcaccatcaagagaagcggcagcctggactactaccagcagcccggcatgtactggatcagaccccccctgctgatcagaagaggcagattcagcgacgaggacgccaccagaatgtag

SEQ ID NO: 79632 - DNA, 2223 bp, Artificial Sequence
  Description of Artificial Sequence: Synthetic coding sequence
atgagcttcggcagagacatggagctggagcacttcgacgagagagacaaggcccagagatacagcagaggcagcagagtgaacggcctgcccagccccacccacagcgcccactgcagcttctacagaaccagaaccctgcagaccctgagcagcgagaagaaggccaagaaggtgagattctacagaaacggcgacagatacttcaagggcatcgtgtacgccatcagccccgacagattcagaagcttcgaggccctgctggccgacctgaccagaaccctgagcgacaacgtgaacctgccccagggcgtgagaaccatctacaccatcgacggcctgaagaagatcagcagcctggaccagctggtggagggcgagagctacgtgtgcggcagcatcgagcccttcaagaagctggagtacaccaagaacgtgaaccccaactggagcgtgaacgtgaagaccaccagcgccagcagagccgtgagcagcctggccaccgccaagggcagccccagcgaggtgagagagaacaaggacttcatcagacccaagctggtgaccatcatcagaagcggcgtgaagcccagaaaggccgtgagaatcctgctgaacaagaagaccgcccacagcttcgagcaggtgctgaccgacatcaccgacgccatcaagctggacagcggcgtggtgaagagactgtacaccctggacggcaagcaggtgatgtgcctgcaggacttcttcggcgacgacgacatcttcatcgcctgcggccccgagaagttcagataccaggacgacttcctgctggacgagagcgagtgcagagtggtgaagagcaccagctacaccaagatcgccagcagcagcagaagaagcaccaccaagagccccggccccagcagaagaagcaagagccccgccagcaccagcagcgtgaacggcacccccggcagccagctgagcacccccagaagcggcaagagccccagccccagccccaccagccccggcagcctgagaaagcagagaagcagccagcacggcggcagcagcaccagcctggccagcaccaaggtgtgcagcagcatggacgagaacgacggccccggcgaggaggtgagcgaggagggcttccagatccccgccaccatcaccgagagatacaaggtgggcagaaccatcggcgacggcaacttcgccgtggtgaaggagtgcgtggagagaagcaccgccagagagtacgccctgaagatcatcaagaagagcaagtgcagaggcaaggagcacatgatccagaacgaggtgagcatcctgagaagagtgaagcaccccaacatcgtgctgctgatcgaggagatggacgtgcccaccgagctgtacctggtgatggagctggtgaagggcggcgacctgttcgacgccatcaccagcaccaacaagtacaccgagagagacgccagcggcatgctgtacaacctggccagcgccatcaagtacctgcacagcctgaacatcgtgcacagagacatcaagcccgagaacctgctggtgtacgagcaccaggacggcagcaagagcctgaagctgggcgacttcggcctggccaccatcgtggacggccccctgtacaccgtgtgcggcacccccacctacgtggcccccgagatcatcgccgagaccggctacggcctgaaggtggacatctgggccgccggcgtgatcacctacatcctgctgtgcggcttcccccccttcagaggcagcggcgacgaccaggaggtgctgttcgaccagatcctgatgggccaggtggacttccccagcccctactgggacaacgtgagcgacagcgccaaggagctgatcaccatgatgctgctggtggacgtggaccagagattcagcgccgtgcaggtgctggagcacccctgggtgaacgacgacggcctgcccgagaacgagcaccagctgagcgtggccggcaagatcaagaagcacttcaacaccggccccaagcccaacagcaccgccgccggcgtgagcgtgatcgccaccaccgccctggacaaggagagacaggtgttcagaagaagaagaaaccaggacgtgagaagcagatacaaggcccagcccgccccccccgagctgaacagcgagagcgaggactacagccccagcagcagcgagaccgtgagaagccccaacagccccttctag

SEQ ID NO: 79633 - DNA, 1092 bp, Artificial Sequence
  Description of Artificial Sequence: Synthetic coding sequence
atgagcttcggcagagacatggagctggagcacttcgacgagagagacaaggcccagagatacagcagaggcagcagagtgaacggcctgcccagccccacccacagcgcccactgcagcttctacagaaccagaaccctgcagaccctgagcagcgagaagaaggccaagaaggtgagattctacagaaacggcgacagatacttcaagggcatcgtgtacgccatcagccccgacagattcagaagcttcgaggccctgctggccgacctgaccagaaccctgagcgacaacgtgaacctgccccagggcgtgagaaccatctacaccatcgacggcctgaagaagatcagcagcctggaccagctggtggagggcgagagctacgtgtgcggcagcatcgagcccttcaagaagctggagtacaccaagaacgtgaaccccaactggagcgtgaacgtgaagaccaccagcgccagcagagccgtgagcagcctggccaccgccaagggcagccccagcgaggtgagagagaacaaggacttcatcagacccaagctggtgaccatcatcagaagcggcgtgaagcccagaaaggccgtgagaatcctgctgaacaagaagaccgcccacagcttcgagcaggtgctgaccgacatcaccgacgccatcaagctggacagcggcgtggtgaagagactgtacaccctggacggcaagcaggtgatgtgcctgcaggacttcttcggcgacgacgacatcttcatcgcctgcggccccgagaagttcagataccaggacgacttcctgctggacgagagcgagtgcagagtggtgaagagcaccagctacaccaagatcgccagcagcagcagaagaagcaccaccaagagccccggccccagcagaagaagcaagagccccgccagcaccagcagcgtgaacggcacccccggcagccagctgagcacccccagaagcggcaagagccccagccccagccccaccagccccggcagcctgagaaagcagagagacctgtacagacccctgagcagcgacgacctggacagcgtgggcgacagcgtgtag

SEQ ID NO: 79634 - DNA, 1302 bp, Artificial Sequence
  Description of Artificial Sequence: Synthetic coding sequence
atgctggagctgatcgaggtgaacggcacccccggcagccagctgagcacccccagaagcggcaagagccccagccccagccccaccagccccggcagcctgagaaagcagagaagcagccagcacggcggcagcagcaccagcctggccagcaccaaggtgtgcagcagcatggacgagaacgacggccccggcgaggaggtgagcgaggagggcttccagatccccgccaccatcaccgagagatacaaggtgggcagaaccatcggcgacggcaacttcgccgtggtgaaggagtgcgtggagagaagcaccgccagagagtacgccctgaagatcatcaagaagagcaagtgcagaggcaaggagcacatgatccagaacgaggtgagcatcctgagaagagtgaagcaccccaacatcgtgctgctgatcgaggagatggacgtgcccaccgagctgtacctggtgatggagctggtgaagggcggcgacctgttcgacgccatcaccagcaccaacaagtacaccgagagagacgccagcggcatgctgtacaacctggccagcgccatcaagtacctgcacagcctgaacatcgtgcacagagacatcaagcccgagaacctgctggtgtacgagcaccaggacggcagcaagagcctgaagctgggcgacttcggcctggccaccatcgtggacggccccctgtacaccgtgtgcggcacccccacctacgtggcccccgagatcatcgccgagaccggctacggcctgaaggtggacatctgggccgccggcgtgatcacctacatcctgctgtgcggcttcccccccttcagaggcagcggcgacgaccaggaggtgctgttcgaccagatcctgatgggccaggtggacttccccagcccctactgggacaacgtgagcgacagcgccaaggagctgatcaccatgatgctgctggtggacgtggaccagagattcagcgccgtgcaggtgctggagcacccctgggtgaacgacgacggcctgcccgagaacgagcaccagctgagcgtggccggcaagatcaagaagcacttcaacaccggccccaagcccaacagcaccgccgccggcgtgagcgtgatcgccaccaccgccctggacaaggagagacaggtgttcagaagaagaagaaaccaggacgtgagaagcagatacaaggcccagcccgccccccccgagctgaacagcgagagcgaggactacagccccagcagcagcgagaccgtgagaagccccaacagccccttctag

SEQ ID NO: 79635 - DNA, 1266 bp, Artificial Sequence
  Description of Artificial Sequence: Synthetic coding sequence
ctgagcctgatcaagttcaacggcacccccggcagccagctgagcacccccagaagcggcaagagccccagccccagccccaccagccccggcagcctgagaaagcagagaagcagccagcacggcggcagcagcaccagcctggccagcaccaaggtgtgcagcagcatggacgagaacgacggccccggcgaggaggtgagcgaggagggcttccagatccccgccaccatcaccgagagatacaaggtgggcagaaccatcggcgacggcaacttcgccgtggtgaaggagtgcgtggagagaagcaccgccagagagtacgccctgaagatcatcaagaagagcaagtgcagaggcaaggagcacatgatccagaacgaggtgagcatcctgagaagagtgaagcaccccaacatcgtgctgctgatcgaggagatggacgtgcccaccgagctgtacctggtgatggagctggtgaagggcggcgacctgttcgacgccatcaccagcaccaacaagtacaccgagagagacgccagcggcatgctgtacaacctggccagcgccatcaagtacctgcacagcctgaacatcgtgcacagagacatcaagcccgagaacctgctggtgtacgagcaccaggacggcagcaagagcctgaagctgggcgacttcggcctggccaccatcgtggacggccccctgtacaccgtgtgcggcacccccacctacgtggcccccgagatcatcgccgagaccggctacggcctgaaggtggacatctgggccgccggcgtgatcacctacatcctgctgtgcggcttcccccccttcagaggcagcggcgacgaccaggaggtgctgttcgaccagatcctgatgggccaggtggacttccccagcccctactgggacaacgtgagcgacagcgccaaggagctgatcaccatgatgctgctggtggacgtggaccagagattcagcgccgtgcaggtgctggagcacccctgggtgaacgacgacggcctgcccgagaacgagcaccagctgagcgtggccggcaagatcaagaagcacttcaacaccggccccaagcccaacagcaccgccgccggcgtgagcgtgatcgccctggaccacggcttcaccatcaagagaagcggcagcctggactactaccagcagcccggcatgtactggatcagaccccccctgctgatcagaagaggcagattcagcgacgaggacgccaccagaatgtag

SEQ ID NO: 79636 - DNA, 1860 bp, Artificial Sequence
  Description of Artificial Sequence: Synthetic coding sequence
atgagcttcggcagagacatggagctggagcacttcgacgagagagacaaggcccagagatacagcagaggcagcagagtgaacggcctgcccagccccacccacagcgcccactgcagcttctacagaaccagaaccctgcagaccctgagcagcgagaagaaggccaagaaggtgagattctacagaaacggcgacagatacttcaagggcatcgtgtacgccatcagccccgacagattcagaagcttcgaggccctgctggccgacctgaccagaaccctgagcgacaacgtgaacctgccccagggcgtgagaaccatctacaccatcgacggcctgaagaagatcagcagcctggaccagctggtggagggcgagagctacgtgtgcggcagcatcgagcccttcaagaagctggagtacaccaagaacgtgaaccccaactggagcgtgaacgtgaagaccaccagcgccagcagagccgtgagcagcctggccaccgccaagggcagccccagcgaggtgagagagaacaaggacttcatcagacccaagctggtgaccatcatcagaagcggcgtgaagcccagaaaggccgtgagaatcctgctgaacaagaagaccgcccacagcttcgagcaggtgctgaccgacatcaccgacgccatcaagctggacagcggcgtggtgaagagactgtacaccctggacggcaagcaggtgatgtgcctgcaggacttcttcggcgacgacgacatcttcatcgcctgcggccccgagaagttcagataccaggacgacttcctgctggacgagagcgagtgcagagtggtgaagagcaccagctacaccaagatcgccagcagcagcagaagaagcaccaccaagagccccggccccagcagaagaagcaagagccccgccagcaccagcagcgtgaacggcacccccggcagccagctgagcacccccagaagcggcaagagccccagccccagccccaccagccccggcagcctgagaaagcagagaagcagccagcacggcggcagcagcaccagcctggccagcaccaaggtgtgcagcagcatggacgagaacgacggccccggcgaggaggtgagcgaggagggcttccagatccccgccaccatcaccgagagatacaaggtgggcagaaccatcggcgacggcaacttcgccgtggtgaaggagtgcgtggagagaagcaccgccagagagtacgccctgaagatcatcaagaagagcaagtgcagaggcaaggagcacatgatccagaacgaggtgagcatcctgagaagagtgaagcaccccaacatcgtgctgctgatcgaggagatggacgtgcccaccgagctgtacctggtgatggagctggtgaagggcggcgacctgttcgacgccatcaccagcaccaacaagtacctgcacagcctgaacatcgtgcacagagacatcaagcccgagaacctgctggtgtacgagcaccaggacggcagcaagagcctgaagctgggcgacttcggcctggccaccatcgtggacggccccctgtacaccgtgtgcggcacccccacctacgtggcccccgagatcatcgccgagaccggctacggcctgaaggtggacatctgggccgccggcgtgatcacctacatcctgctgtgcggcttcccccccttcagaggcagcggcgacgaccaggaggtgctgttcgaccagatcctgatgggccaggtggacttccccagcccctactgggacaacgtgagcgacagcgccaaggagctgatcaccatgatggccagccagaagatgaacatcagctgccagtag

SEQ ID NO: 79637 - DNA, 2301 bp, Artificial Sequence
  Description of Artificial Sequence: Synthetic coding sequence
atggccagcaccagaagcatcgagctggagcacttcgaggagagagacaagagacccagacccggcagcagaagaggcgcccccagcagcagcggcggcagcagcagcagcggccccaagggcaacggcctgatccccagccccgcccacagcgcccactgcagcttctacagaaccagaaccctgcaggccctgagcagcgagaagaaggccaagaaggccagattctacagaaacggcgacagatacttcaagggcctggtgttcgccatcagcagcgacagattcagaagcttcgacgccctgctgatcgagctgaccagaagcctgagcgacaacgtgaacctgccccagggcgtgagaaccatctacaccatcgacggcagcagaaaggtgaccagcctggacgagctgctggagggcgagagctacgtgtgcgccagcaacgagcccttcagaaaggtggactacaccaagaacatcaaccccaactggagcgtgaacatcaagggcggcaccagcagagccctggccgccgccagcagcgtgaagagcgaggtgaaggagagcaaggacttcatcaagcccaagctggtgaccgtgatcagaagcggcgtgaagcccagaaaggccgtgagaatcctgctgaacaagaagaccgcccacagcttcgagcaggtgctgaccgacatcaccgaggccatcaagctggacagcggcgtggtgaagagactgtgcaccctggacggcaagcaggtgacctgcctgcaggacttcttcggcgacgacgacgtgttcatcgcctgcggccccgagaagttcagatacgcccaggacgacttcgtgctggaccacagcgagtgcagagtgctgaagagcagctacagcagaagcagcgccgtgaagtacagcggcagcaagagccccggccccagcagaagaagcaagagccccgccagcgtgaacggcacccccagcagccagctgagcacccccaagagcaccaagagcagcagcagcagccccaccagccccggcagcttcagaggcctgaagcagatcagcgcccacggcagaagcagcagcaacgtgaacggcggccccgagctggacagatgcatcagccccgagggcgtgaacggcaacagatgcagcgagagcagcaccctgctggagaagtacaagatcggcaaggtgatcggcgacggcaacttcgccgtggtgaaggagtgcatcgacagaagcaccggcaaggagttcgccctgaagatcatcgacaaggccaagtgctgcggcaaggagcacctgatcgagaacgaggtgagcatcctgagaagagtgaagcaccccaacatcatcatgctggtggaggagatggagaccgccaccgagctgttcctggtgatggagctggtgaagggcggcgacctgttcgacgccatcaccagcagcaccaagtacaccgagagagacggcagcgccatggtgtacaacctggccaacgccctgagatacctgcacggcctgagcatcgtgcacagagacatcaagcccgagaacctgctggtgtgcgagtaccccgacggcaccaagagcctgaagctgggcgacttcggcctggccaccgtggtggagggccccctgtacaccgtgtgcggcacccccacctacgtggcccccgagatcatcgccgagaccggctacggcctgaaggtggacatctgggccgccggcgtgatcacctacatcctgctgtgcggcttcccccccttcagaagcgagaacaacctgcaggaggacctgttcgaccagatcctggccggcaagctggagttccccgccccctactgggacaacatcaccgacagcgccaaggagctgatcagccagatgctgcaggtgaacgtggaggccagatgcaccgccggccagatcctgagccacccctgggtgagcgacgacgccagccaggagaacaacatgcaggccgaggtgaccggcaagctgaagcagcacttcaacaacgccctgcccaagcagaacagcaccaccaccggcgtgagcgtgatcatgaacaccgccctggacaaggagggccagatcttctgcagcaagcactgccaggacagcggcagacccggcatggagcccatcagccccgtgccccccagcgtggaggagatccccgtgcccggcgaggccgtgcccgcccccaccccccccgagagccccaccccccaccccccccccgccgcccccggcggcgagagagccggcacctggagaagacacagagactag

SEQ ID NO: 79638 - DNA, 2352 bp, Artificial Sequence
  Description of Artificial Sequence: Synthetic coding sequence
atggccagcaccagaagcatcgagctggagcacttcgaggagagagacaagagacccagacccggcagcagaagaggcgcccccagcagcagcggcggcagcagcagcagcggccccaagggcaacggcctgatccccagccccgcccacagcgcccactgcagcttctacagaaccagaaccctgcaggccctgagcagcgagaagaaggccaagaaggccagattctacagaaacggcgacagatacttcaagggcctggtgttcgccatcagcagcgacagattcagaagcttcgacgccctgctgatcgagctgaccagaagcctgagcgacaacgtgaacctgccccagggcgtgagaaccatctacaccatcgacggcagcagaaaggtgaccagcctggacgagctgctggagggcgagagctacgtgtgcgccagcaacgagcccttcagaaaggtggactacaccaagaacatcaaccccaactggagcgtgaacatcaagggcggcaccagcagagccctggccgccgccagcagcgtgaagagcgaggtgaaggagagcaaggacttcatcaagcccaagctggtgaccgtgatcagaagcggcgtgaagcccagaaaggccgtgagaatcctgctgaacaagaagaccgcccacagcttcgagcaggtgctgaccgacatcaccgaggccatcaagctggacagcggcgtggtgaagagactgtgcaccctggacggcaagcaggtgacctgcctgcaggacttcttcggcgacgacgacgtgttcatcgcctgcggccccgagaagttcagatacgcccaggacgacttcgtgctggaccacagcgagtgcagagtgctgaagagcagctacagcagaagcagcgccgtgaagtacagcggcagcaagagccccggccccagcagaagaagcaagagccccgccagcgtgaagagaggcggccactacagcagcgcctacagcaccgccaagagccccgtgaacggcacccccagcagccagctgagcacccccaagagcaccaagagcagcagcagcagccccaccagccccggcagcttcagaggcctgaagcagatcagcgcccacggcagaagcagcagcaacgtgaacggcggccccgagctggacagatgcatcagccccgagggcgtgaacggcaacagatgcagcgagagcagcaccctgctggagaagtacaagatcggcaaggtgatcggcgacggcaacttcgccgtggtgaaggagtgcatcgacagaagcaccggcaaggagttcgccctgaagatcatcgacaaggccaagtgctgcggcaaggagcacctgatcgagaacgaggtgagcatcctgagaagagtgaagcaccccaacatcatcatgctggtggaggagatggagaccgccaccgagctgttcctggtgatggagctggtgaagggcggcgacctgttcgacgccatcaccagcagcaccaagtacaccgagagagacggcagcgccatggtgtacaacctggccaacgccctgagatacctgcacggcctgagcatcgtgcacagagacatcaagcccgagaacctgctggtgtgcgagtaccccgacggcaccaagagcctgaagctgggcgacttcggcctggccaccgtggtggagggccccctgtacaccgtgtgcggcacccccacctacgtggcccccgagatcatcgccgagaccggctacggcctgaaggtggacatctgggccgccggcgtgatcacctacatcctgctgtgcggcttcccccccttcagaagcgagaacaacctgcaggaggacctgttcgaccagatcctggccggcaagctggagttccccgccccctactgggacaacatcaccgacagcgccaaggagctgatcagccagatgctgcaggtgaacgtggaggccagatgcaccgccggccagatcctgagccacccctgggtgagcgacgacgccagccaggagaacaacatgcaggccgaggtgaccggcaagctgaagcagcacttcaacaacgccctgcccaagcagaacagcaccaccaccggcgtgagcgtgatcatgaacaccgccctggacaaggagggccagatcttctgcagcaagcactgccaggacagcggcagacccggcatggagcccatcagccccgtgccccccagcgtggaggagatccccgtgcccggcgaggccgtgcccgcccccaccccccccgagagccccaccccccaccccccccccgccgcccccggcggcgagagagccggcacctggagaagacacagagactag

SEQ ID NO: 79639 - DNA, 2298 bp, Artificial Sequence
  Description of Artificial Sequence: Synthetic coding sequence
atggccagcaccagaagcatcgagctggagcacttcgaggagagagacaagagacccagacccggcagcagaagaggcgcccccagcagcagcggcggcagcagcagcagcggccccaagggcaacggcctgatccccagccccgcccacagcgcccactgcagcttctacagaaccagaaccctgcaggccctgagcagcgagaagaaggccaagaaggccagattctacagaaacggcgacagatacttcaagggcctggtgttcgccatcagcagcgacagattcagaagcttcgacgccctgctgatcgagctgaccagaagcctgagcgacaacgtgaacctgccccagggcgtgagaaccatctacaccatcgacggcagcagaaaggtgaccagcctggacgagctgctggagggcgagagctacgtgtgcgccagcaacgagcccttcagaaaggtggactacaccaagaacatcaaccccaactggagcgtgaacatcaagggcggcaccagcagagccctggccgccgccagcagcgtgaagagcgaggtgaaggagagcaaggacttcatcaagcccaagctggtgaccgtgatcagaagcggcgtgaagcccagaaaggccgtgagaatcctgctgaacaagaagaccgcccacagcttcgagcaggtgctgaccgacatcaccgaggccatcaagctggacagcggcgtggtgaagagactgtgcaccctggacggcaagcaggtgacctgcctgcaggacttcttcggcgacgacgacgtgttcatcgcctgcggccccgagaagttcagatacgcccaggacgacttcgtgctggaccacagcgagtgcagagtgctgaagagcagctacagcagaagcagcgccgtgaagtacagcggcagcaagagccccggccccagcagaagaagcaagagccccgccagcgtgaacggcacccccagcagccagctgagcacccccaagagcaccaagagcagcagcagcagccccaccagccccggcagcttcagaggcctgaagatcagcgcccacggcagaagcagcagcaacgtgaacggcggccccgagctggacagatgcatcagccccgagggcgtgaacggcaacagatgcagcgagagcagcaccctgctggagaagtacaagatcggcaaggtgatcggcgacggcaacttcgccgtggtgaaggagtgcatcgacagaagcaccggcaaggagttcgccctgaagatcatcgacaaggccaagtgctgcggcaaggagcacctgatcgagaacgaggtgagcatcctgagaagagtgaagcaccccaacatcatcatgctggtggaggagatggagaccgccaccgagctgttcctggtgatggagctggtgaagggcggcgacctgttcgacgccatcaccagcagcaccaagtacaccgagagagacggcagcgccatggtgtacaacctggccaacgccctgagatacctgcacggcctgagcatcgtgcacagagacatcaagcccgagaacctgctggtgtgcgagtaccccgacggcaccaagagcctgaagctgggcgacttcggcctggccaccgtggtggagggccccctgtacaccgtgtgcggcacccccacctacgtggcccccgagatcatcgccgagaccggctacggcctgaaggtggacatctgggccgccggcgtgatcacctacatcctgctgtgcggcttcccccccttcagaagcgagaacaacctgcaggaggacctgttcgaccagatcctggccggcaagctggagttccccgccccctactgggacaacatcaccgacagcgccaaggagctgatcagccagatgctgcaggtgaacgtggaggccagatgcaccgccggccagatcctgagccacccctgggtgagcgacgacgccagccaggagaacaacatgcaggccgaggtgaccggcaagctgaagcagcacttcaacaacgccctgcccaagcagaacagcaccaccaccggcgtgagcgtgatcatgaacaccgccctggacaaggagggccagatcttctgcagcaagcactgccaggacagcggcagacccggcatggagcccatcagccccgtgccccccagcgtggaggagatccccgtgcccggcgaggccgtgcccgcccccaccccccccgagagccccaccccccaccccccccccgccgcccccggcggcgagagagccggcacctggagaagacacagagactag

SEQ ID NO: 79640 - DNA, 1947 bp, Artificial Sequence
  Description of Artificial Sequence: Synthetic coding sequence
atgggcaaggagcccctgaccctgaagagcatccaggtggccgtggaggagctgtaccccaacaaggccagagccctgaccctggcccagcacagcagagcccccagccccagactgagaagcagactgttcagcaaggccctgaagggcgaccacagatgcggcgagaccgagacccccaagagctgcagcgaggtggccggctgcaaggccgccatgagacaccagggcaagatccccgaggagctgagcctggacgacagagccagaacccagaagaagtggggcagaggcaagtgggagcccgagcccagcagcaagccccccagagaggccaccctggaggagagacacgccagaggcgagaagcacctgggcgtggagatcgagaagaccagcggcgagatcatcagatgcgagaagtgcaagagagagagagagctgcagcagagcctggagagagagagactgagcctgggcaccagcgagctggacatgggcaagggccccatgtacgacgtggagaagctggtgagaaccagaagctgcagaagaagccccgaggccaaccccgccagcggcgaggagggctggaagggcgacagccacagaagcagccccagaaaccccacccaggagctgagaagacccagcaagagcatggacaagaaggaggacagaggccccgaggaccaggagagccacgcccagggcgccgccaaggccaagaaggacctggtggaggtgctgcccgtgaccgaggagggcctgagagaggtgaagaaggacaccagacccatgagcagaagcaagcacggcggctggctgctgagagagcaccaggccggcttcgagaagctgagaagaaccagaggcgaggagaaggaggccgagaaggagaagaagccctgcatgagcggcggcagaagaatgaccctgagagacgaccagcccgccaagctggagaaggagcccaagaccagacccgaggagaacaagcccgagagacccagcggcagaaagcccagacccatgggcatcatcgccgccaacgtggagaagcactacgagaccggcagagtgatcggcgacggcaacttcgccgtggtgaaggagtgcagacacagagagaccagacaggcctacgccatgaagatcatcgacaagagcagactgaagggcaaggaggacatggtggacagcgagatcctgatcatccagagcctgagccaccccaacatcgtgaagctgcacgaggtgtacgagaccgacatggagatctacctgatcctggagtacgtgcagggcggcgacctgttcgacgccatcatcgagagcgtgaagttccccgagcccgacgccgccctgatgatcatggacctgtgcaaggccctggtgcacatgcacgacaagagcatcgtgcacagagacctgaagcccgagaacctgctggtgcagagaaacgaggacaagagcaccaccctgaagctggccgacttcggcctggccaagcacgtggtgagacccatcttcaccgtgtgcggcacccccacctacgtggcccccgagatcctgagcgagaagggctacggcctggaggtggacatgtgggccgccggcgtgatcctgtacatcctgctgtgcggcttcccccccttcagaagccccgagagagaccaggacgagctgttcaacatcatccagctgggccacttcgagttcctgcccccctactgggacaacatcagcgacgccgccaaggacctggtgagcagactgctggtggtggaccccaagaagagatacaccgcccaccaggtgctgcagcacccctggatcgagaccgccggcaagaccaacaccgtgaagagacagaagcaggtgagccccagcagcgagggccacttcagaagccagcacaagagagtggtggagcaggtgagctag

SEQ ID NO: 79641 - DNA, 1122 bp, Artificial Sequence
  Description of Artificial Sequence: Synthetic coding sequence
atgcccaacgacgaggccttcagcaagcccagcacccccagcgaggccccccacgcccccggcgtgcccccccagggcagagccggcggcttcggcaaggccagcggcgccctggtgggcgccgccagcggcagcagcgccggcggcagcagcagaggcggcggcagcggcagcggcgccagcgacctgggcgccggcagcaagaagagccccagactgcccaagtgcgccagatgcagaaaccacggctacgccagccccctgaagggccacaagagattctgcatgtggagagactgccagtgcaagaagtgcaacctgatcgccgagagacagagagtgatggccgcccaggtggccctgagaagacagcaggcccaggaggaggagctgggcatcagccaccccatccccctgcccagcgccgccgagctgctggtgaagagagagaacaacggcagcaacccctgcctgatgaccgagtgcagcggcaccagccagcccccccccgccagcgtgcccaccaccgccgccagcgagggcagaatggtgatccaggacatccccgccgtgaccagcagaggccacgtggagaacacccccgacctggtgagcgacagcacctactacagcagcttctaccagcccagcctgttcccctactacaacaacctgtacaactgcccccagtacagcatggccctggccgccgacagcgccagcggcgaggtgggcaaccccctgggcggcagccccgtgaagaacagcctgagaggcctgcccggcccctacgtgcccggccagaccggcaaccagtggcagatgaagaacatggagaacagacacgccatgagcagccagtacagaatgcacagctactaccccccccccagctacctgggccagagcgtgccccagttcttcaccttcgaggacgcccccagctaccccgaggccagagccagcgtgttcagcccccccagcagccaggacagcggcctggtgagcctgagcagcagcagccccatcagcaacaagagcaccaaggccgtgctggagtgcgagcccgccagcgagcccagcagcttcaccgtgacccccgtgatcgaggaggacgagtag

SEQ ID NO: 79642 - DNA, 525 bp, Artificial Sequence
  Description of Artificial Sequence: Synthetic coding sequence
atgcccaacgacgaggccttcagcaagcccagcacccccagcgaggccccccacgcccccggcgtgcccccccagggcagagccggcggcttcggcaaggccagcggcgccctggtgggcgccgccagcggcagcagcgccggcggcagcagcagaggcggcggcagcggcagcggcgccagcgacctgggcgccggcagcaagaagagccccagactgcccaagtgcgccagatgcagaaaccacggctacgccagccccctgaagggccacaagagattctgcatgtggagagactgccagtgcaagaagtgcaacctgatcgccgagagacagagagtgatggccgcccaggtgggcgccggcgtgagagagcccggcttcagcctgagcttcttcttcttcttcttcttcagatggagcctggccagactgcccagactgcagtgcagcggcgccatcctggcccactgcaacagcgccagcagagtgcaggccatcctgctgccccagccccccaagtag

SEQ ID NO: 79643 - DNA, 681 bp, Artificial Sequence
  Description of Artificial Sequence: Synthetic coding sequence
atggccgacccccaggccggcagcgccgccggcgactgggagatcgacgtggagagcctggagctggaggaggacgtgtgcggcgcccccagaagcaccccccccggccccagccccccccccgccgacggcgactgcgaggacgacgaggacgacgacggcgtggacgaggacgccgaggaggagggcgacggcgaggaggccggcgccagccccggcatgcccggccagcccgagcagagaggcggcccccagcccagaccccccctggccccccaggccagccccgccggcaccggccccagagagagatgcacccccgccggcggcggcgccgagcccagaaagctgagcagaacccccaagtgcgccagatgcagaaaccacggcgtggtgagctgcctgaagggccacaagagattctgcagatggagagactgccagtgcgccaactgcctgctggtggtggagagacagagagtgatggccgcccaggtggccctgagaagacagcaggccaccgaggacaagaagggcctgagcggcaagcagaacaacttcgagagaaaggccgtgtaccagagacaggtgagagcccccagcctgctggccaagagcatcctggaggtgctgctgggcctgttctacagctactacgtgtacatcatgaaccacctgtag

SEQ ID NO: 79644 - DNA, 1686 bp, Artificial Sequence
  Description of Artificial Sequence: Synthetic coding sequence
atggccgacccccaggccggcagcgccgccggcgactgggagatcgacgtggagagcctggagctggaggaggacgtgtgcggcgcccccagaagcaccccccccggccccagccccccccccgccgacggcgactgcgaggacgacgaggacgacgacggcgtggacgaggacgccgaggaggagggcgacggcgaggaggccggcgccagccccggcatgcccggccagcccgagcagagaggcggcccccagcccagaccccccctggccccccaggccagccccgccggcaccggccccagagagagatgcacccccgccggcggcggcgccgagcccagaaagctgagcagaacccccaagtgcgccagatgcagaaaccacggcgtggtgagctgcctgaagggccacaagagattctgcagatggagagactgccagtgcgccaactgcctgctggtggtggagagacagagagtgatggccgcccaggtggccctgagaagacagcaggccaccgaggacaagaagggcctgagcggcaagcagaacaacttcgagagaaaggccgtgtaccagagacaggtgagagcccccagcctgctggccaagagcatcctggagggctacagacccatccccgccgagacctacgtgggcggcaccttccccctgcccccccccgtgagcgacagaatgagaaagagaagagccttcgccgacaaggagctggagaacatcatgctggagagagagtacaaggagagagagatgctggagaccagccaggccgccgccctgttcctgcccaacagaatggtgcccggccccgactacaacagctacaagagcgcctacagccccagccccgtggagccccccagcaaggacttctgcaacttcctgcccacctgcctggacctgaccatgcagtacagcggcagcggcaacatggagctgatcagcagcaacgtgagcgtggccaccacctacagacagtaccccctgagcagcagattcctggtgtggcccaagtgcggccccatcagcgacaccctgctgtaccagcagtgcctgctgaacgccaccaccagcgtgcaggccctgaagcccggcgccagctgggacctgaagggcgccagagtgcaggacggcctgagcgccgagcaggacatgatgcccagcaagctggagggcagcctggtgctgccccacacccccgagatccagaccaccagaagcgacctgcagggccaccaggccgtgcccgagagaagcgccttcagcccccccagaagaaacttcagccccatcgtggacaccgacagcctggccgcccagggccacgtgctgaccaagatcagcaaggagaacaccagacaccccctgcccctgagacacaaccccttccacagcctgttccagcagaccctgaccgacaagagcggccccgagctgaagacccccttcgtgaaggaggccttcgaggagacccccaagaagcacagagagtgcctggtgaaggacaaccagaagtacaccttcaccatcgacagatgcgccaaggacctgttcgtggccaagcaggtgggcaccaagctgagcgtgaacgagcccctgagcttcagcgtggagagcatcctgaagagacccagcagcgccatcaccagagtgagccagtag

SEQ ID NO: 79645 - DNA, 1686 bp, Artificial Sequence; identical to SEQ ID NO: 79644
  Description of Artificial Sequence: Synthetic coding sequence

SEQ ID NO: 79646 - DNA, 1686 bp, Artificial Sequence; identical to SEQ ID NO: 79644
  Description of Artificial Sequence: Synthetic coding sequence

SEQ ID NO: 79647 - DNA, 681 bp, Artificial Sequence; identical to SEQ ID NO: 79643
  Description of Artificial Sequence: Synthetic coding sequence

SEQ ID NO: 79648 - DNA, 681 bp, Artificial Sequence; identical to SEQ ID NO: 79643
  Description of Artificial Sequence: Synthetic coding sequence

SEQ ID NO: 79649 - DNA, 6039 bp, Artificial Sequence
  Description of Artificial Sequence: Synthetic coding sequence
atgtggatcctggccctgagcctgttccagagcttcgccaacgtgttcagcgaggacctgcacagcagcctgtacttcgtgaacgccagcctgcaggaggtggtgttcgccagcaccaccggcaccctggtgccctgccccgccgccggcatcccccccgtgaccctgagatggtacctggccaccggcgaggagatctacgacgtgcccggcatcagacacgtgcaccccaacggcaccctgcagatcttccccttcccccccagcagcttcagcaccctgatccacgacaacacctactactgcaccgccgagaaccccagcggcaagatcagaagccaggacgtgcacatcaaggccgtgctgagagagccctacaccgtgagagtggaggaccagaagaccatgagaggcaacgtggccgtgttcaagtgcatcatccccagcagcgtggaggcctacatcaccgtggtgagctgggagaaggacaccgtgagcctggtgagcggcagcagattcctgatcaccagcaccggcgccctgtacatcaaggacgtgcagaacgaggacggcctgtacaactacagatgcatcaccagacacagatacaccggcgagaccagacagagcaacagcgccagactgttcgtgagcgaccccgccaacagcgcccccagcatcctggacggcttcgaccacagaaaggccatggccggccagagagtggagctgccctgcaaggccctgggccaccccgagcccgactacagatggctgaaggacaacatgcccctggagctgagcggcagattccagaagaccgtgaccggcctgctgatcgagaacatcagacccagcgacagcggcagctacgtgtgcgaggtgagcaacagatacggcaccgccaaggtgatcggcagactgtacgtgaagcagcccctgaaggccaccatcagccccagaaaggtgaagagcagcgtgggcagccaggtgagcctgagctgcagcgtgaccggcaccgaggaccaggagctgagctggtacagaaacggcgagatcctgaaccccggcaagaacgtgagaatcaccggcatcaaccacgagaacctgatcatggaccacatggtgaagagcgacggcggcgcctaccagtgcttcgtgagaaaggacaagctgagcgcccaggactacgtgcaggtggtgctggaggacggcacccccaagatcatcagcgccttcagcgagaaggtggtgagccccgccgagcccgtgagcctgatgtgcaacgtgaagggcacccccctgcccaccatcacctggaccctggacgacgaccccatcctgaagggcggcagccacagaatcagccagatgatcaccagcgagggcaacgtggtgagctacctgaacatcagcagcagccaggtgagagacggcggcgtgtacagatgcaccgccaacaacagcgccggcgtggtgctgtaccaggccagaatcaacgtgagaggccccgccagcatcagacccatgaagaacatcaccgccatcgccggcagagacacctacatccactgcagagtgatcggctacccctactacagcatcaagtggtacaagaacagcaacctgctgcccttcaaccacagacaggtggccttcgagaacaacggcaccctgaagctgagcgacgtgcagaaggaggtggacgagggcgagtacacctgcaacgtgctggtgcagccccagctgagcaccagccagagcgtgcacgtgaccgtgaaggtgccccccttcatccagcccttcgagttccccagattcagcatcggccagagagtgttcatcccctgcgtggtggtgagcggcgacctgcccatcaccatcacctggcagaaggacggcagacccatccccggcagcctgggcgtgaccatcgacaacatcgacttcaccagcagcctgagaatcagcaacctgagcctgatgcacaacggcaactacacctgcatcgccagaaacgaggccgccgccgtggagcaccagagccagctgatcgtgagagtgccccccaagttcgtggtgcagcccagagaccaggacggcatctacggcaaggccgtgatcctgaactgcagcgccgagggctaccccgtgcccaccatcgtgtggaagttcagcaagggcgccggcgtgccccagttccagcccatcgccctgaacggcagaatccaggtgctgagcaacggcagcctgctgatcaagcacgtggtggaggaggacagcggctactacctgtgcaaggtgagcaacgacgtgggcgccgacgtgagcaagagcatgtacctgaccgtgaagatccccgccatgatcaccagctaccccaacaccaccctggccacccagggccagaagaaggagatgagctgcaccgcccacggcgagaagcccatcatcgtgagatgggagaaggaggacagaatcatcaaccccgagatggccagatacctggtgagcaccaaggaggtgggcgaggaggtgatcagcaccctgcagatcctgcccaccgtgagagaggacagcggcttcttcagctgccacgccatcaacagctacggcgaggacagaggcatcatccagctgaccgtgcaggagccccccgacccccccgagatcgagatcaaggacgtgaaggccagaaccatcaccctgagatggaccatgggcttcgacggcaacagccccatcaccggctacgacatcgagtgcaagaacaagagcgacagctgggacagcgcccagagaaccaaggacgtgagcccccagctgaacagcgccaccatcatcgacatccaccccagcagcacctacagcatcagaatgtacgccaagaacagaatcggcaagagcgagcccagcaacgagctgaccatcaccgccgacgaggccgcccccgacggccccccccaggaggtgcacctggagcccatcagcagccagagcatcagagtgacctggaaggcccccaagaagcacctgcagaacggcatcatcagaggctaccagatcggctacagagagtacagcaccggcggcaacttccagttcaacatcatcagcgtggacaccagcggcgacagcgaggtgtacaccctggacaacctgaacaagttcacccagtacggcctggtggtgcaggcctgcaacagagccggcaccggccccagcagccaggagatcatcaccaccaccctggaggacgtgcccagctacccccccgagaacgtgcaggccatcgccaccagccccgagagcatcagcatcagctggagcaccctgagcaaggaggccctgaacggcatcctgcagggcttcagagtgatctactgggccaacctgatggacggcgagctgggcgagatcaagaacatcaccaccacccagcccagcctggagctggacggcctggagaagtacaccaactacagcatccaggtgctggccttcaccagagccggcgacggcgtgagaagcgagcagatcttcaccagaaccaaggaggacgtgcccggcccccccgccggcgtgaaggccgccgccgccagcgccagcatggtgttcgtgagctggctgccccccctgaagctgaacggcatcatcagaaagtacaccgtgttctgcagccacccctaccccaccgtgatcagcgagttcgaggccagccccgacagcttcagctacagaatccccaacctgagcagaaacagacagtacagcgtgtgggtggtggccgtgaccagcgccggcagaggcaacagcagcgagatcatcaccgtggagcccctggccaaggcccccgccagaatcctgaccttcagcggcaccgtgaccaccccctggatgaaggacatcgtgctgccctgcaaggccgtgggcgaccccagccccgccgtgaagtggatgaaggacagcaacggcacccccagcctggtgaccatcgacggcagaagaagcatcttcagcaacggcagcttcatcatcagaaccgtgaaggccgaggacagcggctactacagctgcatcgccaacaacaactggggcagcgacgagatcatcctgaacctgcaggtgcaggtgccccccgaccagcccagactgaccgtgagcaagaccaccagcagcagcatcaccctgagctggctgcccggcgacaacggcggcagcagcatcagaggctacatcctgcagtacagcgaggacaacagcgagcagtggggcagcttccccatcagccccagcgagagaagctacagactggagaacctgaagtgcggcacctggtacaagttcaccctgaccgcccagaacggcgtgggccccggcagaatcagcgagatcatcgaggccaagaccctgggcaaggagccccagttcagcaaggagcaggagctgttcgccagcatcaacaccaccagagtgagactgaacctgatcggctggaacgacggcggctgccccatcaccagcttcaccctggagtacagacccttcggcaccaccgtgtggaccaccgcccagagaaccagcctgagcaagagctacatcctgtacgacctgcaggaggccacctggtacgagctgcagatgagagtgtgcaacagcgccggctgcgccgagaagcaggccaacttcgccaccctgaactacgacggcagcaccatcccccccctgatcaagagcgtggtgcagaacgaggagggcctgaccaccaacgagggcctgaagatgctggtgaccatcagctgcatcctggtgggcgtgctgctgctgttcgtgctgctgctggtggtgagaagaagaagaagagagcagagactgaagagactgagagacgccaagagcctggccgagatgctgatgagcaagaacaccagaaccagcgacaccctgagcaagcagcagcagaccctgagaatgcacatcgacatccccagagcccagctgctgatcgaggagagagacaccatggagaccatcgacgacagaagcaccgtgctgctgaccgacgccgacttcggcgaggccgccaagcagaagagcctgaccgtgacccacaccgtgcactaccagagcgtgagccaggccaccggccccctggtggacgtgagcgacgccagacccggcaccaaccccaccaccagaagaaacgccaaggccggccccaccgccagaaacagatacgccagccagtggaccctgaacagaccccaccccaccatcagcgcccacaccctgaccaccgactggagactgcccacccccagagccgccggcagcgtggacaaggagagcgacagctacagcgtgagccccagccaggacaccgacagagccagaagcagcatggtgagcaccgagagcgccagcagcacctacgaggagctggccagagcctacgagcacgccaagatggaggagcagctgagacacgccaagttcaccatcaccgagtgcttcatcagcgacaccagcagcgagcagctgaccgccggcaccaacgagtacaccgacagcctgaccagcagcacccccagcgagagcggcatctgcagattcaccgccagcccccccaagccccaggacggcggcagagtgatgaacatggccgtgcccaaggcccacagacccggcgacctgatccacctgcccccctacctgagaatggacttcctgctgaacagaggcggccccggcaccagcagagacctgagcctgggccaggcctgcctggagccccagaagagcagaaccctgaagagacccaccgtgctggagcccatccccatggaggccgccagcagcgccagcagcaccagagagggccagagctggcagcccggcgccgtggccaccctgccccagagagagggcgccgagctgggccaggccgccaagatgagcagcagccaggagagcctgctggacagcagaggccacctgaagggcaacaacccctacgccaagagctacaccctggtgtag

SEQ ID NO: 79650 - DNA, 6342 bp, Artificial Sequence
  Description of Artificial Sequence: Synthetic coding sequence
atgaccggcgccggcgagcccagaagagaggagccccccccccagcccagcgccggcctgagaagcagagagagcggcgcccccagcgccggcggctgggagagagccgagagaggcagaggcgccgccgccagacccgccaccggccccccccccagaagaatcggccccctgtacggcatgtggctggtgaccttcctgctgctgctggacagcctgcacaaggccagacccgaggacgtgggcaccagcctgtacttcgtgaacgacagcctgcagcaggtgaccttcagcagcagcgtgggcgtggtggtgccctgccccgccgccggcagccccagcgccgccctgagatggtacctggccaccggcgacgacatctacgacgtgccccacatcagacacgtgcacgccaacggcaccctgcagctgtaccccttcagccccagcgccttcaacagcttcatccacgacaacgactacttctgcaccgccgagaacgccgccggcaagatcagaagccccaacatcagagtgaaggccgtgttcagagagccctacaccgtgagagtggaggaccagagaagcatgagaggcaacgtggccgtgttcaagtgcctgatccccagcagcgtgcaggagtacgtgagcgtggtgagctgggagaaggacaccgtgagcatcatccccgagcacagattcttcatcacctaccacggcggcctgtacatcagcgacgtgcagaaggaggacgccctgagcacctacagatgcatcaccaagcacaagtacagcggcgagaccagacagagcaacggcgccagactgagcgtgaccgaccccgccgagagcatccccaccatcctggacggcttccacagccaggaggtgtgggccggccacaccgtggagctgccctgcaccgccagcggctaccccatccccgccatcagatggctgaaggacggcagacccctgcccgccgacagcagatggaccaagagaatcaccggcctgaccatcagcgacctgagaaccgaggacagcggcacctacatctgcgaggtgaccaacaccttcggcagcgccgaggccaccggcatcctgatggtgatcgaccccctgcacgtgaccctgacccccaagaagctgaagaccggcatcggcagcaccgtgatcctgagctgcgccctgaccggcagccccgagttcaccatcagatggtacagaaacaccgagctggtgctgcccgacgaggccatcagcatcagaggcctgagcaacgagaccctgctgatcaccagcgcccagaagagccacagcggcgcctaccagtgcttcgccaccagaaaggcccagaccgcccaggacttcgccatcatcgccctggaggacggcacccccagaatcgtgagcagcttcagcgagaaggtggtgaaccccggcgagcagttcagcctgatgtgcgccgccaagggcgcccccccccccaccgtgacctgggccctggacgacgagcccatcgtgagagacggcagccacagaaccaaccagtacaccatgagcgacggcaccaccatcagccacatgaacgtgaccggcccccagatcagagacggcggcgtgtacagatgcaccgccagaaacctggtgggcagcgccgagtaccaggccagaatcaacgtgagaggcccccccagcatcagagccatgagaaacatcaccgccgtggccggcagagacaccctgatcaactgcagagtgatcggctacccctactacagcatcaagtggtacaaggacgccctgctgctgcccgacaaccacagacaggtggtgttcgagaacggcaccctgaagctgaccgacgtgcagaagggcatggacgagggcgagtacctgtgcagcgtgctgatccagccccagctgagcatcagccagagcgtgcacgtggccgtgaaggtgccccccctgatccagcccttcgagttcccccccgccagcatcggccagctgctgtacatcccctgcgtggtgagcagcggcgacatgcccatcagaatcacctggagaaaggacggccaggtgatcatcagcggcagcggcgtgaccatcgagagcaaggagttcatgagcagcctgcagatcagcagcgtgagcctgaagcacaacggcaactacacctgcatcgccagcaacgccgccgccaccgtgagcagagagagacagctgatcgtgagagtgccccccagattcgtggtgcagcccaacaaccaggacggcatctacggcaaggccggcgtgctgaactgcagcgtggacggctaccccccccccaaggtgatgtggaagcacgccaagggcagcggcaacccccagcagtaccaccccgtgcccctgaccggcagaatccagatcctgcccaacagcagcctgctgatcagacacgtgctggaggaggacatcggctactacctgtgccaggccagcaacggcgtgggcaccgacatcagcaagagcatgttcctgaccgtgaagatccccgccatgatcaccagccaccccaacaccaccatcgccatcaagggccacgccaaggagctgaactgcaccgccagaggcgagagacccatcatcatcagatgggagaagggcgacaccgtgatcgaccccgacagagtgatgagatacgccatcgccaccaaggacaacggcgacgaggtggtgagcaccctgaagctgaagcccgccgacagaggcgacagcgtgttcttcagctgccacgccatcaacagctacggcgaggacagaggcctgatccagctgaccgtgcaggagccccccgacccccccgagctggagatcagagaggtgaaggccagaagcatgaacctgagatggacccagagattcgacggcaacagcatcatcaccggcttcgacatcgagtacaagaacaagagcgacagctgggacttcaagcagagcaccagaaacatcagccccaccatcaaccaggccaacatcgtggacctgcaccccgccagcgtgtacagcatcagaatgtacagcttcaacaagatcggcagaagcgagcccagcaaggagctgaccatcagcaccgaggaggccgcccccgacggcccccccatggacgtgaccctgcagcccgtgaccagccagagcatccaggtgacctggaaggcccccaagaaggagctgcagaacggcgtgatcagaggctaccagatcggctacagagagaacagccccggcagcaacggccagtacagcatcgtggagatgaaggccaccggcgacagcgaggtgtacaccctggacaacctgaagaagttcgcccagtacggcgtggtggtgcaggccttcaacagagccggcaccggccccagcagcagcgagatcaacgccaccaccctggaggacgtgcccagccagccccccgagaacgtgagagccctgagcatcaccagcgacgtggccgtgatcagctggagcgagccccccagaagcaccctgaacggcgtgctgaagggctacagagtgatcttctggagcctgtacgtggacggcgagtggggcgagatgcagaacatcaccaccaccagagagagagtggagctgagaggcatggagaagttcaccaactacagcgtgcaggtgctggcctacacccaggccggcgacggcgtgagaagcagcgtgctgtacatccagaccaaggaggacgtgcccggcccccccgccggcatcaaggccgtgcccagcagcgccagcagcgtggtggtgagctggctgccccccaccaagcccaacggcgtgatcagaaagtacaccatcttctgcagcagccccggcagcggccagcccgcccccagcgagtacgagaccagccccgagcagctgttctacagaatcgcccacctgaacagaggccagcagtacctgctgtgggtggccgccgtgaccagcgccggcagaggcaacagcagcgagaaggtgaccatcgagcccgccggcaaggcccccgccaagatcatcagcttcggcggcaccgtgaccaccccctggatgaaggacgtgagactgccctgcaacagcgtgggcgaccccgcccccgccgtgaagtggaccaaggacagcgaggacagcgccatccccgtgagcatggacggccacagactgatccacaccaacggcaccctgctgctgagagccgtgaaggccgaggacagcggctactacacctgcaccgccaccaacaccggcggcttcgacaccatcatcgtgaacctgctggtgcaggtgccccccgaccagcccagactgaccgtgagcaagaccagcgccagcagcatcaccctgacctggatccccggcgacaacggcggcagcagcatcagaggcttcgtgctgcagtacagcgtggacaacagcgaggagtggaaggacgtgttcatcagcagcagcgagagaagcttcaagctggacagcctgaagtgcggcacctggtacaaggtgaagctggccgccaagaacagcgtgggcagcggcagaatcagcgagatcatcgaggccaagacccacggcagagagcccagcttcagcaaggaccagcacctgttcacccacatcaacagcacccacgccagactgaacctgcagggctggaacaacggcggctgccccatcaccgccatcgtgctggagtacagacccaagggcacctgggcctggcagggcctgagagccaacagcagcggcgaggtgttcctgaccgagctgagagaggccacctggtacgagctgagaatgagagcctgcaacagcgccggctgcggcaacgagaccgcccagttcgccaccctggactacgacggcagcaccatcccccccatcaagagcgcccagggcgagggcgacgacgtgaagaagctgttcaccatcggctgccccgtgatcctggccaccctgggcgtggccctgctgttcatcgtgagaaagaagagaaaggagaagagactgaagagactgagagacgccaagagcctggccgagatgctgatcagcaagaacaacagaagcttcgacacccccgtgaagggccccccccagggccccagactgcacatcgacatccccagagtgcagctgctgatcgaggacaaggagggcatcaagcagctgggcgacgacaaggccaccatccccgtgaccgacgccgagttcagccaggccgtgaacccccagagcttctgcaccggcgtgagcctgcaccaccccaccctgatccagagcaccggccccctgatcgacatgagcgacatcagacccggcaccaaccccgtgagcagaaagaacgtgaagagcgcccacagcaccagaaacagatacagcagccagtggaccctgaccaagtgccaggccagcacccccgccagaaccctgaccagcgactggagaaccgtgggcagccagcacggcgtgaccgtgaccgagagcgacagctacagcgccagcctgagccaggacaccgacaagggcagaaacagcatggtgagcaccgagagcgccagcagcacctacgaggagctggccagagcctacgagcacgccaagctggaggagcagctgcagcacgccaagttcgagatcaccgagtgcttcatcagcgacagcagcagcgaccagatgaccaccggcaccaacgagaacgccgacagcatgaccagcatgagcacccccagcgagcccggcatctgcagattcaccgccagcccccccaagccccaggacgccgacagaggcaagaacgtggccgtgcccatcccccacagagccaacaagagcgactactgcaacctgcccctgtacgccaagagcgaggccttcttcagaaaggccgacggcagagagccctgccccgtggtgccccccagagaggccagcatcagaaacctggccagaacctaccacacccaggccagacacctgaccctggaccccgccagcaagagcctgggcctgccccaccccggcgcccccgccgccgccagcaccgccaccctgccccagagaaccctggccatgcccgccccccccgccggcaccgccccccccgcccccggccccacccccgccgagccccccaccgcccccagcgccgccccccccgcccccagcaccgagccccccagagccggcggcccccacaccaagatgggcggcagcagagacagcctgctggagatgagcaccagcggcgtgggcagaagccagaagcagggcgccggcgcctacagcaagagctacaccctggtgtag

SEQ ID NO: 79651 - DNA, 5463 bp, Artificial Sequence
  Description of Artificial Sequence: Synthetic coding sequence
atgctgccctactgggccggccacaccgtggagctgccctgcaccgccagcggctaccccatccccgccatcagatggctgaaggacggcagacccctgcccgccgacagcagatggaccaagagaatcaccggcctgaccatcagcgacctgagaaccgaggacagcggcacctacatctgcgaggtgaccaacaccttcggcagcgccgaggccaccggcatcctgatggtgatcgaccccctgcacgtgaccctgacccccaagaagctgaagaccggcatcggcagcaccgtgatcctgagctgcgccctgaccggcagccccgagttcaccatcagatggtacagaaacaccgagctggtgctgcccgacgaggccatcagcatcagaggcctgagcaacgagaccctgctgatcaccagcgcccagaagagccacagcggcgcctaccagtgcttcgccaccagaaaggcccagaccgcccaggacttcgccatcatcgccctggaggacggcacccccagaatcgtgagcagcttcagcgagaaggtggtgaaccccggcgagcagttcagcctgatgtgcgccgccaagggcgcccccccccccaccgtgacctgggccctggacgacgagcccatcgtgagagacggcagccacagaaccaaccagtacaccatgagcgacggcaccaccatcagccacatgaacgtgaccggcccccagatcagagacggcggcgtgtacagatgcaccgccagaaacctggtgggcagcgccgagtaccaggccagaatcaacgtgagaggcccccccagcatcagagccatgagaaacatcaccgccgtggccggcagagacaccctgatcaactgcagagtgatcggctacccctactacagcatcaagtggtacaaggacgccctgctgctgcccgacaaccacagacaggtggtgttcgagaacggcaccctgaagctgaccgacgtgcagaagggcatggacgagggcgagtacctgtgcagcgtgctgatccagccccagctgagcatcagccagagcgtgcacgtggccgtgaaggtgccccccctgatccagcccttcgagttcccccccgccagcatcggccagctgctgtacatcccctgcgtggtgagcagcggcgacatgcccatcagaatcacctggagaaaggacggccaggtgatcatcagcggcagcggcgtgaccatcgagagcaaggagttcatgagcagcctgcagatcagcagcgtgagcctgaagcacaacggcaactacacctgcatcgccagcaacgccgccgccaccgtgagcagagagagacagctgatcgtgagagtgccccccagattcgtggtgcagcccaacaaccaggacggcatctacggcaaggccggcgtgctgaactgcagcgtggacggctaccccccccccaaggtgatgtggaagcacgccaagggcagcggcaacccccagcagtaccaccccgtgcccctgaccggcagaatccagatcctgcccaacagcagcctgctgatcagacacgtgctggaggaggacatcggctactacctgtgccaggccagcaacggcgtgggcaccgacatcagcaagagcatgttcctgaccgtgaagatccccgccatgatcaccagccaccccaacaccaccatcgccatcaagggccacgccaaggagctgaactgcaccgccagaggcgagagacccatcatcatcagatgggagaagggcgacaccgtgatcgaccccgacagagtgatgagatacgccatcgccaccaaggacaacggcgacgaggtggtgagcaccctgaagctgaagcccgccgacagaggcgacagcgtgttcttcagctgccacgccatcaacagctacggcgaggacagaggcctgatccagctgaccgtgcaggagccccccgacccccccgagctggagatcagagaggtgaaggccagaagcatgaacctgagatggacccagagattcgacggcaacagcatcatcaccggcttcgacatcgagtacaagaacaagagcgacagctgggacttcaagcagagcaccagaaacatcagccccaccatcaaccaggccaacatcgtggacctgcaccccgccagcgtgtacagcatcagaatgtacagcttcaacaagatcggcagaagcgagcccagcaaggagctgaccatcagcaccgaggaggccgcccccgacggcccccccatggacgtgaccctgcagcccgtgaccagccagagcatccaggtgacctggaaggcccccaagaaggagctgcagaacggcgtgatcagaggctaccagatcggctacagagagaacagccccggcagcaacggccagtacagcatcgtggagatgaaggccaccggcgacagcgaggtgtacaccctggacaacctgaagaagttcgcccagtacggcgtggtggtgcaggccttcaacagagccggcaccggccccagcagcagcgagatcaacgccaccaccctggaggacgtgcccagccagccccccgagaacgtgagagccctgagcatcaccagcgacgtggccgtgatcagctggagcgagccccccagaagcaccctgaacggcgtgctgaagggctacagagtgatcttctggagcctgtacgtggacggcgagtggggcgagatgcagaacatcaccaccaccagagagagagtggagctgagaggcatggagaagttcaccaactacagcgtgcaggtgctggcctacacccaggccggcgacggcgtgagaagcagcgtgctgtacatccagaccaaggaggacgtgcccggcccccccgccggcatcaaggccgtgcccagcagcgccagcagcgtggtggtgagctggctgccccccaccaagcccaacggcgtgatcagaaagtacaccatcttctgcagcagccccggcagcggccagcccgcccccagcgagtacgagaccagccccgagcagctgttctacagaatcgcccacctgaacagaggccagcagtacctgctgtgggtggccgccgtgaccagcgccggcagaggcaacagcagcgagaaggtgaccatcgagcccgccggcaaggcccccgccaagatcatcagcttcggcggcaccgtgaccaccccctggatgaaggacgtgagactgccctgcaacagcgtgggcgaccccgcccccgccgtgaagtggaccaaggacagcgaggacagcgccatccccgtgagcatggacggccacagactgatccacaccaacggcaccctgctgctgagagccgtgaaggccgaggacagcggctactacacctgcaccgccaccaacaccggcggcttcgacaccatcatcgtgaacctgctggtgcaggtgccccccgaccagcccagactgaccgtgagcaagaccagcgccagcagcatcaccctgacctggatccccggcgacaacggcggcagcagcatcagaggcttcgtgctgcagtacagcgtggacaacagcgaggagtggaaggacgtgttcatcagcagcagcgagagaagcttcaagctggacagcctgaagtgcggcacctggtacaaggtgaagctggccgccaagaacagcgtgggcagcggcagaatcagcgagatcatcgaggccaagacccacggcagagagcccagcttcagcaaggaccagcacctgttcacccacatcaacagcacccacgccagactgaacctgcagggctggaacaacggcggctgccccatcaccgccatcgtgctggagtacagacccaagggcacctgggcctggcagggcctgagagccaacagcagcggcgaggtgttcctgaccgagctgagagaggccacctggtacgagctgagaatgagagcctgcaacagcgccggctgcggcaacgagaccgcccagttcgccaccctggactacgacggcagcaccatcccccccatcaagagcgcccagggcgagggcgacgacgtgaagaagctgttcaccatcggctgccccgtgatcctggccaccctgggcgtggccctgctgttcatcgtgagaaagaagagaaaggagaagagactgaagagactgagagacgccaagagcctggccgagatgctgatcagcaagaacaacagaagcttcgacacccccgtgaagggccccccccagggccccagactgcacatcgacatccccagagtgcagctgctgatcgaggacaaggagggcatcaagcagctgggcgacgacaaggccaccatccccgtgaccgacgccgagttcagccaggccgtgaacccccagagcttctgcaccggcgtgagcctgcaccaccccaccctgatccagagcaccggccccctgatcgacatgagcgacatcagacccggcaccaaccccgtgagcagaaagaacgtgaagagcgcccacagcaccagaaacagatacagcagccagtggaccctgaccaagtgccaggccagcacccccgccagaaccctgaccagcgactggagaaccgtgggcagccagcacggcgtgaccgtgaccgagagcgacagctacagcgccagcctgagccaggacaccgacaagggcagaaacagcatggtgagcaccgagagcgccagcagcacctacgaggagctggccagagcctacgagcacgccaagctggaggagcagctgcagcacgccaagttcgagatcaccgagtgcttcatcagcgacagcagcagcgaccagatgaccaccggcaccaacgagaacgccgacagcatgaccagcatgagcacccccagcgagcccggcatctgcagattcaccgccagcccccccaagccccaggacgccgacagaggcaagaacgtggccgtgcccatcccccacagagccaacaagagcgactactgcaacctgcccctgtacgccaagagcgaggccttcttcagaaaggccgacggcagagagccctgccccgtggtgccccccagagaggccagcatcagaaacctggccagaacctaccacacccaggccagacacctgaccctggaccccgccagcaagagcctgggcctgccccaccccggcgcccccgccgccgccagcaccgccaccctgccccagagaaccctggccatgcccgccccccccgccggcaccgccccccccgcccccggccccacccccgccgagccccccaccgcccccagcgccgccccccccgcccccagcaccgagccccccagagccggcggcccccacaccaagatgggcggcagcagagacagcctgctggagatgagcaccagcggcgtgggcagaagccagaagcagggcgccggcgcctacagcaagagctacaccctggtgtag

SEQ ID NO: 79652 - DNA, 762 bp, Artificial Sequence
  Description of Artificial Sequence: Synthetic coding sequence
atggagggcaccgtgaacctgcagctgagcgccaagagcgtgggcgtgttcgaggccttctacaacagcgtgaagcccatccagatcatcaacagcaccatcgagatggtgaagcccggcaagttccccagcggcaagaccgagatccccttcgagttccccctgcacctgaagggcaacaaggtgctgtacgagacctaccacggcgtgttcgtgaacatccagtacaccctgagatgcgacatgaagagaagcctgctggccaaggacctgaccaagacctgcgagttcatcgtgcacagcgccccccagaagggcaagttcacccccagccccgtggacttcaccatcacccccgagaccctgcagaacgtgaaggagagagccctgctgcccaagttcctgctgagaaccagccagctgaacaagctgtgccaccacgccgccaccaacggcagagccggcggcggcgagctgggcagcagacaccagaagagaggcgccgccgccggcgccagaggcgacgtgagagtgtgcagatacgccagagacgccaccgagatccagaacatccagatcgccgacggcgacgtgtgcagaggcctgagcgtgcccatctacatggtgttccccagactgttcacctgccccaccctggagaccaccaacttcaaggtggagttcgaggtgaacatcgtggtgctgctgcaccccgaccacctgatcaccgagaacttccccctgaagctgtgcagaatctag

SEQ ID NO: 79653 - DNA, 894 bp, Artificial Sequence
  Description of Artificial Sequence: Synthetic coding sequence
atgggcaccgccctggacatcaagatcaagagagccaacaaggtgtaccacgccggcgaggtgctgagcggcgtggtggtgatcagcagcaaggacagcgtgcagcaccagggcgtgagcctgaccatggagggcaccgtgaacctgcagctgagcgccaagagcgtgggcgtgttcgaggccttctacaacagcgtgaagcccatccagatcatcaacagcaccatcgagatggtgaagcccggcaagttccccagcggcaagaccgagatccccttcgagttccccctgcacctgaagggcaacaaggtgctgtacgagacctaccacggcgtgttcgtgaacatccagtacaccctgagatgcgacatgaagagaagcctgctggccaaggacctgaccaagacctgcgagttcatcgtgcacagcgccccccagaagggcaagttcacccccagccccgtggacttcaccatcacccccgagaccctgcagaacgtgaaggagagagccctgctgcccaagttcctgctgagaggccacctgaacagcaccaactgcgtgatcacccagcccctgaccggcgagctggtggtggagagcagcgaggccgccatcagaagcgtggagctgcagctggtgagagtggagacctgcggctgcgccgagggctacgccagagacgccaccgagatccagaacatccagatcgccgacggcgacgtgtgcagaggcctgagcgtgcccatctacatggtgttccccagactgttcacctgccccaccctggagaccaccaacttcaaggtggagttcgaggtgaacatcgtggtgctgctgcaccccgaccacctgatcaccgagaacttccccctgaagctgtgcagaatctag

SEQ ID NO: 79654 - DNA, 519 bp, Artificial Sequence
  Description of Artificial Sequence: Synthetic coding sequence
atgggcaccgccctggacatcaagatcaagagagccaacaaggtgtaccacgccggcccccagaagggcaagttcacccccagccccgtggacttcaccatcacccccgagaccctgcagaacgtgaaggagagagccctgctgcccaagttcctgctgagaggccacctgaacagcaccaactgcgtgatcacccagcccctgaccggcgagctggtggtggagagcagcgaggccgccatcagaagcgtggagctgcagctggtgagagtggagacctgcggctgcgccgagggctacgccagagacgccaccgagatccagaacatccagatcgccgacggcgacgtgtgcagaggcctgagcgtgcccatctacatggtgttccccagactgttcacctgccccaccctggagaccaccaacttcaaggtggagttcgaggtgaacatcgtggtgctgctgcaccccgaccacctgatcaccgagaacttccccctgaagctgtgcagaatctag

SEQ ID NO: 79655 - DNA, 813 bp, Artificial Sequence
  Description of Artificial Sequence: Synthetic coding sequence
atgggcaccgccctggacatcaagatcaagagagccaacaaggtgtaccacgccggcgaggtgctgagcggcgtggtggtgatcagcagcaaggacagcgtgcagcaccagggcgtgagcctgaccatggagggcaccgtgaacctgcagctgagcgccaagagcgtgggcgtgttcgaggccttctacaacagcgtgaagcccatccagatcatcaacagcaccatcgagatggtgaagcccggcaagttccccagcggcaagaccgagatccccttcgagttccccctgcacctgaagggcaacaaggtgctgtacgagacctaccacggcgtgttcgtgaacatccagccccagaagggcaagttcacccccagccccgtggacttcaccatcacccccgagaccctgcagaacgtgaaggagagagccctgctgcccaagttcctgctgagaggccacctgaacagcaccaactgcgtgatcacccagcccctgaccggcgagctggtggtggagagcagcgaggccgccatcagaagcgtggagctgcagctggtgagagtggagacctgcggctgcgccgagggctacgccagagacgccaccgagatccagaacatccagatcgccgacggcgacgtgtgcagaggcctgagcgtgcccatctacatggtgttccccagactgttcacctgccccaccctggagaccaccaacttcaaggtggagttcgaggtgaacatcgtggtgctgctgcaccccgaccacctgatcaccgagaacttccccctgaagctgtgcagaatctag

SEQ ID NO: 79656 - DNA, 663 bp, Artificial Sequence
  Description of Artificial Sequence: Synthetic coding sequence
atgggcaccgccctggacatcaagatcaagagagccaacaaggtgtaccacgccggcgaggtgctgagcggcgtggtggtgatcagcagcaaggacagcgtgcagcaccagggcgtgagcctgaccatggagggcaccgtgaacctgcagctgagcgccaagagcgtgggcgtgttcgaggccttctacaacagcgtgaagccccagaagggcaagttcacccccagccccgtggacttcaccatcacccccgagaccctgcagaacgtgaaggagagagccctgctgcccaagttcctgctgagaggccacctgaacagcaccaactgcgtgatcacccagcccctgaccggcgagctggtggtggagagcagcgaggccgccatcagaagcgtggagctgcagctggtgagagtggagacctgcggctgcgccgagggctacgccagagacgccaccgagatccagaacatccagatcgccgacggcgacgtgtgcagaggcctgagcgtgcccatctacatggtgttccccagactgttcacctgccccaccctggagaccaccaacttcaaggtggagttcgaggtgaacatcgtggtgctgctgcaccccgaccacctgatcaccgagaacttccccctgaagctgtgcagaatctag

SEQ ID NO: 79657 - DNA, 357 bp, Artificial Sequence
  Description of Artificial Sequence: Synthetic coding sequence
atgagcctgatcatcctgaccagagacgacgagcccagaatcttcacccccgacagcgacgccgccagccccgccctgcacagcaccagccccctgcccgaccccgccagcgccagccccctgcacagagaggagaagatcctgcccaaggtgtgcaacatcgtgagctgcctgagcttcagcctgcccgccagccccaccgacagcggcctggccagccccaccatcatcaccagagagggccagcagttctgggccaagtgcctgatctggaagtaccagctgtacctgcacggcctgcacaagaagagcgacggcagaagagacaagcagatcagcgccagccccagcacctag

SEQ ID NO: 79658 - DNA, 573 bp, Artificial Sequence
  Description of Artificial Sequence: Synthetic coding sequence
atggagcccgaggccgccgccggcgccagaaaggccagaggcagaggctgccactgccccggcgacgccccctggagaccccccccccccagaggccccgagagccccgccccctggagaccctggatccagacccccggcgacgccgagctgaccagaaccggcagacccctggagcccagagccgaccagcacaccttcggcagcaagggcgccttcggcttccagcaccccgtgagagtgtacctgcccatgagcaagagacaggagtacctgagaagcagcggcgagcaggtgctggccagcttccccgtgcaggccaccatcgacttctacgacgacgagagcaccgagagcgccagcgaggccgaggagcccgaggagggccccccccccctgcacctgctgccccaggaggtgggcggcagacaggagaacggccccggcggcaagggcagagaccagggcatcaaccagggccagagaagcagcggcggcggcgaccactggggcgagggccccctgccccagggcgtgagcagcagaggcggcaagtgcagcagcagcaagtag

SEQ ID NO: 79659 - DNA, 294 bp, Artificial Sequence
  Description of Artificial Sequence: Synthetic coding sequence
atgaaggagcccggccccaacttcgtgaccgtgagaaagggcctgcacagcttcaagatggccttcgtgaagcacctgctgctgttcctgagccccagactggagtgcagcggcagcatcaccgaccactgcagcctgcacctgcccgtgcaggagatcctgatgagccagccccccgagcagctgggcctgcagaccaacctgggcaaccaggagagcagcggcatgatgaagctgttcatgcccagacccaaggtgctggcccagtacgagagcatccagttcatgccctag

SEQ ID NO: 79660 - DNA, 276 bp, Artificial Sequence
  Description of Artificial Sequence: Synthetic coding sequence
atgaaggagcccggccccaacttcgtgaccgtgagaaagggcctgcacagcttcaagatggccttcgtgaagcacctgctgctggagtgcagcggcagcatcaccgaccactgcagcctgcacctgcccgtgcaggagatcctgatgagccagccccccgagcagctgggcctgcagaccaacctgggcaaccaggagagcagcggcatgatgaagctgttcatgcccagacccaaggtgctggcccagtacgagagcatccagttcatgccctag

SEQ ID NO: 79661 - DNA, 531 bp, Artificial Sequence
  Description of Artificial Sequence: Synthetic coding sequence
atggccagcagcagcggcaacgacgacgacctgaccatccccagagccgccatcaacaagatgatcaaggagaccctgcccaacgtgagagtggccaacgacgccagagagctggtggtgaactgctgcaccgagttcatccacctgatcagcagcgaggccaacgagatctgcaacaagagcgagaagaagaccatcagccccgagcacgtgatccaggccctggagagcctgggcttcggcagctacatcagcgaggtgaaggaggtgctgcaggagtgcaagaccgtggccctgaagagaagaaaggccagcagcagactggagaacctgggcatccccgaggaggagctgctgagacagcagcaggagctgttcgccaaggccagacagcagcaggccgagctggcccagcaggagtggctgcagatgcagcaggccgcccagcaggcccagctggccgccgccagcgccagcgccagcaaccaggccggcagcagccaggacgaggaggacgacgacgacatctag

SEQ ID NO: 79662 - DNA, 531 bp, Artificial Sequence; identical to SEQ ID NO: 79661
  Description of Artificial Sequence: Synthetic coding sequence

SEQ ID NO: 79663 - DNA, 1470 bp, Artificial Sequence
  Description of Artificial Sequence: Synthetic coding sequence
atggagagcatgttcagcagccccgccgaggccgccctgcagagagagaccggcgtgcccggcctgctgacccccctgcccgacctggacggcgtgtacgagctggagagagtggccggcttcgtgagagacctgggctgcgagagagtggccctgcagttccccgaccagctgctgggcgacgccgtggccgtggccgccagactggaggagaccaccggcagcaagatgttcatcctgggcgacaccgcctacggcagctgctgcgtggacgtgctgggcgccgagcaggccggcgcccaggccctgatccacttcggccccgcctgcctgagcccccccgccagacccctgcccgtggccttcgtgctgagacagagaagcgtggccctggagctgtgcgtgaaggccttcgaggcccagaaccccgaccccaaggcccccgtggtgctgctgagcgagcccgcctgcgcccacgccctggaggccctggccaccctgctgagacccagatacctggacctgctggtgagcagccccgccttcccccagcccgtgggcagcctgagccccgagcccatgcccctggagagattcggcagaagattccccctggcccccggcagaagactggaggagtacggcgccttctacgtgggcggcagcaaggccagccccgaccccgacctggaccccgacctgagcagactgctgctgggctgggcccccggccagcccttcagcagctgctgccccgacaccggcaagacccaggacgagggcgccagagccggcagactgagagccagaagaagatacctggtggagagagccagagacgccagagtggtgggcctgctggccggcaccctgggcgtggcccagcacagagaggccctggcccacctgagaaacctgacccaggccgccggcaagagaagctacgtgctggccctgggcagacccacccccgccaagctggccaacttccccgaggtggacgtgttcgtgctgctggcctgccccctgggcgccctggccccccagctgagcggcagcttcttccagcccatcctggccccctgcgagctggaggccgcctgcaaccccgcctggcccccccccggcctggccccccacctgacccactacgccgacctgctgcccggcagccccttccacgtggccctgcccccccccgagagcgagctgtgggagacccccgacgtgagcctgatcaccggcgacctgagacccccccccgcctggaagagcagcaacgaccacggcagcctggccctgacccccagaccccagctggagctggccgagagcagccccgccgccagcttcctgagcagcagaagctggcagggcctggagcccagactgggccagacccccgtgaccgaggccgtgagcggcagaagaggcatcgccatcgcctacgaggacgagggcagcggctag

SEQ ID NO: 79664 - DNA, 786 bp, Artificial Sequence
  Description of Artificial Sequence: Synthetic coding sequence
atggagagcatgttcagcagccccgccgaggccgccctgcagagagagaccggcgtgcccggcctgctgacccccctgcccgacctggacggcgtgtacgagctggagagagtggccggcttcgtgagagacctgggctgcgagagagtggccctgcagttccccgaccagctgctgggcgacgccgtggccgtggccgccagactggaggagaccaccggcagcaagatgttcatcctgggcgacaccgcctacggcagctgctgcgtggacgtgctgggcgccgagcaggccggcgcccaggccctgatccacttcggccccgcctgcctgagcccccccgccagacccctgcccgtggccttcgtgctgagacagagaagcgtggccctggagctgtgcgtgaaggccttcgaggcccagaaccccgaccccaaggcccccgtggtgctgctgagcgagcccgcctgcgcccacgccctgggcagccccttccacgtggccctgcccccccccgagagcgagctgtgggagacccccgacgtgagcctgatcaccggcgacctgagacccccccccgcctggaagagcagcaacgaccacggcagcctggccctgacccccagaccccagctggagctggccgagagcagccccgccgccagcttcctgagcagcagaagctggcagggcctggagcccagactgggccagacccccgtgaccgaggccgtgagcggcagaagaggcatcgccatcgcctacgaggacgagggcagcggctag

SEQ ID NO: 79665 - DNA, 1065 bp, Artificial Sequence
  Description of Artificial Sequence: Synthetic coding sequence
atgctgtggctgtggctgcacgactggagaagaagacagggccagagatgcagcttctgggtgacccagcccaccgccgaggccctggccaccctgctgagacccagatacctggacctgctggtgagcagccccgccttcccccagcccgtgggcagcctgagccccgagcccatgcccctggagagattcggcagaagattccccctggcccccggcagaagactggaggagtacggcgccttctacgtgggcggcagcaaggccagccccgaccccgacctggaccccgacctgagcagactgctgctgggctgggcccccggccagcccttcagcagctgctgccccgacaccggcaagacccaggacgagggcgccagagccggcagactgagagccagaagaagatacctggtggagagagccagagacgccagagtggtgggcctgctggccggcaccctgggcgtggcccagcacagagaggccctggcccacctgagaaacctgacccaggccgccggcaagagaagctacgtgctggccctgggcagacccacccccgccaagctggccaacttccccgaggtggacgtgttcgtgctgctggcctgccccctgggcgccctggccccccagctgagcggcagcttcttccagcccatcctggccccctgcgagctggaggccgcctgcaaccccgcctggcccccccccggcctggccccccacctgacccactacgccgacctgctgcccggcagccccttccacgtggccctgcccccccccgagagcgagctgtgggagacccccgacgtgagcctgatcaccggcgacctgagacccccccccgcctggaagagcagcaacgaccacggcagcctggccctgacccccagaccccagctggagctggccgagagcagccccgccgccagcttcctgagcagcagaagctggcagggcctggagcccagactgggccagacccccgtgaccgaggccgtgagcggcagaagaggcatcgccatcgcctacgaggacgagggcagcggctag

SEQ ID NO: 79666 - DNA, 174 bp, Artificial Sequence
  Description of Artificial Sequence: Synthetic coding sequence
atggccgtgttccacgacgaggtggagatcgaggacttccagtacgacgaggacagcgagacctacttctacccctgcccctgcggcgacaacttcagcatcaccaaggaccagttcgtgtgcggcgagaccgtgcccgcccccagcgccaacaaggagctggtgaagtgctag

SEQ ID NO: 79667 - DNA, 249 bp, Artificial Sequence
  Description of Artificial Sequence: Synthetic coding sequence
atggccgtgttccacgacgaggtggagatcgaggacttccagtacgacgaggacagcgagacctacttctacccctgcccctgcggcgacaacttcagcatcaccaaggaggacctggagaacggcgaggacgtggccacctgccccagctgcagcctgatcatcaaggtgatctacgacaaggaccagttcgtgtgcggcgagaccgtgcccgcccccagcgccaacaaggagctggtgaagtgctag

SEQ ID NO: 79668 - DNA, 855 bp, Artificial Sequence
  Description of Artificial Sequence: Synthetic coding sequence
atgctgtacctgatcggcctgggcctgggcgacgccaaggacatcaccgtgaagggcctggaggtggtgagaagatgcagcagagtgtacctggaggcctacaccagcgtgctgaccgtgggcaaggaggccctggaggagttctacggcagaaagctggtggtggccgacagagaggaggtggagcaggaggccgacaacatcctgaaggacgccgacatcagcgacgtggccttcctggtggtgggcgaccccttcggcgccaccacccacagcgacctggtgctgagagccaccaagctgggcatcccctacagagtgatccacaacgccagcatcatgaacgccgtgggctgctgcggcctgcagctgtacaagttcggcgagaccgtgagcatcgtgttctggaccgacacctggagacccgagagcttcttcgacaaggtgaagaagaacagacagaacggcatgcacaccctgtgcctgctggacatcaaggtgaaggagcagagcctggagaacctgatcaagggcagaaagatctacgagccccccagatacatgagcgtgaaccaggccgcccagcagctgctggagatcgtgcagaaccagagaatcagaggcgaggagcccgtgaccgaggagaccctgtgcgtgggcctggccagagtgggcgccgacgaccagaagatcgccgccggcaccctgagacagatgtgcaccgtggacctgggcgagcccctgcacagcctgatcatcaccggcggcagcatccaccccatggagatggagatgctgagcctgttcagcatccccgagaacagcagcgagagccagagcatcaacggcctgtag

SEQ ID NO: 79669 - DNA, 858 bp, Artificial Sequence
  Description of Artificial Sequence: Synthetic coding sequence
atgctgtacctgatcggcctgggcctgggcgacgccaaggacatcaccgtgaagggcctggaggtggtgagaagatgcagcagagtgtacctggaggcctacaccagcgtgctgaccgtgggcaaggaggccctggaggagttctacggcagaaagctggtggtggccgacagagaggaggtggagcaggaggccgacaacatcctgaaggacgccgacatcagcgacgtggccttcctggtggtgggcgaccccttcggcgccaccacccacagcgacctggtgctgagagccaccaagctgggcatcccctacagagtgatccacaacgccagcatcatgaacgccgtgggctgctgcggcctgcagctgtacaagttcggcgagaccgtgagcatcgtgttctggaccgacacctggagacccgagagcttcttcgacaaggtgaagaagaacagacagaacggcatgcacaccctgtgcctgctggacatcaaggtgaaggagcagagcctggagaacctgatcaagggcagaaagatctacgagccccccagatacatgagcgtgaaccaggccgcccagcagctgctggagatcgtgcagaaccagagaatcagaggcgaggagcccgccgtgaccgaggagaccctgtgcgtgggcctggccagagtgggcgccgacgaccagaagatcgccgccggcaccctgagacagatgtgcaccgtggacctgggcgagcccctgcacagcctgatcatcaccggcggcagcatccaccccatggagatggagatgctgagcctgttcagcatccccgagaacagcagcgagagccagagcatcaacggcctgtag

SEQ ID NO: 79670 - DNA, 705 bp, Artificial Sequence
  Description of Artificial Sequence: Synthetic coding sequence
atgctgtacctgatcggcctgggcctgggcgacgccaaggacatcaccgtgaagggcctggaggtggtgagaagatgcagcagagtgtacctggaggcctacaccagcgtgctgaccgtgggcaaggaggccctggaggagttctacggcagaaagctggtggtggccgacagagaggaggtggagcaggaggccgacaacatcctgaaggacgccgacatcagcgacgtggccttcctggtggtgggcgaccccaccgacacctggagacccgagagcttcttcgacaaggtgaagaagaacagacagaacggcatgcacaccctgtgcctgctggacatcaaggtgaaggagcagagcctggagaacctgatcaagggcagaaagatctacgagccccccagatacatgagcgtgaaccaggccgcccagcagctgctggagatcgtgcagaaccagagaatcagaggcgaggagcccgccgtgaccgaggagaccctgtgcgtgggcctggccagagtgggcgccgacgaccagaagatcgccgccggcaccctgagacagatgtgcaccgtggacctgggcgagcccctgcacagcctgatcatcaccggcggcagcatccaccccatggagatggagatgctgagcctgttcagcatccccgagaacagcagcgagagccagagcatcaacggcctgtag

SEQ ID NO: 79671 - DNA, 141 bp, Artificial Sequence
  Description of Artificial Sequence: Synthetic coding sequence
atgtgcaccgtggacctgggcgagcccctgcacagcctgatcatcaccggcggcagcatccaccccatggagatggagatgctgagcctgttcagcatccccgagaacagcagcgagagccagagcatcaacggcctgtag

SEQ ID NO: 79672 - DNA, 855 bp, Artificial Sequence
  Description of Artificial Sequence: Synthetic coding sequence
atgctgtacctgatcggcctgggcctgggcgacgccaaggacatcaccgtgaagggcctggaggtggtgagaagatgcagcagagtgtacctggaggcctacaccagcgtgctgaccgtgggcaaggaggccctggaggagttctacggcagaaagctggtggtggccgacagagaggaggtggagcaggaggccgacaacatcctgaaggacgccgacatcagcgacgtggccttcctggtggtgggcgaccccttcggcgccaccacccacagcgacctggtgctgagagccaccaagctgggcatcccctacagagtgatccacaacgccagcatcatgaacgccgtgggctgctgcggcctgcagtacatcagcctggagagacagttcctgctgttcttcggccagaccctgggccccgagagcttcttcgacaaggtgaagaagaacagacagaacggcatgcacaccctgtgcctgctggacatcaaggtgaaggagcagagcctggagaacctgatcaagggcagaaagatctacgagccccccagatacatgagcgtgaaccaggccgcccagcagctgctggagatcgtgcagaaccagagaatcagaggcgaggagcccgccgtgaccgaggagaccctgtgcgtgggcctggccagagtgggcgccgacgaccagaagatcgccgccggcaccctgagacagatgtgcaccgtggacctgggcgagcccctgcacagcctgatcatcaccggcggcagcatccaccccatggagatggagatgctgagcctgttcagcatccccgagaacagcagcgagagccagagcatcaacggcctgtag

SEQ ID NO: 79673 - DNA, 858 bp, Artificial Sequence; identical to SEQ ID NO: 79669
  Description of Artificial Sequence: Synthetic coding sequence

SEQ ID NO: 79674 - DNA, 2028 bp, Artificial Sequence
  Description of Artificial Sequence: Synthetic coding sequence
atggagggcagacccccccccgagggcagacccccccccagacccagaaccggcagagcccccagaggcagaagaagagccgtgttcgccgccgtgctgcactggagccacatcacccacctgttcgagaacgacagacacttcagccacctgagcaccctggagagagagatggccttcagaaccgagatgggcctgtactacagctacttcaagaccatcgtggaggcccccagcttcctgaacggcgtgtggatgatcatgaacgacaagctgaccgagtaccccctggtgatcaacaccctgaagagattcaacctgtaccccgaggtgatcctggccagctggtacagaatctacaccaagatcatggacctgatcggcatccagaccaagatctgctggaccgtgaccagaggcgagggcctgagccccatcgagagctgcgagggcctgggcgaccccgcctgcttctacgtggccgtgatcttcatcctgaacggcctgatgatggccctgttcttcatctacggcacctacctgagcggcagcagactgggcggcctggtgaccgtgctgtgcttcttcttcaaccacggcgagtgcaccagagtgatgtggaccccccccctgagagagagcttcagctaccccttcctggtgctgcagatgctgctggtgacccacatcctgagagccaccaagctgtacagaggcagcctgatcgccctgtgcatcagcaacgtgttcttcatgctgccctggcagttcgcccagttcgtgctgctgacccagatcgccagcctgttcgccgtgtacgtggtgggctacatcgacatctgcaagctgagaaagatcatctacatccacatgatcagcctggccctgtgcttcgtgctgatgttcggcaacagcatgctgctgaccagctactacgccagcagcctggtgatcatctggggcatcctggccatgaagccccacttcctgaagatcaacgtgagcgagctgagcctgtgggtgatccagggctgcttctggctgttcggcaccgtgatcctgaagtacctgaccagcaagatcttcggcatcgccgacgacgcccacatcggcaacctgctgaccagcaagttcttcagctacaaggacttcgacaccctgctgtacacctgcgccgccgagttcgacttcatggagaaggagacccccctgagatacaccaagaccctgctgctgcccgtggtgctggtggtgttcgtggccatcgtgagaaagatcatcagcgacatgtggggcgtgctggccaagcagcagacccacgtgagaaagcaccagttcgaccacggcgagctggtgtaccacgccctgcagctgctggcctacaccgccctgggcatcctgatcatgagactgaagctgttcctgaccccccacatgtgcgtgatggccagcctgatctgcagcagacagctgttcggctggctgttctgcaaggtgcaccccggcgccatcgtgttcgccatcctggccgccatgagcatccagggcagcgccaacctgcagacccagtggaacatcgtgggcgagttcagcaacctgccccaggaggagctgatcgagtggatcaagtacagcaccaagcccgacgccgtgttcgccggcgccatgcccaccatggccagcgtgaagctgagcgccctgagacccatcgtgaaccacccccactacgaggacgccggcctgagagccagaaccaagatcgtgtacagcatgtacagcagaaaggccgccgaggaggtgaagagagagctgatcaagctgaaggtgaactactacatcctggaggagagctggtgcgtgagaagaagcaagcccggctgcagcatgcccgagatctgggacgtggaggaccccgccaacgccggcaagacccccctgtgcaacctgctggtgaaggacagcaagccccacttcaccaccgtgttccagaacagcgtgtacaaggtgctggaggtggtgaaggagtag

SEQ ID NO: 79675 - DNA, 258 bp, Artificial Sequence
  Description of Artificial Sequence: Synthetic coding sequence
atgtacagcagaaaggccgccgaggaggtgaagagagagctgatcaagctgaaggtgaactactacatcctggaggagagctggtgcgtgagaagaagcaagcccggctgcagcatgcccgagatctgggacgtggaggaccccgccaacgccggcaagacccccctgtgcaacctgctggtgaaggacagcaagccccacttcaccaccgtgttccagaacagcgtgtacaaggtgctggaggtggtgaaggagtag

SEQ ID NO: 79676 - DNA, 2277 bp, Artificial Sequence
  Description of Artificial Sequence: Synthetic coding sequence
atgagaaagcagggcgtgagcagcaagagactgcagagcagcggcagaagccagagcaagggcagaagaggcgccagcctggccagagagcccgaggtggaggaggagatggagaagagcgccctgggcggcggcaagctgcccagaggcagctggagaagcagccccggcagaatccagagcctgaaggagagaaagggcctggagctggaggtggtggccaagaccttcctgctgggccccttccagttcgtgagaaacagcctggcccagctgagagagaaggtgcaggagctgcaggccagaagattcagcagcagaaccaccctgggcatcgccgtgttcgtggccatcctgcactggctgcacctggtgaccctgttcgagaacgacagacacttcagccacctgagcagcctggagagagagatgaccttcagaaccgagatgggcctgtactacagctacttcaagaccatcatcgaggcccccagcttcctggagggcctgtggatgatcatgaacgacagactgaccgagtaccccctgatcatcaacgccatcaagagattccacctgtaccccgaggtgatcatcgccagctggtactgcaccttcatgggcatcatgaacctgttcggcctggagaccaagacctgctggaacgtgaccagaatcgagcccctgaacgaggtgcagagctgcgagggcctgggcgaccccgcctgcttctacgtgggcgtgatcttcatcctgaacggcctgatgatgggcctgttcttcatgtacggcgcctacctgagcggcacccagctgggcggcctgatcaccgtgctgtgcttcttcttcaaccacggcgaggccaccagagtgatgtggaccccccccctgagagagagcttcagctaccccttcctggtgctgcagatgtgcatcctgaccctgatcctgagaaccagcagcaacgacagaagacccttcatcgccctgtgcctgagcaacgtggccttcatgctgccctggcagttcgcccagttcatcctgttcacccagatcgccagcctgttccccatgtacgtggtgggctacatcgagcccagcaagttccagaagatcatctacatgaacatgatcagcgtgaccctgagcttcatcctgatgttcggcaacagcatgtacctgagcagctactacagcagcagcctgctgatgacctgggccatcatcctgaagagaaacgagatccagaagctgggcgtgagcaagctgaacttctggctgatccagggcagcgcctggtggtgcggcaccatcatcctgaagttcctgaccagcaagatcctgggcgtgagcgaccacatcagactgagcgacctgatcgccgccagaatcctgagatacaccgacttcgacaccctgatctacacctgcgcccccgagttcgacttcatggagaaggccacccccctgagatacaccaagaccctgctgctgcccgtggtgatggtgatcacctgcttcatcttcaagaagaccgtgagagacatcagctacgtgctggccaccaacatctacctgagaaagcagctgctggagcacagcgagctggccttccacaccctgcagctgctggtgttcaccgccctggccatcctgatcatgagactgaagatgttcctgaccccccacatgtgcgtgatggccagcctgatctgcagcagacagctgttcggctggctgttcagaagagtgagattcgagaaggtgatcttcggcatcctgaccgtgatgagcatccagggctacgccaacctgagaaaccagtggagcatcatcggcgagttcaacaacctgccccaggaggagctgctgcagtggatcaagtacagcaccaccagcgacgccgtgttcgccggcgccatgcccaccatggccagcatcaagctgagcaccctgcaccccatcgtgaaccacccccactacgaggacgccgacctgagagccagaaccaagatcgtgtacagcacctacagcagaaagagcgccaaggaggtgagagacaagctgctggagctgcacgtgaactactacgtgctggaggaggcctggtgcgtggtgagaaccaagcccggctgcagcatgctggagatctgggacgtggaggaccccagcaacgccgccaacccccccctgtgcagcgtgctgctggaggacgccagaccctacttcaccaccgtgttccagaacagcgtgtacagagtgctgaaggtgaactag

SEQ ID NO: 79677 - DNA, 618 bp, Artificial Sequence
  Description of Artificial Sequence: Synthetic coding sequence
atgagactgaagatgttcctgaccccccacatgtgcgtgatggccagcctgatctgcagcagacagctgttcggctggctgttcagaagagtgagattcgagaaggtgatcttcggcatcctgaccgtgatgagcatccagggctacgccaacctgagaaaccagtggagcatcatcggcgagttcaacaacctgccccaggaggagctgctgcagtggatcaagtacagcaccaccagcgacgccgtgttcgccggcgccatgcccaccatggccagcatcaagctgagcaccctgcaccccatcgtgaaccacccccactacgaggacgccgacctgagagccagaaccaagatcgtgtacagcacctacagcagaaagagcgccaaggaggtgagagacaagctgctggagctgcacgtgaactactacgtgctggaggaggcctggtgcgtggtgagaaccaagcccggctgcagcatgctggagatctgggacgtggaggaccccagcaacgccgccaacccccccctgtgcagcgtgctgctggaggacgccagaccctacttcaccaccgtgttccagaacagcgtgtacagagtgctgaaggtgaactag

SEQ ID NO: 79678 - DNA, 273 bp, Artificial Sequence
  Description of Artificial Sequence: Synthetic coding sequence
atgagaaagcagggcgtgagcagcaagagactgcagagcagcggcagaagccagagcaagggcagaagaggcgccagcctggccagagagcccgaggtggaggaggagatggagaagagcgccctgggcggcggcaagctgcccagaggcagctggagaagcagccccggcagaatccagagcctgaaggagagaaagggcctggagctggaggtggtggccaagaccttcctgctgggccccttccagttcgtgagaaacagcctggcctag

SEQ ID NO: 79679 - DNA, 1629 bp, Artificial Sequence
  Description of Artificial Sequence: Synthetic coding sequence
atgatgagcatcagacagagaagagagatcagagccaccgaggtgagcgaggacttccccgcccaggaggagaacgtgaagctggagaacaagctgcccagcggctgcaccagcagaagactgtggaagatcctgagcctgaccatcggcggcaccatcgccctgtgcatcggcctgctgaccagcgtgtacctggccaccctgcacgagaacgacctgtggttcagcaacatcaaggaggtggagagagagatcagcttcagaaccgagtgcggcctgtactacagctactacaagcagatgctgcaggcccccaccctggtgcagggcttccacggcctgatctacgacaacaagaccgagagcatgaagaccatcaacctgctgcagagaatgaacatctaccaggaggtgttcctgagcatcctgtacagagtgctgcccatccagaagtacctggagcccgtgtacttctacatctacaccctgttcggcctgcaggccatctacgtgaccgccctgtacatcaccagctggctgctgagcggcacctggctgagcggcctgctggccgccttctggtacgtgaccaacagaatcgacaccaccagagtggagttcaccatccccctgagagagaactgggccctgcccttcttcgccatccagatcgccgccatcacctacttcctgagacccaacctgcagcccctgagcgagagactgaccctgctggccatcttcatcagcaccttcctgttcagcctgacctggcagttcaaccagttcatgatgctgatgcaggccctggtgctgttcaccctggacagcctggacatgctgcccgccgtgaaggccacctggctgtacggcatccagatcaccagcctgctgctggtgtgcatcctgcagttcttcaacagcatgatcctgggcagcctgctgatcagcttcaacctgagcgtgttcatcgccagaaagctgcagaagaacctgaagaccggcagcttcctgaacagactgggcaagctgctgctgcacctgttcatggtgctgtgcctgaccctgttcctgaacaacatcatcaagaagatcctgaacctgaagagcgacgagcacatcttcaagttcctgaaggccaagttcggcctgggcgccaccagagacttcgacgccaacctgtacctgtgcgaggaggccttcggcctgctgcccttcaacaccttcggcagactgagcgacaccctgctgttctacgcctacatcttcgtgctgagcatcaccgtgatcgtggccttcgtggtggccttccacaacctgagcgacagcaccaaccagcagagcgtgggcaagatggagaagggcaccgtggacctgaagcccgagaccgcctacaacctgatccacaccatcctgttcggcttcctggccctgagcaccatgagaatgaagtacctgtggaccagccacatgtgcgtgttcgccagcttcggcctgtgcagccccgagatctgggagctgctgctgaagagcgtgcacctgtacaaccccaagagaatctgcatcatgagatacagcgtgcccatcctgatcctgctgtacctgtgctacaagaaccagaagagctag

SEQ ID NO: 79680 - DNA, 2151 bp, Artificial Sequence
  Description of Artificial Sequence: Synthetic coding sequence
atgatgagcatcagacagagaagagagatcagagccaccgaggtgagcgaggacttccccgcccaggaggagaacgtgaagctggagaacaagctgcccagcggctgcaccagcagaagactgtggaagatcctgagcctgaccatcggcggcaccatcgccctgtgcatcggcctgctgaccagcgtgtacctggccaccctgcacgagaacgacctgtggttcagcaacatcaaggaggtggagagagagatcagcttcagaaccgagtgcggcctgtactacagctactacaagcagatgctgcaggcccccaccctggtgcagggcttccacggcctgatctacgacaacaagaccgagagcatgaagaccatcaacctgctgcagagaatgaacatctaccaggaggtgttcctgagcatcctgtacagagtgctgcccatccagaagtacctggagcccgtgtacttctacatctacaccctgttcggcctgcaggccatctacgtgaccgccctgtacatcaccagctggctgctgagcggcacctggctgagcggcctgctggccgccttctggtacgtgaccaacagaatcgacaccaccagagtggagttcaccatccccctgagagagaactgggccctgcccttcttcgccatccagatcgccgccatcacctacttcctgagacccaacctgcagcccctgagcgagagactgaccctgctggccatcttcatcagcaccttcctgttcagcctgacctggcagttcaaccagttcatgatgctgatgcaggccctggtgctgttcaccctggacagcctggacatgctgcccgccgtgaaggccacctggctgtacggcatccagatcaccagcctgctgctggtgtgcatcctgcagttcttcaacagcatgatcctgggcagcctgctgatcagcttcaacctgagcgtgttcatcgccagaaagctgcagaagaacctgaagaccggcagcttcctgaacagactgggcaagctgctgctgcacctgttcatggtgctgtgcctgaccctgttcctgaacaacatcatcaagaagatcctgaacctgaagagcgacgagcacatcttcaagttcctgaaggccaagttcggcctgggcgccaccagagacttcgacgccaacctgtacctgtgcgaggaggccttcggcctgctgcccttcaacaccttcggcagactgagcgacaccctgctgttctacgcctacatcttcgtgctgagcatcaccgtgatcgtggccttcgtggtggccttccacaacctgagcgacagcaccaaccagcagagcgtgggcaagatggagaagggcaccgtggacctgaagcccgagaccgcctacaacctgatccacaccatcctgttcggcttcctggccctgagcaccatgagaatgaagtacctgtggaccagccacatgtgcgtgttcgccagcttcggcctgtgcagccccgagatctgggagctgctgctgaagagcgtgcacctgtacaaccccaagagaatctgcatcatgagatacagcgtgcccatcctgatcctgctgtacctgtgctacaagttctggcccggcatgatggacgagctgagcgagctgagagagttctacgaccccgacaccgtggagctgatgaactggatcaacagcaacacccccagaaaggccgtgttcgccggcagcatgcagctgctggccggcgtgaagctgtgcaccggcagaaccctgaccaaccacccccactacgaggacagcagcctgagagagagaaccagagccgtgtaccagatctacgccaagagagcccccgaggaggtgcacgccctgctgagaagcttcggcaccgactacgtgatcctggaggacagcatctgctacgagagaagacacagaagaggctgcagactgagagacctgctggacatcgccaacggccacatgatggacggccccggcgagaacgaccccgacctgaagcccgccgaccaccccagattctgcgaggagatcaagagaaacctgcccccctacgtggcctacttcaccagagtgttccagaacaagaccttccacgtgtacaagctgagcagaaacaagtag

SEQ ID NO: 79681 - DNA, 342 bp, Artificial Sequence
  Description of Artificial Sequence: Synthetic coding sequence
atgatgagcatcagacagagaagagagatcagagccaccgaggtgagcgaggacttccccgcccaggaggagaacgtgaagctggagaacaagctgcccagcggctgcaccagcagaagactgtggaagatcctgagcctgaccatcggcggcaccctgcccttcgccctggacttcctgcacctgagcaccctgcccagatacatgaagatgatctacggcttcctgatcctgagaaagtggagcgagaagagccacagcgagcagagcgtggcctgcatcacccccaccaccagcagatgctgcagactgcagcccagctgcaaggtgttcatggcctag

SEQ ID NO: 79682 - DNA, 2151 bp, Artificial Sequence; identical to SEQ ID NO: 79680
  Description of Artificial Sequence: Synthetic coding sequence

SEQ ID NO: 79683 - DNA, 2172 bp, Artificial Sequence
  Description of Artificial Sequence: Synthetic coding sequence
atggccgaggaggagggcccccccgtggagctgagacagagaaagaagcccaagagcagcgagaacaaggagagcgccaaggaggagaagatcagcgacatccccatccccgagagagcccccaagcacgtgctgttccagagattcgccaagatcttcatcggctgcctggccgccgtgaccagcggcatgatgtacgccctgtacctgagcgcctaccacgagagaaagttctggttcagcaacagacaggagctggagagagagatcaccttccagggcgacagcgccatctactacagctactacaaggacatgctgaaggcccccagcttcgagagaggcgtgtacgagctgacccacaacaacaagaccgtgagcctgaagaccatcaacgccgtgcagcagatgagcctgtaccccgagctgatcgccagcatcctgtaccaggccaccggcagcaacgagatcatcgagcccgtgtacttctacatcggcatcgtgttcggcctgcagggcatctacgtgaccgccctgttcgtgaccagctggctgatgagcggcacctggctggccggcatgctgaccgtggcctggttcgtgatcaacagagtggacaccaccagaatcgagtacagcatccccctgagagagaactgggccctgccctacttcgcctgccagatcgccgccctgaccggctacctgaagagcaacctgaacacctacggcgagagattctgctacctgctgatgagcgccagcacctacaccttcatgatgatgtgggagtacagccactacctgctgttcctgcaggccatcagcctgttcctgctggacaccttcagcgtggagcagagcgacaaggtgtacgaggtgtacaagatctacatcttcagcctgttcctgggctacctgctgcagttcgagaaccccgccctgctggtgagccccctgctgagcctggtggccgccctgatgctggccaagtgcctgcagctgaacgtgaagaagggcagcttcgtggccaagatcatcaaggtgatcaacttctacctggtgtgcaccctgaccatcaccctgaacatcatcatgaagatgttcgtgccccacaaggagaacggccacatgctgaagttcctggaggtgaagttcggcctgaacatgaccaagaacttcaccatgaactggctgctgtgccaggagagcctgcaggcccccagccaggacttcttcctgagactgacccagagcagcctgctgcccttctacatcctggtgctgatcatctgcttcctgagcatgctgcaggtgatcttcagaagaatcaacggcaagagcctgaaggagaccgtgaccctggaggacggcagaatcggcgagagacccgagatcatctaccacgtgatccacaccatcctgctgggcagcctggccatggtgatcgagggcctgaagtacatctggatcccctacgtgtgcatgctggccgccttcggcgtgtgcagccccgagctgtggatgaccctgttcaagtggctgagactgagaaccgtgcaccccatcctgctggccctgatcctgagcatggccgtgcccaccatcatcggcctgagcctgtggaaggagttcttccccagactgatgaccgagctgatggagctgcaggagttctacgaccccgacaccgtggagctgatgacctggatcaagagacaggcccccgtggccgccgtgttcgccggcagcccccagctgatgggcgccatcaagctgtgcaccggctggatggtgaccagcctgcccctgtacaacgacgacgacctgctgaagagaaacgagaacatctaccagatctacagcaagagaagcgccgaggacatctacaagatcctgaccagctacaaggccaactacctgatcgtggaggacgccatctgcaacgaggtgggccccatgagaggctgcagagtgaaggacctgctggacatcgccaacggccacatggtgtgcgaggagggcgacaagctgacctacagcaagtacggcagattctgccacgaggtgaagatcaactacagcccctacgtgaactacttcaccagagtgtactggaacagaagctacttcgtgtacaagatcaacaccgtgatcagcttccagagctag

SEQ ID NO: 79684 - DNA, 300 bp, Artificial Sequence
  Description of Artificial Sequence: Synthetic coding sequence
atggagcccgagcagatgctggagggccagacccaggtggccgagaacccccacagcgagtacggcctgaccgacaacgtggagagaatcgtggagaacgagaagatcaacgccgagaagagcagcaagcagaaggtggacctgcagagcctgcccaccagagcctacctggaccagaccgtggtgcccatcctgctgcagggcctggccgtgctggccaaggagagaccccccaaccccatcgagttcctggccagctacctgctgaagaacaaggcccagttcgaggacagaaactag

SEQ ID NO: 79685 - DNA, 300 bp, Artificial Sequence; identical to SEQ ID NO: 79684
  Description of Artificial Sequence: Synthetic coding sequence

SEQ ID NO: 79686 - DNA, 1956 bp, Artificial Sequence
  Description of Artificial Sequence: Synthetic coding sequence
atggccggccacccctggcacggcaccgccgccctggccagcagccaggcctggagagacggcagagagagacaggccctggtgagctgcagagccctgtacacctacgaggacggcagcgacgacctgaagctggccgccagcggcgagggcggcctgcaggagctgagcggccacttcgagaaccagaaggtgatgtacggcttctgcagcgtgaaggacagccaggccgccctgcccaagtacgtgctgatcaactgggtgggcgaggacgtgcccgacgccagaaagtgcgcctgcgccagccacgtggccaaggtggccgagttcttccagggcgtggacgtgatcgtgaacgccagcagcgtggaggacatcgacgccggcgccatcggccagagactgagcaacggcctggccagactgagcagccccgtgctgcacagactgagactgagagaggacgagaacgccgagcccgtgggcaccacctaccagaagaccgacgccgccgtggagatgaagagaatcaacagagagcagttctgggagcaggccaagaaggaggaggagctgagaaaggaggaggagagaaagaaggccctggacgagagactgagattcgagcaggagagaatggagcaggagagacaggagcaggaggagagagagagaagatacagagagagagagcagcagatcgaggagcacagaagaaagcagcagaccctggaggccgaggaggccaagagaagactgaaggagcagagcatcttcggcgaccacagagacgaggaggaggagacccacatgaagaagagcgagagcgaggtggaggaggccgccgccatcatcgcccagagacccgacaaccccagagagttcttcaagcagcaggagagagtggccagcgccagcgccggcagctgcgacgtgcccagccccttcaaccacagacccggcagccacctggacagccacagaagaatggcccccacccccatccccaccagaagccccagcgacagcagcaccgccagcacccccgtggccgagcagatcgagagagccctggacgaggtgaccagcagccagcccccccccctgccccccccccccccccccgcccaggagacccaggagcccagccccatcctggacagcgaggagaccagagccgccgccccccaggcctgggccggccccatggaggagcccccccaggcccaggccccccccagaggccccggcagccccgccgaggacctgatgttcatggagagcgccgagcaggccgtgctggccgcccccgtggagcccgccaccgccgacgccaccgagatccacgacgccgccgacaccatcgagaccgacaccgccaccgccgacaccaccgtggccaacaacgtgccccccgccgccaccagcctgatcgacctgtggcccggcaacggcgagggcgccagcaccctgcagggcgagcccagagcccccaccccccccagcggcaccgaggtgaccctggccgaggtgcccctgctggacgaggtggcccccgagcccctgctgcccgccggcgagggctgcgccaccctgctgaacttcgacgagctgcccgagccccccgccaccttctgcgaccccgaggaggtggagggcgagagcctggccgccccccagacccccaccctgcccagcgccctggaggagctggagcaggagcaggagcccgagccccacctgctgaccaacggcgagaccacccagaaggagggcacccaggccagcgagggctacttcagccagagccaggaggaggagttcgcccagagcgaggagctgtgcgccaaggcccccccccccgtgttctacaacaagccccccgagatcgacatcacctgctgggacgccgaccccgtgcccgaggaggaggagggcttcgagggcggcgactag

SEQ ID NO: 79687 - DNA, 1950 bp, Artificial Sequence
  Description of Artificial Sequence: Synthetic coding sequence
atggccggcgtgagcttcagcggccacagactggagctgctggccgcctacgaggaggtgatcagagaggagagcgccgccgactgggccctgtacacctacgaggacggcagcgacgacctgaagctggccgccagcggcgagggcggcctgcaggagctgagcggccacttcgagaaccagaaggtgatgtacggcttctgcagcgtgaaggacagccaggccgccctgcccaagtacgtgctgatcaactgggtgggcgaggacgtgcccgacgccagaaagtgcgcctgcgccagccacgtggccaaggtggccgagttcttccagggcgtggacgtgatcgtgaacgccagcagcgtggaggacatcgacgccggcgccatcggccagagactgagcaacggcctggccagactgagcagccccgtgctgcacagactgagactgagagaggacgagaacgccgagcccgtgggcaccacctaccagaagaccgacgccgccgtggagatgaagagaatcaacagagagcagttctgggagcaggccaagaaggaggaggagctgagaaaggaggaggagagaaagaaggccctggacgagagactgagattcgagcaggagagaatggagcaggagagacaggagcaggaggagagagagagaagatacagagagagagagcagcagatcgaggagcacagaagaaagcagcagaccctggaggccgaggaggccaagagaagactgaaggagcagagcatcttcggcgaccacagagacgaggaggaggagacccacatgaagaagagcgagagcgaggtggaggaggccgccgccatcatcgcccagagacccgacaaccccagagagttcttcaagcagcaggagagagtggccagcgccagcgccggcagctgcgacgtgcccagccccttcaaccacagacccggcagccacctggacagccacagaagaatggcccccacccccatccccaccagaagccccagcgacagcagcaccgccagcacccccgtggccgagcagatcgagagagccctggacgaggtgaccagcagccagcccccccccctgccccccccccccccccccgcccaggagacccaggagcccagccccatcctggacagcgaggagaccagagccgccgccccccaggcctgggccggccccatggaggagcccccccaggcccaggccccccccagaggccccggcagccccgccgaggacctgatgttcatggagagcgccgagcaggccgtgctggccgcccccgtggagcccgccaccgccgacgccaccgagatccacgacgccgccgacaccatcgagaccgacaccgccaccgccgacaccaccgtggccaacaacgtgccccccgccgccaccagcctgatcgacctgtggcccggcaacggcgagggcgccagcaccctgcagggcgagcccagagcccccaccccccccagcggcaccgaggtgaccctggccgaggtgcccctgctggacgaggtggcccccgagcccctgctgcccgccggcgagggctgcgccaccctgctgaacttcgacgagctgcccgagccccccgccaccttctgcgaccccgaggaggtggagggcgagagcctggccgccccccagacccccaccctgcccagcgccctggaggagctggagcaggagcaggagcccgagccccacctgctgaccaacggcgagaccacccagaaggagggcacccaggccagcgagggctacttcagccagagccaggaggaggagttcgcccagagcgaggagctgtgcgccaaggcccccccccccgtgttctacaacaagccccccgagatcgacatcacctgctgggacgccgaccccgtgcccgaggaggaggagggcttcgagggcggcgactag

SEQ ID NO: 79688 - DNA, 1146 bp, Artificial Sequence
  Description of Artificial Sequence: Synthetic coding sequence
atgaagaagagcgagagcgaggtggaggaggccgccgccatcatcgcccagagacccgacaaccccagagagttcttcaagcagcaggagagagtggccagcgccagcgccggcagctgcgacgtgcccagccccttcaaccacagacccggcagccacctggacagccacagaagaatggcccccacccccatccccaccagaagccccagcgacagcagcaccgccagcacccccgtggccgagcagatcgagagagccctggacgaggtgaccagcagccagcccccccccctgccccccccccccccccccgcccaggagacccaggagcccagccccatcctggacagcgaggagaccagagccgccgccccccaggcctgggccggccccatggaggagcccccccaggcccaggccccccccagaggccccggcagccccgccgaggacctgatgttcatggagagcgccgagcaggccgtgctggccgcccccgtggagcccgccaccgccgacgccaccgagatccacgacgccgccgacaccatcgagaccgacaccgccaccgccgacaccaccgtggccaacaacgtgccccccgccgccaccagcctgatcgacctgtggcccggcaacggcgagggcgccagcaccctgcagggcgagcccagagcccccaccccccccagcggcaccgaggtgaccctggccgaggtgcccctgctggacgaggtggcccccgagcccctgctgcccgccggcgagggctgcgccaccctgctgaacttcgacgagctgcccgagccccccgccaccttctgcgaccccgaggaggtggagggcgagagcctggccgccccccagacccccaccctgcccagcgccctggaggagctggagcaggagcaggagcccgagccccacctgctgaccaacggcgagaccacccagaaggagggcacccaggccagcgagggctacttcagccagagccaggaggaggagttcgcccagagcgaggagctgtgcgccaaggcccccccccccgtgttctacaacaagccccccgagatcgacatcacctgctgggacgccgaccccgtgcccgaggaggaggagggcttcgagggcggcgactag

SEQ ID NO: 79689 - DNA, 954 bp, Artificial Sequence
  Description of Artificial Sequence: Synthetic coding sequence
atggccggcgtgagcttcagcggccacagactggagctgctggccgcctacgaggaggtgatcagagaggagagcgccgccgactgggccctgtacacctacgaggacggcagcgacgacctgaagctggccgccagcggcggcggcctgcaggagctgagcggccacttcgagaaccagaaggtgatgtacggcttctgcagcgtgaaggacagccaggccgccctgcccaagtacgtgctgatcaactgggtgggcgaggacgtgcccgacgccagaaagtgcgcctgcgccagccacgtggccaaggtggccgagttcttccagggcgtggacgtgatcgtgaacgccagcagcgtggaggacatcgacgccggcgccatcggccagagactgagcaacggcctggccagactgagcagccccgtgctgcacagactgagactgagagaggacgagaacgccgagcccgtgggcaccacctaccagaagaccgacgccgccgtggagatgaagagaatcaacagagagcagttctgggagcaggccaagaaggaggaggagctgagaaaggaggaggagagaaagaaggccctggacgagagactgagattcgagcaggagagaatggagcaggagagacaggagcaggaggagagagagagaagatacagagagagagagcagcagatcgaggagcacagaagaaagcagcagaccctggaggccgaggaggccaagagaagactgaaggagcagagcatcttcggcgaccacagagacgaggaggaggagacccacatgaagaagagcgagagcgaggtggaggaggccgccgccatcatcgcccagagacccgacaaccccagagagttcttcaagcagcaggagagagtggccagcgccagcgccggcagctgcgacgtgcccagccccttcaaccacagaccctag

SEQ ID NO: 79690 - DNA, 375 bp, Artificial Sequence
  Description of Artificial Sequence: Synthetic coding sequence
atggccggcgtgagcttcagcggccacagactggagctgctggccgcctacgaggaggtgatcagagaggagagcgccgccgactgggccctgtacacctacgaggacggcagcgacgacctgaagctggccgccagcggcgagggcggcctgcaggagctgagcggccacttcgagaaccagaaggtgatgtacggcttctgcagcgtgaaggacagccaggccgccctgcccaagtacgtgctgatcaactgggtgggcgaggacgtgcccgacgccagaaagtgcgcctgcgccagccacgtggccaaggtggccgagttcttccagggcgtggacgtgatcgtgaacgccagcagcgtggaggacatctag

SEQ ID NO: 79691 - DNA, 3900 bp, Artificial Sequence
  Description of Artificial Sequence: Synthetic coding sequence
cacagaatgagcttccaccccggcagaggctgccccagaggcagaggcggccacggcgccagacccagcgcccccagcttcagaccccagaacctgagactgctgcacccccagcagccccccgtgcagtaccagtacgagccccccagcgcccccagcaccaccttcagcaacagccccgcccccaacttcctgccccccagacccgacttcgtgcccttccccccccccatgccccccagcgcccagggccccctgcccccctgccccatcagaccccccttccccaaccaccagatgagacaccccttccccgtgcccccctgcttcccccccatgcccccccccatgccctgccccaacaacccccccgtgcccggcgccccccccggccagggcaccttccccttcatgatgcccccccccagcatgccccaccccccccccccccccgtgatgccccagcaggtgaactaccagtacccccccggctacagccaccacaacttccccccccccagcttcaacagcttccagaacaaccccagcagcttcctgcccagcgccaacaacagcagcagcccccacttcagacacctgcccccctaccccctgcccaaggcccccagcgagagaagaagccccgagagactgaagcactacgacgaccacagacacagagaccacagccacggcagaggcgagagacacagaagcctggacagaagagagagaggcagaagccccgacagaagaagacaggacagcagatacagaagcgactacgacagaggcagaacccccagcagacacagaagctacgagagaagcagcagaagccccagcagagagaagaagagagccagatgggaggaggagaaggacagatggagcgacaaccagagcagcggcaaggacaagaactacaccagcatcaaggagaaggagcccgaggagaccatgcccgacaagaacgaggaggaggaggaggagctgctgaagcccgtgtggatcagatgcacccacagcgagaactactacagcagcgaccccatggaccaggtgggcgacagcaccgtggtgggcaccagcagactgagagacctgtacgacaagttcgaggaggagctgggcagcagacaggagaaggccaaggccgccagacccccctgggagccccccaagaccaagctggacgaggacctggagagcagcagcgagagcgagtgcgagagcgacgaggacagcacctgcagcagcagcagcgacagcgaggtgttcgacgtgatcgccgagatcaagagaaagaaggcccaccccgacagactgcacgacgagctgtggtacaacgaccccggccagatgaacgacggccccctgtgcaagtgcagcgccaaggccagaagaaccggcatcagacacagcatctaccccggcgaggaggccatcaagccctgcagacccatgaccaacaacgccggcagactgttccactacagaatcaccgtgagcccccccaccaacttcctgaccgacagacccaccgtgatcgagtacgacgaccacgagtacatcttcgagggcttcagcatgttcgcccacgcccccctgaccaacatccccctgtgcaaggtgatcagattcaacatcgactacaccatccacttcatcgaggagatgatgcccgagaacttctgcgtgaagggcctggagctgttcagcctgttcctgttcagagacatcctggagctgtacgactggaacctgaagggccccctgttcgaggacagccccccctgctgccccagattccacttcatgcccagattcgtgagattcctgcccgacggcggcaaggaggtgctgagcatgcaccagatcctgctgtacctgctgagatgcagcaaggccctggtgcccgaggaggagatcgccaacatgctgcagtgggaggagctggagtggcagaagtacgccgaggagtgcaagggcatgatcgtgaccaaccccggcaccaagcccagcagcgtgagaatcgaccagctggacagagagcagttcaaccccgacgtgatcaccttccccatcatcgtgcacttcggcatcagacccgcccagctgagctacgccggcgacccccagtaccagaagctgtggaagagctacgtgaagctgagacacctgctggccaacagccccaaggtgaagcagaccgacaagcagaagctggcccagagagaggaggccctgcagaagatcagacagaagaacaccatgagaagagaggtgaccgtggagctgagcagccagggcttctggaagaccggcatcagaagcgacgtgtgccagcacgccatgatgctgcccgtgctgacccaccacatcagataccaccagtgcctgatgcacctggacaagctgatcggctacaccttccaggacagatgcctgctgcagctggccatgacccaccccagccaccacctgaacttcggcatgaaccccgaccacgccagaaacagcctgagcaactgcggcatcagacagcccaagtacggcgacagaaaggtgcaccacatgcacatgagaaagaagggcatcaacaccctgatcaacatcatgagcagactgggccaggacgaccccacccccagcagaatcaaccacaacgagagactggagttcctgggcgacgccgtggtggagttcctgaccagcgtgcacctgtactacctgttccccagcctggaggagggcggcctggccacctacagaaccgccatcgtgcagaaccagcacctggccatgctggccaagaagctggagctggacagattcatgctgtacgcccacggccccgacctgtgcagagagagcgacctgagacacgccatggccaactgcttcgaggccctgatcggcgccgtgtacctggagggcagcctggaggaggccaagcagctgttcggcagactgctgttcaacgaccccgacctgagagaggtgtggctgaactaccccctgcaccccctgcagctgcaggagcccaacaccgacagacagctgatcgagaccagccccgtgctgcagaagctgaccgagttcgaggaggccatcggcgtgatcttcacccacgtgagactgctggccagagccttcaccctgagaaccgtgggcttcaaccacctgaccctgggccacaaccagagaatggagttcctgggcgacagcatcatgcagctggtggccaccgagtacctgttcatccacttccccgaccaccacgagggccacctgaccctgctgagaagcagcctggtgaacaacagaacccaggccaaggtggccgaggagctgggcatgcaggagtacgccatcaccaacgacaagaccaagagacccgtggccctgagaaccaagaccctggccgacctgctggagagcttcatcgccgccctgtacatcgacaaggacctggagtacgtgcacaccttcatgaacgtgtgcttcttccccagactgaaggagttcatcctgaaccaggactggaacgaccccaagagccagctgcagcagtgctgcctgaccctgagaaccgagggcaaggagcccgacatccccctgtacaagaccctgcagaccgtgggccccagccacgccagaacctacaccgtggccgtgtacttcaagggcgagagaatcggctgcggcaagggccccagcatccagcaggccgagatgggcgccgccatggacgccctggagaagtacaacttcccccagatggcccaccagaagagattcatcgagagaaagtacagacaggagctgaaggagatgagatgggagagagagcaccaggagagagagcccgacgagaccgaggacatcaagaagtag

SEQ ID NO: 79692 - DNA, 4125 bp, Artificial Sequence
  Description of Artificial Sequence: Synthetic coding sequence
atgatgcagggcaacacctgccacagaatgagcttccaccccggcagaggctgccccagaggcagaggcggccacggcgccagacccagcgcccccagcttcagaccccagaacctgagactgctgcacccccagcagccccccgtgcagtaccagtacgagccccccagcgcccccagcaccaccttcagcaacagccccgcccccaacttcctgccccccagacccgacttcgtgcccttccccccccccatgccccccagcgcccagggccccctgcccccctgccccatcagaccccccttccccaaccaccagatgagacaccccttccccgtgcccccctgcttcccccccatgcccccccccatgccctgccccaacaacccccccgtgcccggcgccccccccggccagggcaccttccccttcatgatgcccccccccagcatgccccaccccccccccccccccgtgatgccccagcaggtgaactaccagtacccccccggctacagccaccacaacttccccccccccagcttcaacagcttccagaacaaccccagcagcttcctgcccagcgccaacaacagcagcagcccccacttcagacacctgcccccctaccccctgcccaaggcccccagcgagagaagaagccccgagagactgaagcactacgacgaccacagacacagagaccacagccacggcagaggcgagagacacagaagcctggacagaagagagagaggcagaagccccgacagaagaagacaggacagcagatacagaagcgactacgacagaggcagaacccccagcagacacagaagctacgagagaagcagagagagagagagagagagacacagacacagagacaacagaagaagccccagcctggagagaagctacaagaaggagtacaagagaagcggcagaagctacggcctgagcgtggtgcccgagcccgccggctgcacccccgagctgcccggcgagatcatcaagaacaccgacagctgggccccccccctggagatcgtgaaccacagaagccccagcagagagaagaagagagccagatgggaggaggagaaggacagatggagcgacaaccagagcagcggcaaggacaagaactacaccagcatcaaggagaaggagcccgaggagaccatgcccgacaagaacgaggaggaggaggaggagctgctgaagcccgtgtggatcagatgcacccacagcgagaactactacagcagcgaccccatggaccaggtgggcgacagcaccgtggtgggcaccagcagactgagagacctgtacgacaagttcgaggaggagctgggcagcagacaggagaaggccaaggccgccagacccccctgggagccccccaagaccaagctggacgaggacctggagagcagcagcgagagcgagtgcgagagcgacgaggacagcacctgcagcagcagcagcgacagcgaggtgttcgacgtgatcgccgagatcaagagaaagaaggcccaccccgacagactgcacgacgagctgtggtacaacgaccccggccagatgaacgacggccccctgtgcaagtgcagcgccaaggccagaagaaccggcatcagacacagcatctaccccggcgaggaggccatcaagccctgcagacccatgaccaacaacgccggcagactgttccactacagaatcaccgtgagcccccccaccaacttcctgaccgacagacccaccgtgatcgagtacgacgaccacgagtacatcttcgagggcttcagcatgttcgcccacgcccccctgaccaacatccccctgtgcaaggtgatcagattcaacatcgactacaccatccacttcatcgaggagatgatgcccgagaacttctgcgtgaagggcctggagctgttcagcctgttcctgttcagagacatcctggagctgtacgactggaacctgaagggccccctgttcgaggacagccccccctgctgccccagattccacttcatgcccagattcgtgagattcctgcccgacggcggcaaggaggtgctgagcatgcaccagatcctgctgtacctgctgagatgcagcaaggccctggtgcccgaggaggagatcgccaacatgctgcagtgggaggagctggagtggcagaagtacgccgaggagtgcaagggcatgatcgtgaccaaccccggcaccaagcccagcagcgtgagaatcgaccagctggacagagagcagttcaaccccgacgtgatcaccttccccatcatcgtgcacttcggcatcagacccgcccagctgagctacgccggcgacccccagtaccagaagctgtggaagagctacgtgaagctgagacacctgctggccaacagccccaaggtgaagcagaccgacaagcagaagctggcccagagagaggaggccctgcagaagatcagacagaagaacaccatgagaagagaggtgaccgtggagctgagcagccagggcttctggaagaccggcatcagaagcgacgtgtgccagcacgccatgatgctgcccgtgctgacccaccacatcagataccaccagtgcctgatgcacctggacaagctgatcggctacaccttccaggacagatgcctgctgcagctggccatgacccaccccagccaccacctgaacttcggcatgaaccccgaccacgccagaaacagcctgagcaactgcggcatcagacagcccaagtacggcgacagaaaggtgcaccacatgcacatgagaaagaagggcatcaacaccctgatcaacatcatgagcagactgggccaggacgaccccacccccagcagaatcaaccacaacgagagactggagttcctgggcgacgccgtggtggagttcctgaccagcgtgcacctgtactacctgttccccagcctggaggagggcggcctggccacctacagaaccgccatcgtgcagaaccagcacctggccatgctggccaagaagctggagctggacagattcatgctgtacgcccacggccccgacctgtgcagagagagcgacctgagacacgccatggccaactgcttcgaggccctgatcggcgccgtgtacctggagggcagcctggaggaggccaagcagctgttcggcagactgctgttcaacgaccccgacctgagagaggtgtggctgaactaccccctgcaccccctgcagctgcaggagcccaacaccgacagacagctgatcgagaccagccccgtgctgcagaagctgaccgagttcgaggaggccatcggcgtgatcttcacccacgtgagactgctggccagagccttcaccctgagaaccgtgggcttcaaccacctgaccctgggccacaaccagagaatggagttcctgggcgacagcatcatgcagctggtggccaccgagtacctgttcatccacttccccgaccaccacgagggccacctgaccctgctgagaagcagcctggtgaacaacagaacccaggccaaggtggccgaggagctgggcatgcaggagtacgccatcaccaacgacaagaccaagagacccgtggccctgagaaccaagaccctggccgacctgctggagagcttcatcgccgccctgtacatcgacaaggacctggagtacgtgcacaccttcatgaacgtgtgcttcttccccagactgaaggagttcatcctgaaccaggactggaacgaccccaagagccagctgcagcagtgctgcctgaccctgagaaccgagggcaaggagcccgacatccccctgtacaagaccctgcagaccgtgggccccagccacgccagaacctacaccgtggccgtgtacttcaagggcgagagaatcggctgcggcaagggccccagcatccagcaggccgagatgggcgccgccatggacgccctggagaagtacaacttcccccagatggcccaccagaagagattcatcgagagaaagtacagacaggagctgaaggagatgagatgggagagagagcaccaggagagagagcccgacgagaccgaggacatcaagaagtag

SEQ ID NO: 79693 - DNA, 3558 bp, Artificial Sequence
  Description of Artificial Sequence: Synthetic coding sequence
cacagaatgagcttccaccccggcagaggctgccccagaggcagaggcggccacggcgccagacccagcgcccccagcttcagaccccagaacctgagactgctgcacccccagcagccccccgtgcagtaccagtacgagccccccagcgcccccagcaccaccttcagcaacagccccgcccccaacttcctgccccccagacccgacttcgtgcccttccccccccccatgccccccagcgcccagggccccctgcccccctgccccatcagaccccccttccccaaccaccagatgagacaccccttccccgtgcccccctgcttcccccccatgcccccccccatgccctgccccaacaacccccccgtgcccggcgccccccccggccagggcaccttccccttcatgatgcccccccccagcatgccccaccccccccccccccccgtgatgccccagcaggtgaactaccagtacccccccggctacagccaccacaacttccccccccccagcttcaacagcttccagaacaaccccagcagcttcctgcccagcgccaacaacagcagcagcccccacttcagacacctgcccccctaccccctgcccaaggcccccagcgagagaagaagccccgagagactgaagcactacgacgaccacagacacagagaccacagccacggcagaggcgagagacacagaagcctggacagaagagagagaggcagaagccccgacagaagaagacaggacagcagatacagaagcgactacgacagaggcagaacccccagcagacacagaagctacgagagaagcagagagagagagagagagagacacagacacagagacaacagaagaagccccagcctggagagaagctacaagaaggagtacaagagaagcggcagcagaagccccagcagagagaagaagagagccagatgggaggaggagaaggacagatggagcgacaaccagagcagcggcaaggacaagaactacaccagcatcaaggagaaggagcccgaggagaccatgcccgacaagaacgaggaggaggaggaggagctgctgaagcccgtgtggatcagatgcacccacagcgagaactactacagcagcgaccccatggaccaggtgggcgacagcaccgtggtgggcaccagcagactgagagacctgtacgacaagttcgaggaggagctgggcagcagacaggagaaggccaaggccgccagacccccctgggagccccccaagaccaagctggacgaggacctggagagcagcagcgagagcgagtgcgagagcgacgaggacagcacctgcagcagcagcagcgacagcgaggtgttcgacgtgatcgccgagatcaagagaaagaaggcccaccccgacagactgcacgacgagctgtggtacaacgaccccggccagatgaacgacggccccctgtgcaagtgcagcgccaaggccagaagaaccggcatcagacacagcatctaccccggcgaggaggccatcaagccctgcagacccatgaccaacaacgccggcagactgttccactacagaatcaccgtgagcccccccaccaacttcctgaccgacagacccaccgtgatcgagtacgacgaccacgagtacatcttcgagggcttcagcatgttcgcccacgcccccctgaccaacatccccctgtgcaaggtgatcagattcaacatcgactacaccatccacttcatcgaggagatgatgcccgagaacttctgcgtgaagggcctggagctgttcagcctgttcctgttcagagacatcctggagctgtacgactggaacctgaagggccccctgttcgaggacagccccccctgctgccccagattccacttcatgcccagattcgtgagattcctgcccgacggcggcaaggaggtgctgagcatgcaccagatcctgctgtacctgctgagatgcagcaaggccctggtgcccgaggaggagatcgccaacatgctgcagtgggaggagctggagtggcagaagtacgccgaggagtgcaagggcatgatcgtgaccaaccccggcaccaagcccagcagcgtgagaatcgaccagctggacagagagcagttcaaccccgacgtgatcaccttccccatcatcgtgcacttcggcatcagacccgcccagctgagctacgccggcgacccccagtaccagaagctgtggaagagctacgtgaagctgagacacctgctggccaacagccccaaggtgaagcagaccgacaagcagaagctggcccagagagaggaggccctgcagaagatcagacagaagaacaccatgagaagagaggtgaccgtggagctgagcagccagggcttctggaagaccggcatcagaagcgacgtgtgccagcacgccatgatgctgcccgtgctgacccaccacatcagataccaccagtgcctgatgcacctggacaagctgatcggctacaccttccaggacagatgcctgctgcagctggccatgacccaccccagccaccacctgaacttcggcatgaaccccgaccacgccagaaacagcctgagcaactgcggcatcagacagcccaagtacggcgacagaaaggtgcaccacatgcacatgagaaagaagggcatcaacaccctgatcaacatcatgagcagactgggccaggacgaccccacccccagcagaatcaaccacaacgagagactggagttcctgggcgacgccgtggtggagttcctgaccagcgtgcacctgtactacctgttccccagcctggaggagggcggcctggccacctacagaaccgccatcgtgcagaaccagcacctggccatgctggccaagaagctggagctggacagattcatgctgtacgcccacggccccgacctgtgcagagagagcgacctgagacacgccatggccaactgcttcgaggccctgatcggcgccgtgtacctggagggcagcctggaggaggccaagcagctgttcggcagactgctgttcaacgaccccgacctgagagaggtgtggctgaactaccccctgcaccccctgcagctgcaggagcccaacaccgacagacagctgatcgagaccagccccgtgctgcagaagctgaccgagttcgaggaggccatcggcgtgatcttcacccacgtgagactgctggccagagccttcaccctgagaaccgtgggcttcaaccacctgaccctgggccacaaccagagaatggagttcctgggcgacagcatcatgcagctggtggccaccgagtacctgttcatccacttccccgaccaccacgagggccacctgaccctgctgagaagcagcctggtgaacaacagaacccaggccaaggtggccgaggagctgggcatgcaggagtggagcatctacctgctgagcaactgcgactgctgcctgctgagacccagcctggtgttcctgcagaccatgaacgaggtgtgcagcctgaagtag

SEQ ID NO: 79694 - DNA, 4014 bp, Artificial Sequence
  Description of Artificial Sequence: Synthetic coding sequence
atgatgcagggcaacacctgccacagaatgagcttccaccccggcagaggctgccccagaggcagaggcggccacggcgccagacccagcgcccccagcttcagaccccagaacctgagactgctgcacccccagcagccccccgtgcagtaccagtacgagccccccagcgcccccagcaccaccttcagcaacagccccgcccccaacttcctgccccccagacccgacttcgtgcccttccccccccccatgccccccagcgcccagggccccctgcccccctgccccatcagaccccccttccccaaccaccagatgagacaccccttccccgtgcccccctgcttcccccccatgcccccccccatgccctgccccaacaacccccccgtgcccggcgccccccccggccagggcaccttccccttcatgatgcccccccccagcatgccccaccccccccccccccccgtgatgccccagcaggtgaactaccagtacccccccggctacagccaccacaacttccccccccccagcttcaacagcttccagaacaaccccagcagcttcctgcccagcgccaacaacagcagcagcccccacttcagacacctgcccccctaccccctgcccaaggcccccagcgagagaagaagccccgagagactgaagcactacgacgaccacagacacagagaccacagccacggcagaggcgagagacacagaagcctggacagaagagagagaggcagaagccccgacagaagaagacaggacagcagatacagaagcgactacgacagaggcagaacccccagcagacacagaagctacgagagaagcagagagagagagagagagagacacagacacagagacaacagaagaagccccagcctggagagaagctacaagaaggagtacaagagaagcggcagcagaagccccagcagagagaagaagagagccagatgggaggaggagaaggacagatggagcgacaaccagagcagcggcaaggacaagaactacaccagcatcaaggagaaggagcccgaggagaccatgcccgacaagaacgaggaggaggaggaggagctgctgaagcccgtgtggatcagatgcacccacagcgagaactactacagcagcgaccccatggaccaggtgggcgacagcaccgtggtgggcaccagcagactgagagacctgtacgacaagttcgaggaggagctgggcagcagacaggagaaggccaaggccgccagacccccctgggagccccccaagaccaagctggacgaggacctggagagcagcagcgagagcgagtgcgagagcgacgaggacagcacctgcagcagcagcagcgacagcgaggtgttcgacgtgatcgccgagatcaagagaaagaaggcccaccccgacagactgcacgacgagctgtggtacaacgaccccggccagatgaacgacggccccctgtgcaagtgcagcgccaaggccagaagaaccggcatcagacacagcatctaccccggcgaggaggccatcaagccctgcagacccatgaccaacaacgccggcagactgttccactacagaatcaccgtgagcccccccaccaacttcctgaccgacagacccaccgtgatcgagtacgacgaccacgagtacatcttcgagggcttcagcatgttcgcccacgcccccctgaccaacatccccctgtgcaaggtgatcagattcaacatcgactacaccatccacttcatcgaggagatgatgcccgagaacttctgcgtgaagggcctggagctgttcagcctgttcctgttcagagacatcctggagctgtacgactggaacctgaagggccccctgttcgaggacagccccccctgctgccccagattccacttcatgcccagattcgtgagattcctgcccgacggcggcaaggaggtgctgagcatgcaccagatcctgctgtacctgctgagatgcagcaaggccctggtgcccgaggaggagatcgccaacatgctgcagtgggaggagctggagtggcagaagtacgccgaggagtgcaagggcatgatcgtgaccaaccccggcaccaagcccagcagcgtgagaatcgaccagctggacagagagcagttcaaccccgacgtgatcaccttccccatcatcgtgcacttcggcatcagacccgcccagctgagctacgccggcgacccccagtaccagaagctgtggaagagctacgtgaagctgagacacctgctggccaacagccccaaggtgaagcagaccgacaagcagaagctggcccagagagaggaggccctgcagaagatcagacagaagaacaccatgagaagagaggtgaccgtggagctgagcagccagggcttctggaagaccggcatcagaagcgacgtgtgccagcacgccatgatgctgcccgtgctgacccaccacatcagataccaccagtgcctgatgcacctggacaagctgatcggctacaccttccaggacagatgcctgctgcagctggccatgacccaccccagccaccacctgaacttcggcatgaaccccgaccacgccagaaacagcctgagcaactgcggcatcagacagcccaagtacggcgacagaaaggtgcaccacatgcacatgagaaagaagggcatcaacaccctgatcaacatcatgagcagactgggccaggacgaccccacccccagcagaatcaaccacaacgagagactggagttcctgggcgacgccgtggtggagttcctgaccagcgtgcacctgtactacctgttccccagcctggaggagggcggcctggccacctacagaaccgccatcgtgcagaaccagcacctggccatgctggccaagaagctggagctggacagattcatgctgtacgcccacggccccgacctgtgcagagagagcgacctgagacacgccatggccaactgcttcgaggccctgatcggcgccgtgtacctggagggcagcctggaggaggccaagcagctgttcggcagactgctgttcaacgaccccgacctgagagaggtgtggctgaactaccccctgcaccccctgcagctgcaggagcccaacaccgacagacagctgatcgagaccagccccgtgctgcagaagctgaccgagttcgaggaggccatcggcgtgatcttcacccacgtgagactgctggccagagccttcaccctgagaaccgtgggcttcaaccacctgaccctgggccacaaccagagaatggagttcctgggcgacagcatcatgcagctggtggccaccgagtacctgttcatccacttccccgaccaccacgagggccacctgaccctgctgagaagcagcctggtgaacaacagaacccaggccaaggtggccgaggagctgggcatgcaggagtacgccatcaccaacgacaagaccaagagacccgtggccctgagaaccaagaccctggccgacctgctggagagcttcatcgccgccctgtacatcgacaaggacctggagtacgtgcacaccttcatgaacgtgtgcttcttccccagactgaaggagttcatcctgaaccaggactggaacgaccccaagagccagctgcagcagtgctgcctgaccctgagaaccgagggcaaggagcccgacatccccctgtacaagaccctgcagaccgtgggccccagccacgccagaacctacaccgtggccgtgtacttcaagggcgagagaatcggctgcggcaagggccccagcatccagcaggccgagatgggcgccgccatggacgccctggagaagtacaacttcccccagatggcccaccagaagagattcatcgagagaaagtacagacaggagctgaaggagatgagatgggagagagagcaccaggagagagagcccgacgagaccgaggacatcaagaagtag

SEQ ID NO: 79695 - DNA, 606 bp, Artificial Sequence
  Description of Artificial Sequence: Synthetic coding sequence
atgatgcagggcaacacctgccacagaatgagcttccaccccggcagaggctgccccagaggcagaggcggccacggcgccagacccagcgcccccagcttcagaccccagaacctgagactgctgcacccccagcagccccccgtgcagtaccagtacgagccccccagcgcccccagcaccaccttcagcaacagccccgcccccaacttcctgccccccagacccgacttcgtgcccttccccccccccatgccccccagcgcccagggccccctgcccccctgccccatcagaccccccttccccaaccaccagatgagacaccccttccccgtgcccccctgcttcccccccatgcccccccccatgccctgccccaacaacccccccgtgcccggcgccccccccggccagggcaccttccccttcatgatgcccccccccagcatgccccaccccccccccccccccgtgatgccccagcaggtgaactaccagtacccccccggctacagccaccacaacttccccccccccagcttcaacagcttccagaacaaccccagcagcttcctgcccagcgccaacaacagcagcagctag

SEQ ID NO: 79696 - DNA, 4125 bp, Artificial Sequence; identical to SEQ ID NO: 79692
  Description of Artificial Sequence: Synthetic coding sequence

SEQ ID NO: 79697 - DNA, 630 bp, Artificial Sequence
  Description of Artificial Sequence: Synthetic coding sequence
atgaaggccgtggtgcagagagtgaccagagccagcgtgaccgtgggcggcgagcagatcagcgccatcggcagaggcatctgcgtgctgctgggcatcagcctggaggacacccagaaggagctggagcacatggtgagaaagatcctgaacctgagagtgttcgaggacgagagcggcaagcactggagcaagagcgtgatggacaagcagtacgagatcctgtgcgtgagccagttcaccctgcagtgcgtgctgaagggcaacaagcccgacttccacctggccatgcccaccgagcaggccgagggcttctacaacagcttcctggagcagctgagaaagacctacagacccgagctgatcaaggacggcaagttcggcgcctacatgcaggtgcacatccagaacgacggccccgtgaccatcgagctggagagccccgcccccggcaccgccaccagcgaccccaagcagctgagcaagctggagaagcagcagcagagaaaggagaagaccagagccaagggccccagcgagagcagcaaggagagaaacacccccagaaaggaggacagaagcgccagcagcggcgccgagggcgacgtgagcagcgagagagagccctag

SEQ ID NO: 79698 - DNA, 843 bp, Artificial Sequence
  Description of Artificial Sequence: Synthetic coding sequence
atgggcagagccgagctgctggagggcaagatgagcacccaggaccccagcgacctgtggagcagaagcgacggcgaggccgagctgctgcaggacctgggctggtaccacggcaacctgaccagacacgccgccgaggccctgctgctgagcaacggctgcgacggcagctacctgctgagagacagcaacgagaccaccggcctgtacagcctgagcgtgagagccaaggacagcgtgaagcacttccacgtggagtacaccggctacagcttcaagttcggcttcaacgagttcagcagcctgaaggacttcgtgaagcacttcgccaaccagcccctgatcggcagcgagaccggcaccctgatggtgctgaagcacccctaccccagaaaggtggaggagcccagcatctacgagagcgtgagagtgcacaccgccatgcagaccggcagaaccgaggacgacctggtgcccaccgcccccagcctgggcaccaaggagggctacctgaccaagcagggcggcctggtgaagacctggaagaccagatggttcaccctgcacagaaacgagctgaagtacttcaaggaccagatgagccccgagcccatcagaatcctggacctgaccgagtgcagcgccgtgcagttcgactacagccaggagagagtgaactgcttctgcctggtgttccccttcagaaccttctacctgtgcgccaagaccggcgtggaggccgacgagtggatcaagatcctgagatggaagctgagccagatcagaaagcagctgaaccagggcgagggcaccatcagaagcagaagcttcatcttcaagtag

SEQ ID NO: 79699 - DNA, 4656 bp, Artificial Sequence
  Description of Artificial Sequence: Synthetic coding sequence
atgggcttctgcctggccctggcctggaccctgctggtgggcgcctggacccccctgggcgcccagaaccccatcagctgggaggtgcagagattcgacggctggtacaacaacctgatggagcacagatggggcagcaagggcagcagactgcagagactggtgcccgccagctacgccgacggcgtgtaccagcccctgggcgagccccacctgcccaaccccagagacctgagcaacaccatcagcagaggccccgccggcctggccagcctgagaaacagaaccgtgctgggcgtgttcttcggctaccacgtgctgagcgacctggtgagcgtggagacccccggctgccccgccgagttcctgaacatcagaatcccccccggcgaccccatgttcgaccccgaccagagaggcgacgtggtgctgcccttccagagaagcagatgggaccccgagaccggcagaagccccagcaaccccagagaccccgccaaccaggtgaccggctggctggacggcagcgccatctacggcagcagccacagctggagcgacgccctgagaagcttcagcagaggccagctggccagcggccccgaccccgccttccccagagacagccagaaccccctgctgatgtgggccgcccccgaccccgccaccggccagaacggccccagaggcctgtacgccttcggcgccgagagaggcaacagagagcccttcctgcaggccctgggcctgctgtggttcagataccacaacctgtgggcccagagactggccagacagcaccccgactgggaggacgaggagctgttccagcacgccagaaagagagtgatcgccacctaccagaacatcgccgtgtacgagtggctgcccagcttcctgcagaagaccctgcccgagtacaccggctacagacccttcctggaccccagcatcagcagcgagttcgtggccgccagcgagcagttcctgagcaccatggtgccccccggcgtgtacatgagaaacgccagctgccacttccagggcgtgatcaacagaaacagcagcgtgagcagagccctgagagtgtgcaacagctactggagcagagagcaccccagcctgcagagcgccgaggacgtggacgccctgctgctgggcatggccagccagatcgccgagagagaggaccacgtgctggtggaggacgtgagagacttctggcccggccccctgaagttcagcagaaccgaccacctggccagctgcctgcagagaggcagagacctgggcctgcccagctacaccaaggccagagccgccctgggcctgagccccatcaccagatggcaggacatcaaccccgccctgagcagaagcaacgacaccgtgctggaggccaccgccgccctgtacaaccaggacctgagctggctggagctgctgcccggcggcctgctggagagccacagagaccccggccccctgttcagcaccatcgtgctggagcagttcgtgagactgagagacggcgacagatactggttcgagaacaccagaaacggcctgttcagcaagaaggagatcgaggagatcagaaacaccaccctgcaggacgtgctggtggccgtgatcaacatcgaccccagcgccctgcagcccaacgtgttcgtgtggcacaagggcgacccctgcccccagcccagacagctgagcaccgagggcctgcccgcctgcgcccccagcgtggtgagagactacttcgagggcagcggcttcggcttcggcgtgaccatcggcaccctgtgctgcttccccctggtgagcctgctgagcgcctggatcgtggccagactgagaatgagaaacttcaagagactgcagggccaggacagacagagcatcgtgagcgagaagctggtgggcggcatggaggccctggagtggcagggccacaaggagccctgcagacccgtgctggtgtacctgcagcccggccagatcagagtggtggacggcagactgaccgtgctgagaaccatccagctgcagcccccccagaaggtgaacttcgtgctgagcagcaacagaggcagaagaaccctgctgctgaagatccccaaggagtacgacctggtgctgctgttcaacctggaggaggagagacaggccctggtggagaacctgagaggcgccctgaaggagagcggcctgagcatccaggagtgggagctgagagagcaggagctgatgagagccgccgtgaccagagagcagagaagacacctgctggagaccttcttcagacacctgttcagccaggtgctggacatcaaccaggccgacgccggcaccctgcccctggacagcagccagaaggtgagagaggccctgacctgcgagctgagcagagccgagttcgccgagagcctgggcctgaagccccaggacatgttcgtggagagcatgttcagcctggccgacaaggacggcaacggctacctgagcttcagagagttcctggacatcctggtggtgttcatgaagggcagccccgaggagaagagcagactgatgttcagaatgtacgacttcgacggcaacggcctgatcagcaaggacgagttcatcagaatgctgagaagcttcatcgagatcagcaacaactgcctgagcaaggcccagctggccgaggtggtggagagcatgttcagagagagcggcttccaggacaaggaggagctgacctgggaggacttccacttcatgctgagagaccacaacagcgagctgagattcacccagctgtgcgtgaagggcgtggaggtgcccgaggtgatcaaggacctgtgcagaagagccagctacatcagccaggacatgatctgccccagccccagagtgagcgccagatgcagcagaagcgacatcgagaccgagctgaccccccagagactgcagtgccccatggacaccgaccccccccaggagatcagaagaagattcggcaagaaggtgaccagcttccagcccctgctgttcaccgaggcccacagagagaagttccagagaagctgcctgcaccagaccgtgcagcagttcaagagattcatcgagaactacagaagacacatcggctgcgtggccgtgttctacgccatcgccggcggcctgttcctggagagagcctactactacgccttcgccgcccaccacaccggcatcaccgacaccaccagagtgggcatcatcctgagcagaggcaccgccgccagcatcagcttcatgttcagctacatcctgctgaccatgtgcagaaacctgatcaccttcctgagagagaccttcctgaacagatacgtgcccttcgacgccgccgtggacttccacagactgatcgccagcaccgccatcgtgctgaccgtgctgcacagcgtgggccacgtggtgaacgtgtacctgttcagcatcagccccctgagcgtgctgagctgcctgttccccggcctgttccacgacgacggcagcgagctgccccagaagtactactggtggttcttccagaccgtgcccggcctgaccggcgtggtgctgctgctgatcctggccatcatgtacgtgttcgccagccaccacttcagaagaagaagcttcagaggcttctggctgacccaccacctgtacatcctgctgtacgtgctgctgatcatccacggcagcttcgccctgatccagctgcccagattccacatcttcttcctggtgcccgccatcatctacggcggcgacaagctggtgagcctgagcagaaagaaggtggagatcagcgtggtgaaggccgagctgctgcccagcggcgtgacccacctgagattccagagaccccagggcttcgagtacaagagcggccagtgggtgagaatcgcctgcctggccctgggcaccaccgagtaccaccccttcaccctgaccagcgccccccacgaggacaccctgagcctgcacatcagagccgccggcccctggaccaccagactgagagagatctacagcgcccccaccggcgacagatgcgccagataccccaagctgtacctggacggccccttcggcgagggccaccaggagtggcacaagttcgaggtgagcgtgctggtgggcggcggcatcggcgtgacccccttcgccagcatcctgaaggacctggtgttcaagagcagcgtgagctgccaggtgttctgcaagaagatctacttcatctgggtgaccagaacccagagacagttcgagtggctggccgacatcatcagagaggtggaggagaacgaccaccaggacctggtgagcgtgcacatctacatcacccagctggccgagaagttcgacctgagaaccaccatgctgtacatctgcgagagacacttccagaaggtgctgaacagaagcctgttcaccggcctgagaagcatcacccacttcggcagaccccccttcgagcccttcttcaacagcctgcaggaggtgcacccccaggtgagaaagatcggcgtgttcagctgcggcccccccggcatgaccaagaacgtggagaaggcctgccagctgatcaacagacaggacagaacccacttcagccaccactacgagaacttctag

SEQ ID NO: 79700 - DNA, 4656 bp, Artificial Sequence; identical to SEQ ID NO: 79699
  Description of Artificial Sequence: Synthetic coding sequence

SEQ ID NO: 79701 - DNA, 4656 bp, Artificial Sequence; identical to SEQ ID NO: 79699
  Description of Artificial Sequence: Synthetic coding sequence

SEQ ID NO: 79702 - DNA, 132 bp, Artificial Sequence
  Description of Artificial Sequence: Synthetic coding sequence
atgggcttctgcctggccctggcctggaccctgctggtgggcgcctggacccccctgggcgcccagaaccccatcagctgggaggtgcagagattcgacggctggtacaacaacctgatggagcacagatag

SEQ ID NO: 79703 - DNA, 3594 bp, Artificial Sequence
  Description of Artificial Sequence: Synthetic coding sequence
atgtggatgcactgctgctgggcctggccccccagaagccagagcgagagaaccatgtgctggctgaagatgtgcggcgtgagcctgagactgagcctgcaggtggtgaacagctggcccctgggcagaggcagcgccggcctgcccgagcccgacttctggcccggccccctgaagttcagcagaaccgaccacctggccagctgcctgcagagaggcagagacctgggcctgcccagctacaccaaggccagagccgccctgggcctgagccccatcaccagatggcaggacatcaaccccgccctgagcagaagcaacgacaccgtgctggaggccaccgccgccctgtacaaccaggacctgagctggctggagctgctgcccggcggcctgctggagagccacagagaccccggccccctgttcagcaccatcgtgctggagcagttcgtgagactgagagacggcgacagatactggttcgagaacaccagaaacggcctgttcagcaagaaggagatcgaggagatcagaaacaccaccctgcaggacgtgctggtggccgtgatcaacatcgaccccagcgccctgcagcccaacgtgttcgtgtggcacaagggcgacccctgcccccagcccagacagctgagcaccgagggcctgcccgcctgcgcccccagcgtggtgagagactacttcgagggcagcggcttcggcttcggcgtgaccatcggcaccctgtgctgcttccccctggtgagcctgctgagcgcctggatcgtggccagactgagaatgagaaacttcaagagactgcagggccaggacagacagagcatcgtgagcgagaagctggtgggcggcatggaggccctggagtggcagggccacaaggagccctgcagacccgtgctggtgtacctgcagcccggccagatcagagtggtggacggcagactgaccgtgctgagaaccatccagctgcagcccccccagaaggtgaacttcgtgctgagcagcaacagaggcagaagaaccctgctgctgaagatccccaaggagtacgacctggtgctgctgttcaacctggaggaggagagacaggccctggtggagaacctgagaggcgccctgaaggagagcggcctgagcatccaggagtgggagctgagagagcaggagctgatgagagccgccgtgaccagagagcagagaagacacctgctggagaccttcttcagacacctgttcagccaggtgctggacatcaaccaggccgacgccggcaccctgcccctggacagcagccagaaggtgagagaggccctgacctgcgagctgagcagagccgagttcgccgagagcctgggcctgaagccccaggacatgttcgtggagagcatgttcagcctggccgacaaggacggcaacggctacctgagcttcagagagttcctggacatcctggtggtgttcatgaagggcagccccgaggagaagagcagactgatgttcagaatgtacgacttcgacggcaacggcctgatcagcaaggacgagttcatcagaatgctgagaagcttcatcgagatcagcaacaactgcctgagcaaggcccagctggccgaggtggtggagagcatgttcagagagagcggcttccaggacaaggaggagctgacctgggaggacttccacttcatgctgagagaccacaacagcgagctgagattcacccagctgtgcgtgaagggcgtggaggtgcccgaggtgatcaaggacctgtgcagaagagccagctacatcagccaggacatgatctgccccagccccagagtgagcgccagatgcagcagaagcgacatcgagaccgagctgaccccccagagactgcagtgccccatggacaccgaccccccccaggagatcagaagaagattcggcaagaaggtgaccagcttccagcccctgctgttcaccgaggcccacagagagaagttccagagaagctgcctgcaccagaccgtgcagcagttcaagagattcatcgagaactacagaagacacatcggctgcgtggccgtgttctacgccatcgccggcggcctgttcctggagagagcctactactacgccttcgccgcccaccacaccggcatcaccgacaccaccagagtgggcatcatcctgagcagaggcaccgccgccagcatcagcttcatgttcagctacatcctgctgaccatgtgcagaaacctgatcaccttcctgagagagaccttcctgaacagatacgtgcccttcgacgccgccgtggacttccacagactgatcgccagcaccgccatcgtgctgaccgtgctgcacagcgtgggccacgtggtgaacgtgtacctgttcagcatcagccccctgagcgtgctgagctgcctgttccccggcctgttccacgacgacggcagcgagctgccccagaagtactactggtggttcttccagaccgtgcccggcctgaccggcgtggtgctgctgctgatcctggccatcatgtacgtgttcgccagccaccacttcagaagaagaagcttcagaggcttctggctgacccaccacctgtacatcctgctgtacgtgctgctgatcatccacggcagcttcgccctgatccagctgcccagattccacatcttcttcctggtgcccgccatcatctacggcggcgacaagctggtgagcctgagcagaaagaaggtggagatcagcgtggtgaaggccgagctgctgcccagcggcgtgacccacctgagattccagagaccccagggcttcgagtacaagagcggccagtgggtgagaatcgcctgcctggccctgggcaccaccgagtaccaccccttcaccctgaccagcgccccccacgaggacaccctgagcctgcacatcagagccgccggcccctggaccaccagactgagagagatctacagcgcccccaccggcgacagatgcgccagataccccaagctgtacctggacggccccttcggcgagggccaccaggagtggcacaagttcgaggtgagcgtgctggtgggcggcggcatcggcgtgacccccttcgccagcatcctgaaggacctggtgttcaagagcagcgtgagctgccaggtgttctgcaagaagatctacttcatctgggtgaccagaacccagagacagttcgagtggctggccgacatcatcagagaggtggaggagaacgaccaccaggacctggtgagcgtgcacatctacatcacccagctggccgagaagttcgacctgagaaccaccatgctgtacatctgcgagagacacttccagaaggtgctgaacagaagcctgttcaccggcctgagaagcatcacccacttcggcagaccccccttcgagcccttcttcaacagcctgcaggaggtgcacccccaggtgagaaagatcggcgtgttcagctgcggcccccccggcatgaccaagaacgtggagaaggcctgccagctgatcaacagacaggacagaacccacttcagccaccactacgagaacttctag

SEQ ID NO: 79704 - DNA, 4647 bp, Artificial Sequence
  Description of Artificial Sequence: Synthetic coding sequence
atgctgagagccagacccgaggccctgatgctgctgggcgccctgctgaccggcagcctgggccccagcggcaaccaggacgccctgagcctgccctgggaggtgcagagatacgacggctggttcaacaacctgagacaccacgagagaggcgccgtgggctgcagactgcagagaagagtgcccgccaactacgccgacggcgtgtaccaggccctggaggagccccagctgcccaaccccagaagactgagcaacgccgccaccagaggcatcgccggcctgcccagcctgcacaacagaaccgtgctgggcgtgttcttcggctaccacgtgctgagcgacgtggtgagcgtggagacccccggctgccccgccgagttcctgaacatcagaatcccccccggcgaccccgtgttcgaccccgaccagagaggcgacgtggtgctgcccttccagagaagcagatgggaccccgagaccggcagaagccccagcaaccccagagacctggccaaccaggtgaccggctggctggacggcagcgccatctacggcagcagccacagctggagcgacgccctgagaagcttcagcggcggccagctggccagcggccccgaccccgccttccccagagacagccagaaccccctgctgatgtgggccgcccccgaccccgccaccggccagaacggccccagaggcctgtacgccttcggcgccgagagaggcaacagagagcccttcctgcaggccctgggcctgctgtggttcagataccacaacctgtgggcccagagactggccagacagcaccccgactgggaggacgaggagctgttccagcacgccagaaagagagtgatcgccacctaccagaacatcgccgtgtacgagtggctgcccagcttcctgcagaagaccctgcccgagtacaccggctacagacccttcctggaccccagcatcagccccgagttcgtggtggccagcgagcagttcttcagcaccatggtgccccccggcgtgtacatgagaaacgccagctgccacttcagaaaggtgctgaacaagggcttccagagcagccaggccctgagagtgtgcaacaactactggatcagagagaaccccaacctgaacagcacccaggaggtgaacgagctgctgctgggcatggccagccagatcagcgagctggaggacaacatcgtggtggaggacctgagagactactggcccggccccggcaagttcagcagaaccgactacgtggccagcagcatccagagaggcagagacatgggcctgcccagctacagccaggccctgctggccttcggcctggacatccccagaaactggagcgacctgaaccccaacgtggacccccaggtgctggaggccaccgccgccctgtacaaccaggacctgagccagctggagctgctgctgggcggcctgctggagagccacggcgaccccggccccctgttcagcgccatcgtgctggaccagttcgtgagactgagagacggcgacagatactggttcgagaacaccagaaacggcctgttcagcaagaaggagatcgaggacatcagaaacaccaccctgagagacgtgctggtggccgtgatcaacatcgaccccagcgccctgcagcccaacgtgttcgtgtggcacaagggcgccccctgcccccagcccaagcagctgaccaccgacggcctgccccagtgcgcccccctgaccgtgctggacttcttcgagggcagcagccccggcttcgccatcaccatcatcgccctgtgctgcctgcccctggtgagcctgctgctgagcggcgtggtggcctacttcagaggcagagagcacaagaagctgcagaagaagctgaaggagagcgtgaagaaggaggccgccaaggacggcgtgcccgccatggagtggcccggccccaaggagagaagcagccccatcatcatccagctgctgagcgacagatgcctgcaggtgctgaacagacacctgaccgtgctgagagtggtgcagctgcagcccctgcagcaggtgaacctgatcctgagcaacaacagaggctgcagaaccctgctgctgaagatccccaaggagtacgacctggtgctgctgttcagcagcgaggaggagagaggcgccttcgtgcagcagctgtgggacttctgcgtgagatgggccctgggcctgcacgtggccgagatgagcgagaaggagctgttcagaaaggccgtgaccaagcagcagagagagagaatcctggagatcttcttcagacacctgttcgcccaggtgctggacatcaaccaggccgacgccggcaccctgcccctggacagcagccagaaggtgagagaggccctgacctgcgagctgagcagagccgagttcgccgagagcctgggcctgaagccccaggacatgttcgtggagagcatgttcagcctggccgacaaggacggcaacggctacctgagcttcagagagttcctggacatcctggtggtgttcatgaagggcagccccgaggacaagagcagactgatgttcaccatgtacgacctggacgagaacggcttcctgagcaaggacgagttcttcaccatgatgagaagcttcatcgagatcagcaacaactgcctgagcaaggcccagctggccgaggtggtggagagcatgttcagagagagcggcttccaggacaaggaggagctgacctgggaggacttccacttcatgctgagagaccacgacagcgagctgagattcacccagctgtgcgtgaagggcggcggcggcggcggcaacggcatcagagacatcttcaagcagaacatcagctgcagagtgagcttcatcaccagaacccccggcgagagaagccacccccagggcctgggcccccccgcccccgaggcccccgagctgggcggccccggcctgaagaagagattcggcaagaaggccgccgtgcccacccccagactgtacaccgaggccctgcaggagaagatgcagagaggcttcctggcccagaagctgcagcagtacaagagattcgtggagaactacagaagacacatcgtgtgcgtggccatcttcagcgccatctgcgtgggcgtgttcgccgacagagcctactactacggcttcgccagcccccccagcgacatcgcccagaccaccctggtgggcatcatcctgagcagaggcaccgccgccagcgtgagcttcatgttcagctacatcctgctgaccatgtgcagaaacctgatcaccttcctgagagagaccttcctgaacagatacgtgcccttcgacgccgccgtggacttccacagatggatcgccatggccgccgtggtgctggccatcctgcacagcgccggccacgccgtgaacgtgtacatcttcagcgtgagccccctgagcctgctggcctgcatcttccccaacgtgttcgtgaacgacggcagcaagctgccccagaagttctactggtggttcttccagaccgtgcccggcatgaccggcgtgctgctgctgctggtgctggccatcatgtacgtgttcgccagccaccacttcagaagaagaagcttcagaggcttctggctgacccaccacctgtacatcctgctgtacgccctgctgatcatccacggcagctacgccctgatccagctgcccaccttccacatctacttcctggtgcccgccatcatctacggcggcgacaagctggtgagcctgagcagaaagaaggtggagatcagcgtggtgaaggccgagctgctgcccagcggcgtgacctacctgcagttccagagaccccagggcttcgagtacaagagcggccagtgggtgagaatcgcctgcctggccctgggcaccaccgagtaccaccccttcaccctgaccagcgccccccacgaggacaccctgagcctgcacatcagagccgtgggcccctggaccaccagactgagagagatctacagcagccccaagggcaacggctgcgccggctaccccaagctgtacctggacggccccttcggcgagggccaccaggagtggcacaagttcgaggtgagcgtgctggtgggcggcggcatcggcgtgacccccttcgccagcatcctgaaggacctggtgttcaagagcagcctgggcagccagatgctgtgcaagaagatctacttcatctgggtgaccagaacccagagacagttcgagtggctggccgacatcatccaggaggtggaggagaacgaccaccaggacctggtgagcgtgcacatctacgtgacccagctggccgagaagttcgacctgagaaccaccatgctgtacatctgcgagagacacttccagaaggtgctgaacagaagcctgttcaccggcctgagaagcatcacccacttcggcagaccccccttcgagcccttcttcaacagcctgcaggaggtgcacccccaggtgagaaagatcggcgtgttcagctgcggcccccccggcatgaccaagaacgtggagaaggcctgccagctggtgaacagacaggacagagcccacttcatgcaccactacgagaacttctag

SEQ ID NO: 79705 - DNA, 1452 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgaccgccctggccaccttcatcgtgatcctgcccggcatcagaggcaagaccagactgttctggctgctgagagtggtgaccagcctgttcatcggcgccgccatcctggccgtgaacttcagcagcgagtggagcgtgggccaggtgagcaccaacaccagctacaaggccttcagcagcgagtggatcagcgccgacatcggcctgcaggtgggcctgggcggcgtgaacatcaccctgaccggcacccccgtgcagcagctgaacgagaccatcaactacaacgaggagttcacctggagactgggcgagaactacgccgaggagtacgccaaggccctggagaagggcctgcccgaccccgtgctgtacctggccgagaagttcacccccagaagcccctgcggcctgtacagacagtacagactggccggccactacaccagcgccatgctgtgggtggccttcctgtgctggctgctggccaacgtgatgctgagcatgcccgtgctggtgtacggcggctacatgctgctggccaccggcatcttccagctgctggccctgctgttcttcagcatggccaccagcctgaccagcccctgccccctgcacctgggcgccagcgtgctgcacacccaccacggccccgccttctggatcaccctgaccaccggcctgctgtgcgtgctgctgggcctggccatggccgtggcccacagaatgcagccccacagactgaaggccttcttcaaccagagcgtggacgaggaccccatgctggagtggagccccgaggagggcggcctgctgagccccagatacagaagcatggccgacagccccaagagccaggacatccccctgagcgaggccagcagcaccaaggcctactacagacccagaagactgagcctggtgcccgccgacgtgagaggcctggcccccgccgccctgagcgccctgcccggcgccctgctggcccaggcctggagagccctgctgcccggcctgagatgccccaaggccggcaaggagagcagactgggccccccccacagcccctggagattcggccccgagggctgcgaggagagatgggccgagcacaccggcgacagccccagacccctgagaggcagaggcaccggcagactgtggagatggggcagcaaggagagaagagcctgcggcgtgagagccatgctgcccagactggtgagcaacagcggcctgaagagacccagctgcctggacctgcccaagtgctgggactacagaagagacgccagagccttcttccacctgctggagcccaccccctgcgtgaccagcagacacacccccctgatctag

SEQ ID NO: 79706 - DNA, 1317 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgaccgccctggccaccttcatcgtgatcctgcccggcatcagaggcaagaccagactgttctggctgctgagagtggtgaccagcctgttcatcggcgccgccatcctgggcacccccgtgcagcagctgaacgagaccatcaactacaacgaggagttcacctggagactgggcgagaactacgccgaggagtacgccaaggccctggagaagggcctgcccgaccccgtgctgtacctggccgagaagttcacccccagaagcccctgcggcctgtacagacagtacagactggccggccactacaccagcgccatgctgtgggtggccttcctgtgctggctgctggccaacgtgatgctgagcatgcccgtgctggtgtacggcggctacatgctgctggccaccggcatcttccagctgctggccctgctgttcttcagcatggccaccagcctgaccagcccctgccccctgcacctgggcgccagcgtgctgcacacccaccacggccccgccttctggatcaccctgaccaccggcctgctgtgcgtgctgctgggcctggccatggccgtggcccacagaatgcagccccacagactgaaggccttcttcaaccagagcgtggacgaggaccccatgctggagtggagccccgaggagggcggcctgctgagccccagatacagaagcatggccgacagccccaagagccaggacatccccctgagcgaggccagcagcaccaaggcctactacagacccagaagactgagcctggtgcccgccgacgtgagaggcctggcccccgccgccctgagcgccctgcccggcgccctgctggcccaggcctggagagccctgctgcccggcctgagatgccccaaggccggcaaggagagcagactgggccccccccacagcccctggagattcggccccgagggctgcgaggagagatgggccgagcacaccggcgacagccccagacccctgagaggcagaggcaccggcagactgtggagatggggcagcaaggagagaagagcctgcggcgtgagagccatgctgcccagactggtgagcaacagcggcctgaagagacccagctgcctggacctgcccaagtgctgggactacagaagagacgccagagccttcttccacctgctggagcccaccccctgcgtgaccagcagacacacccccctgatctag

SEQ ID NO: 79707 - DNA, 234 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgaccgccctggccaccttcatcgtgatcctgcccggcatcagaggcaagaccagactgttctggctgctgagagtggtgaccagcctgttcatcggcgccgccatcctgggcacccccgtgcagcagctgaacgagtag

SEQ ID NO: 79708 - DNA, 219 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgaccgccctggccaccttcatcgtgatcctgcccggcatcagaggcaagaccagactgttctggctgctgagagtggtgaccagcctgttcatcggcgccgccatcctggccgtgaacttctag

SEQ ID NO: 79709 - DNA, 897 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgaccgccctggccaccttcatcgtgatcctgcccggcatcagaggcaagaccagactgttctggctgctgagagtggtgaccagcctgttcatcggcgccgccatcctgggcacccccgtgcagcagctgaacgagaccatcaactacaacgaggagttcacctggagactgggcgagaactacgccgaggagtacgccaaggccctggagaagggcctgcccgaccccgtgctgtacctggccgagaagttcacccccagaagcccctgcggcctgtacagacagtacagactggccggccactacaccagcgccatgctgtgggtggccttcctgtgctggctgctggccaacgtgatgctgagcatgcccgtgctggtgtacggcggctacatgctgctggccaccggcatcttccagctgctggccctgctgttcttcagcatggccaccagcctgaccagcccctgccccctgcacctgggcgccagcgtgctgcacacccaccacggccccgccttctggatcaccctgaccaccggcctgctgtgcgtgctgctgggcctggccatggccgtggcccacagaatgcagccccacagactgaaggccttcttcaaccagagcgtggacgaggaccccatgctggagtggagccccgaggagggcggcctgctgagccccagatacagaagcatggccgacagccccaagagccaggacatccccctgagcgaggccagcagcaccaaggcctactgcaaggaggcccaccccaaggaccccgactgcgccctgtag

SEQ ID NO: 79710 - DNA, 42 bp, Artificial Sequence
  Description of Artificial Sequence: Synthetic coding sequence
atggccaccctgggccacaccttccccttctacgccggctag

SEQ ID NO: 79711 - DNA, 897 bp, Artificial Sequence; identical to SEQ ID NO: 79709
  Description of Artificial Sequence: Synthetic coding sequence

SEQ ID NO: 79712 - DNA, 1452 bp, Artificial Sequence; identical to SEQ ID NO: 79705
  Description of Artificial Sequence: Synthetic coding sequence

SEQ ID NO: 79713 - DNA, 219 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgaccgccctggccaccttcatcgtgatcctgcccggcatcagaggcaagaccagactgttctggctgctgagagtggtgaccagcctgttcatcggcgccgccatcctgggcacccccgtgtag

SEQ ID NO: 79714 - DNA, 51 bp, Artificial Sequence
  Description of Artificial Sequence: Synthetic coding sequence
atggccaccctgggccacaccttccccttctacgccggccccaagccctag

SEQ ID NO: 79715 - DNA, 366 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgaccgccctggccaccttcatcgtgatcctgcccggcatcagaggcaagaccagactgttctggctgctgagagtggtgaccagcctgttcatcggcgccgccatcctggccgtgaacttcagcagcgagtggagcgtgggccaggtgagcaccaacaccagctacaaggccttcagcagcgagtggatcagcgccgacatcggcctgcaggtgggcctgggcggcgtgaacatcaccctgaccggcacccccgtgcagcagctgaactag

SEQ ID NO: 79716 - DNA, 1032 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgaccgccctggccaccttcatcgtgatcctgcccggcatcagaggcaagaccagactgttctggctgctgagagtggtgaccagcctgttcatcggcgccgccatcctggccgtgaacttcagcagcgagtggagcgtgggccaggtgagcaccaacaccagctacaaggccttcagcagcgagtggatcagcgccgacatcggcctgcaggtgggcctgggcggcgtgaacatcaccctgaccggcacccccgtgcagcagctgaacgagaccatcaactacaacgaggagttcacctggagactgggcgagaactacgccgaggagtacgccaaggccctggagaagggcctgcccgaccccgtgctgtacctggccgagaagttcacccccagaagcccctgcggcctgtacagacagtacagactggccggccactacaccagcgccatgctgtgggtggccttcctgtgctggctgctggccaacgtgatgctgagcatgcccgtgctggtgtacggcggctacatgctgctggccaccggcatcttccagctgctggccctgctgttcttcagcatggccaccagcctgaccagcccctgccccctgcacctgggcgccagcgtgctgcacacccaccacggccccgccttctggatcaccctgaccaccggcctgctgtgcgtgctgctgggcctggccatggccgtggcccacagaatgcagccccacagactgaaggccttcttcaaccagagcgtggacgaggaccccatgctggagtggagccccgaggagggcggcctgctgagccccagatacagaagcatggccgacagccccaagagccaggacatccccctgagcgaggccagcagcaccaaggcctactgcaaggaggcccaccccaaggaccccgactgcgccctgtag

SEQ ID NO: 79717 - DNA, 963 bp, Artificial Sequence
  Description of Artificial Sequence: Synthetic coding sequence
atgaccctgtggaacggcgtgctgcccttctacccccagcccagacacgccgccggcttcagcgtgcccctgctgatcgtgatcctggtgttcctggccctggccgccagcttcctgctgatcctgcccggcatcagaggccacagcagatggttctggctggtgagagtgctgctgagcctgttcatcggcgccgagatcgtggccgtgcacttcagcgccgagtggttcgtgggcaccgtgaacaccaacaccagctacaaggccttcagcgccgccagagtgaccgccagagtgagactgctggtgggcctggagggcatcaacatcaccctgaccggcacccccgtgcaccagctgaacgagaccatcgactacaacgagcagttcacctggagactgaaggagaactacgccgccgagtacgccaacgccctggagaagggcctgcccgaccccgtgctgtacctggccgagaagttcacccccagcagcccctgcggcctgtaccaccagtaccacctggccggccactacgccagcgccaccctgtgggtggccttctgcttctggctgctgagcaacgtgctgctgagcacccccgcccccctgtacggcggcctggccctgctgaccaccggcgccttcgccctgttcggcgtgttcgccctggccagcatcagcagcgtgcccctgtgccccctgagactgggcagcagcgccctgaccacccagtacggcgccgccttctgggtgaccctggccaccggcgtgctgtgcctgttcctgggcggcgccgtggtgagcctgcagtacgtgagacccagcgccctgagaaccctgctggaccagagcgccaaggactgcagccaggagagaggcggcagccccctgatcctgggcgaccccctgcacaagcaggccgccctgcccgacctgaagtgcatcaccaccaacctgtag

SEQ ID NO: 79718 - DNA, 1767 bp, Artificial Sequence
  Description of Artificial Sequence: Synthetic coding sequence
atggagggcgacggcgtgccctggggcagcgagcccgtgagcggccccggccccggcggcggcggcatgatcagagagctgtgcagaggcttcggcagatacagaagatacctgggcagactgagacagaacctgagagagacccagaagttcttcagagacatcaagtgcagccacaaccacacctgcctgagcagcctgaccggcggcggcggcgccgagagaggccccgccggcgacgtggccgagaccggcctgcaggccggccagctgagctgcatcagcttcccccccaaggaggagaagtacctgcagcagatcgtggactgcctgccctgcatcctgatcctgggccaggactgcaacgtgaagtgccagctgctgaacctgctgctgggcgtgcaggtgctgcccaccaccaagctgggcagcgaggagagctgcaagctgagaagactgagattcacctacggcacccagaccagagtgagcctggccctgcccggccagtacgagctggtgcacaccctggtggcccaccagggcaactgggagaccatccccgaggaggacctggaggtgcaggagaacaacgaggacgccgcccacgtgctggccgagctggaggtgaccatgcaccacgccctgctgcaggaggtggacgtggtggtggccccctgccagggcctgagacccaccgtggacgtgctgggcgacctggtgaacgacttcctgcccgtgatcacctacgccctgcacaaggacgagctgagcgagagagacgagcaggagctgcaggagatcagaaagtacttcagcttccccgtgttcttcttcaaggtgcccaagctgggcagcgagatcatcgacagcagcaccagaagaatggagagcgagagaagccccctgtacagacagctgatcgacctgggctacctgagcagcagccactggaactgcggcgcccccggccaggacaccaaggcccagagcatgctggtggagcagagcgagaagctgagacacctgagcaccttcagccaccaggtgctgcagaccagactggtggacgccgccaaggccctgaacctggtgcactgccactgcctggacatcttcatcaaccaggccttcgacatgcagagagacctgcagatcacccccaagagactggagtacaccagaaagaaggagaacgagctgtacgagagcctgatgaacatcgccaacagaaagcaggaggagatgaaggacatgatcgtggagaccctgaacaccatgaaggaggagctgctggacgacgccaccaacatggagttcaaggacgtgatcgtgcccgagaacggcgagcccatcaccgacctgggcttctgcaagcccgaggccatgatgagcggcagcatcgtgggcacccccatccacatggcccccgagctgttcaccggcaagtacgacaacagcgtggacgtgtacgccttcggcatcctgttctggtacatctgcagcggcagcgtgaagctgcccgaggccttcgagagatgcgccagcaaggaccacctgtggaacaacgtgagaagaggcgccagacccgagagactgcccgtgttcgacgaggagtgctggcagctgatggaggcctgctgggacggcgaccccctgaagagacccctgctgggcatcgtgcagcccatgctgcagggcatcatgaacagactgtgcaagagcaacagcgagcagcccaacagaggcctggacgacagcacctag

SEQ ID NO: 79719 - DNA, 2655 bp, Artificial Sequence
  Description of Artificial Sequence: Synthetic coding sequence
atggagggcgacggcgtgccctggggcagcgagcccgtgagcggccccggccccggcggcggcggcatgatcagagagctgtgcagaggcttcggcagatacagaagatacctgggcagactgagacagaacctgagagagacccagaagttcttcagagacatcaagtgcagccacaaccacacctgcctgagcagcctgaccggcggcggcggcgccgagagaggccccgccggcgacgtggccgagaccggcctgcaggccggccagctgagctgcatcagcttcccccccaaggaggagaagtacctgcagcagatcgtggactgcctgccctgcatcctgatcctgggccaggactgcaacgtgaagtgccagctgctgaacctgctgctgggcgtgcaggtgctgcccaccaccaagctgggcagcgaggagagctgcaagctgagaagactgagattcacctacggcacccagaccagagtgagcctggccctgcccggccagtacgagctggtgcacaccctggtggcccaccagggcaactgggagaccatccccgaggaggacctggaggtgcaggagaacaacgaggacgccgcccacgtgctggccgagctggaggtgaccatgcaccacgccctgctgcaggaggtggacgtggtggtggccccctgccagggcctgagacccaccgtggacgtgctgggcgacctggtgaacgacttcctgcccgtgatcacctacgccctgcacaaggacgagctgagcgagagagacgagcaggagctgcaggagatcagaaagtacttcagcttccccgtgttcttcttcaaggtgcccaagctgggcagcgagatcatcgacagcagcaccagaagaatggagagcgagagaagccccctgtacagacagctgatcgacctgggctacctgagcagcagccactggaactgcggcgcccccggccaggacaccaaggcccagagcatgctggtggagcagagcgagaagctgagacacctgagcaccttcagccaccaggtgctgcagaccagactggtggacgccgccaaggccctgaacctggtgcactgccactgcctggacatcttcatcaaccaggccttcgacatgcagagagacctgcagatcacccccaagagactggagtacaccagaaagaaggagaacgagctgtacgagagcctgatgaacatcgccaacagaaagcaggaggagatgaaggacatgatcgtggagaccctgaacaccatgaaggaggagctgctggacgacgccaccaacatggagttcaaggacgtgatcgtgcccgagaacggcgagcccgtgggcaccagagagatcaagtgctgcatcagacagatccaggagctgatcatcagcagactgaaccaggccgtggccaacaagctgatcagcagcgtggactacctgagagagagcttcgtgggcaccctggagagatgcctgcagagcctggagaagagccaggacgtgagcgtgcacatcaccagcaactacctgaagcagatcctgaacgccgcctaccacgtggaggtgaccttccacagcggcagcagcgtgaccagaatgctgtgggagcagatcaagcagatcatccagagaatcacctgggtgagcccccccgccatcaccctggagtggaagagaaaggtggcccaggaggccatcgagagcctgagcgccagcaagctggccaagagcatctgcagccagttcagaaccagactgaacagcagccacgaggccttcgccgccagcctgagacagctggaggccggccacagcggcagactggagaagaccgaggacctgtggctgagagtgagaaaggaccacgcccccagactggccagactgagcctggagagctgcagcctgcaggacgtgctgctgcacagaaagcccaagctgggccaggagctgggcagaggccagtacggcgtggtgtacctgtgcgacaactggggcggccacttcccctgcgccctgaagagcgtggtgccccccgacgagaagcactggaacgacctggccctggagttccactacatgagaagcctgcccaagcacgagagactggtggacctgcacggcagcgtgatcgactacaactacggcggcggcagcagcatcgccgtgctgctgatcatggagagactgcacagagacctgtacaccggcctgaaggccggcctgaccctggagaccagactgcagatcgccctggacgtggtggagggcatcagattcctgcacagccagggcctggtgcacagagacatcaagctgaagaacgtgctgctggacaagcagaacagagccaagatcaccgacctgggcttctgcaagcccgaggccatgatgagcggcagcatcgtgggcacccccatccacatggcccccgagctgttcaccggcgccagacccgagagactgcccgtgttcgacgaggagtgctggcagctgatggaggcctgctgggacggcgaccccctgaagagacccctgctgggcatcgtgcagcccatgctgcagggcatcatgaacagactgtgcaagagcaacagcgagcagcccaacagaggcctggacgacagcacctag

SEQ ID NO: 79720 - DNA, 2790 bp, Artificial Sequence
  Description of Artificial Sequence: Synthetic coding sequence
atggagggcgacggcgtgccctggggcagcgagcccgtgagcggccccggccccggcggcggcggcatgatcagagagctgtgcagaggcttcggcagatacagaagatacctgggcagactgagacagaacctgagagagacccagaagttcttcagagacatcaagtgcagccacaaccacacctgcctgagcagcctgaccggcggcggcggcgccgagagaggccccgccggcgacgtggccgagaccggcctgcaggccggccagctgagctgcatcagcttcccccccaaggaggagaagtacctgcagcagatcgtggactgcctgccctgcatcctgatcctgggccaggactgcaacgtgaagtgccagctgctgaacctgctgctgggcgtgcaggtgctgcccaccaccaagctgggcagcgaggagagctgcaagctgagaagactgagattcacctacggcacccagaccagagtgagcctggccctgcccggccagtacgagctggtgcacaccctggtggcccaccagggcaactgggagaccatccccgaggaggacctggaggtgcaggagaacaacgaggacgccgcccacgtgctggccgagctggaggtgaccatgcaccacgccctgctgcaggaggtggacgtggtggtggccccctgccagggcctgagacccaccgtggacgtgctgggcgacctggtgaacgacttcctgcccgtgatcacctacgccctgcacaaggacgagctgagcgagagagacgagcaggagctgcaggagatcagaaagtacttcagcttccccgtgttcttcttcaaggtgcccaagctgggcagcgagatcatcgacagcagcaccagaagaatggagagcgagagaagccccctgtacagacagctgatcgacctgggctacctgagcagcagccactggaactgcggcgcccccggccaggacaccaaggcccagagcatgctggtggagcagagcgagaagctgagacacctgagcaccttcagccaccaggtgctgcagaccagactggtggacgccgccaaggccctgaacctggtgcactgccactgcctggacatcttcatcaaccaggccttcgacatgcagagagacctgcagatcacccccaagagactggagtacaccagaaagaaggagaacgagctgtacgagagcctgatgaacatcgccaacagaaagcaggaggagatgaaggacatgatcgtggagaccctgaacaccatgaaggaggagctgctggacgacgccaccaacatggagttcaaggacgtgatcgtgcccgagaacggcgagcccgtgggcaccagagagatcaagtgctgcatcagacagatccaggagctgatcatcagcagactgaaccaggccgtggccaacaagctgatcagcagcgtggactacctgagagagagcttcgtgggcaccctggagagatgcctgcagagcctggagaagagccaggacgtgagcgtgcacatcaccagcaactacctgaagcagatcctgaacgccgcctaccacgtggaggtgaccttccacagcggcagcagcgtgaccagaatgctgtgggagcagatcaagcagatcatccagagaatcacctgggtgagcccccccgccatcaccctggagtggaagagaaaggtggcccaggaggccatcgagagcctgagcgccagcaagctggccaagagcatctgcagccagttcagaaccagactgaacagcagccacgaggccttcgccgccagcctgagacagctggaggccggccacagcggcagactggagaagaccgaggacctgtggctgagagtgagaaaggaccacgcccccagactggccagactgagcctggagagctgcagcctgcaggacgtgctgctgcacagaaagcccaagctgggccaggagctgggcagaggccagtacggcgtggtgtacctgtgcgacaactggggcggccacttcccctgcgccctgaagagcgtggtgccccccgacgagaagcactggaacgacctggccctggagttccactacatgagaagcctgcccaagcacgagagactggtggacctgcacggcagcgtgatcgactacaactacggcggcggcagcagcatcgccgtgctgctgatcatggagagactgcacagagacctgtacaccggcctgaaggccggcctgaccctggagaccagactgcagatcgccctggacgtggtggagggcatcagattcctgcacagccagggcctggtgcacagagacatcaagctgaagaacgtgctgctggacaagcagaacagagccaagatcaccgacctgggcttctgcaagcccgaggccatgatgagcggcagcatcgtgggcacccccatccacatggcccccgagctgttcaccggcaagtacgacaacagcgtggacgtgtacgccttcggcatcctgttctggtacatctgcagcggcagcgtgaagctgcccgaggccttcgagagatgcgccagcaaggaccacctgtggaacaacgtgagaagaggcgccagacccgagagactgcccgtgttcgacgaggagtgctggcagctgatggaggcctgctgggacggcgaccccctgaagagacccctgctgggcatcgtgcagcccatgctgcagggcatcatgaacagactgtgcaagagcaacagcgagcagcccaacagaggcctggacgacagcacctag

SEQ ID NO: 79721 - DNA, 1104 bp, Artificial Sequence
  Description of Artificial Sequence: Synthetic coding sequence
atggtgatggaggtgggcaccctggacgccggcggcctgagagccctgctgggcgagagagccgcccagtgcctgctgctggactgcagaagcttcttcgccttcaacgccggccacatcgccggcagcgtgaacgtgagattcagcaccatcgtgagaagaagagccaagggcgccatgggcctggagcacatcgtgcccaacgccgagctgagaggcagactgctggccggcgcctaccacgccgtggtgctgctggacgagagaagcgccgccctggacggcgccaagagagacggcaccctggccctggccgccggcgccctgtgcagagaggccagagccgcccaggtgttcttcctgaagggcggctacgaggccttcagcgccagctgccccgagctgtgcagcaagcagagcacccccatgggcctgagcctgcccctgagcaccagcgtgcccgacagcgccgagagcggctgcagcagctgcagcacccccctgtacgaccagggcggccccgtggagatcctgcccttcctgtacctgggcagcgcctaccacgccagcagaaaggacatgctggacgccctgggcatcaccgccctgatcaacgtgagcgccaactgccccaaccacttcgagggccactaccagtacaagagcatccccgtggaggacaaccacaaggccgacatcagcagctggttcaacgaggccatcgacttcatcgacagcatcaagaacgccggcggcagagtgttcgtgcactgccaggccggcatcagcagaagcgccaccatctgcctggcctacctgatgagaaccaacagagtgaagctggacgaggccttcgagttcgtgaagcagagaagaagcatcatcagccccaacttcagcttcatgggccagctgctgcagttcgagagccaggtgctggccccccactgcagcgccgaggccggcagccccgccatggccgtgctggacagaggcaccagcaccaccaccgtgttcaacttccccgtgagcatccccgtgcacagcaccaacagcgccctgagctacctgcagagccccatcaccaccagccccagctgctag

SEQ ID NO: 79722 - DNA, 909 bp, Artificial Sequence
  Description of Artificial Sequence: Synthetic coding sequence
atggtgatggaggtgggcaccctggacgccggcggcctgagagccctgctgggcgagagagccgcccagtgcctgctgctggactgcagaagcttcttcgccttcaacgccggccacatcgccggcagcgtgaacgtgagattcagcgccgcccaggtgttcttcctgaagggcggctacgaggccttcagcgccagctgccccgagctgtgcagcaagcagagcacccccatgggcctgagcctgcccctgagcaccagcgtgcccgacagcgccgagagcggctgcagcagctgcagcacccccctgtacgaccagggcggccccgtggagatcctgcccttcctgtacctgggcagcgcctaccacgccagcagaaaggacatgctggacgccctgggcatcaccgccctgatcaacgtgagcgccaactgccccaaccacttcgagggccactaccagtacaagagcatccccgtggaggacaaccacaaggccgacatcagcagctggttcaacgaggccatcgacttcatcgacagcatcaagaacgccggcggcagagtgttcgtgcactgccaggccggcatcagcagaagcgccaccatctgcctggcctacctgatgagaaccaacagagtgaagctggacgaggccttcgagttcgtgaagcagagaagaagcatcatcagccccaacttcagcttcatgggccagctgctgcagttcgagagccaggtgctggccccccactgcagcgccgaggccggcagccccgccatggccgtgctggacagaggcaccagcaccaccaccgtgttcaacttccccgtgagcatccccgtgcacagcaccaacagcgccctgagctacctgcagagccccatcaccaccagccccagctgctag

SEQ ID NO: 79723 - DNA, 1023 bp, Artificial Sequence
  Description of Artificial Sequence: Synthetic coding sequence
atggtgatggaggtgggcaccctggacgccggcggcctgagagccctgctgggcgagagagccgcccagtgcctgctgctggactgcagaagcttcttcgccttcaacgccggccacatcgccggcagcgtgaacgtgagattcagcaccatcgtgagaagaagagccaagggcgccatgggcctggagcacatcgtgcccaacgccaagagagacggcaccctggccctggccgccggcgccctgtgcagagaggccagagccgcccaggtgttcttcctgaagggcggctacgaggccttcagcgccagctgccccgagctgtgcagcaagcagagcacccccatgggcctgagcctgcccctgagcaccagcgtgcccgacagcgccgagagcggctgcagcagctgcagcacccccctgtacgaccagggcggccccgtggagatcctgcccttcctgtacctgggcagcgcctaccacgccagcagaaaggacatgctggacgccctgggcatcaccgccctgatcaacgtgagcgccaactgccccaaccacttcgagggccactaccagtacaagagcatccccgtggaggacaaccacaaggccgacatcagcagctggttcaacgaggccatcgacttcatcgacagcatcaagaacgccggcggcagagtgttcgtgcactgccaggccggcatcagcagaagcgccaccatctgcctggcctacctgatgagaaccaacagagtgaagctggacgaggccttcgagttcgtgaagcagagaagaagcatcatcagccccaacttcagcttcatgggccagctgctgcagttcgagagccaggtgctggccccccactgcagcgccgaggccggcagccccgccatggccgtgctggacagaggcaccagcaccaccaccgtgttcaacttccccgtgagcatccccgtgcacagcaccaacagcgccctgagctacctgcagagccccatcaccaccagccccagctgctag

SEQ ID NO: 79724 - DNA, 1134 bp, Artificial Sequence
  Description of Artificial Sequence: Synthetic coding sequence
atgagaaacagcgagaccctggagagaggcgtgggcggctgcagagtgttcagctgcctgggcagctaccccggcatcgagggcgccggcctggccctgctggccgacctggccctgggcggcagactgctgggcacccacatgagccagtggcaccaccccagaagcggctggggcagaagaagagacttcagcggcagaagcagcgccaagaagaagggcggcaaccacatccccgagagatggaaggactacctgcccgtgggccagagaatgcccggcaccagattcatcgccttcaaggtgcccctgcagaagagcttcgagaagaagctggcccccgaggagtgcttcagccccctggacctgttcaacaagatcagagagcagaacgaggagctgggcctgatcatcgacctgacctacacccagagatactacaagcccgaggacctgcccgagaccgtgccctacctgaagatcttcaccgtgggccaccaggtgcccgacgacgagaccatcttcaagttcaagcacgccgtgaacggcttcctgaaggagaacaaggacaacgacaagctgatcggcgtgcactgcacccacggcctgaacagaaccggctacctgatctgcagatacctgatcgacgtggagggcgtgagacccgacgacgccatcgagctgttcaacagatgcagaggccactgcctggagagacagaactacatcgaggacctgcagaacggccccatcagaaagaactggaacagcagcgtgcccagaagcagcgacttcgaggacagcgcccacctgatgcagcccgtgcacaacaagcccgtgaagcagggccccagatacaacctgcaccagatccagggccacagcgcccccagacacttccacacccagacccagagcctgcagcagagcgtgagaaagttcagcgagaacccccacgtgtaccagagacaccacctgcccccccccggcccccccggcgaggactacagccacagaagatacagctggaacgtgaagcccaacgccagcagagccgcccaggacagaagaagatggtacccctacaactacagcagactgagctaccccgcctgctgggagtggacccagtag

SEQ ID NO: 79725 - DNA, 681 bp, Artificial Sequence
  Description of Artificial Sequence: Synthetic coding sequence
atgagccagtggcaccaccccagaagcggctggggcagaagaagagacttcagcggcagaagcagcgccaagaagaagggcggcaaccacatccccgagagatggaaggactacctgcccgtgggccagagaatgcccggcaccagattcatcgccttcaaggtgcccctgcagaagagcttcgagaagaagctggcccccgaggagtgcttcagccccctggacctgttcaacaagatcagagagcagaacgaggagctgggcctgatcatcgacctgacctacacccagagatactacaagcccgaggacctgcccgagaccgtgccctacctgaagatcttcaccgtgggccaccaggtgcccgacgacgagaccatcttcaagttcaagcacgccgtgaacggcttcctgaaggagaacaaggacaacgacaagctgatcggcgtgcactgcacccacggcctgaacagaaccggctacctgatctgcagaagaagcctggccctgagccccagactggagtgcagcggcaccatcagcacccacagcaagttctgcttccccggcagcagaagaagccccgccagcgccagccaggtggccggcaccaccggcgccagacaccacgccagactgatcttctgcatcttcagcagagacgtggtgagcccctgctag

SEQ ID NO: 79726 - DNA, 822 bp, Artificial Sequence
  Description of Artificial Sequence: Synthetic coding sequence
atgagaaacagcgagaccctggagagaggcgtgggcggctgcagagtgttcagctgcctgggcagctaccccggcatcgagggcgccggcctggccctgctggccgacctggccctgggcggcagactgctgggcacccacatgagccagtggcaccaccccagaagcggctggggcagaagaagagacttcagcggcagaagcagcgccaagaagaagggcggcaaccacatccccgagagatggaaggactacctgcccgtgggccagagaatgcccggcaccagattcatcgccttcaaggtgcccctgcagaagagcttcgagaagaagctggcccccgaggagtgcttcagccccctggacctgttcaacaagatcagagagcagaacgaggagctgggcctgatcatcgacctgacctacacccagagatactacaagcccgaggacctgcccgagaccgtgccctacctgaagatcttcaccgtgggccaccaggtgcccgacgacgagaccatcttcaagttcaagcacgccgtgaacggcttcctgaaggagaacaaggacaacgacaagctgatcggcgtgcactgcacccacggcctgaacagaaccggctacctgatctgcagaagaagcctggccctgagccccagactggagtgcagcggcaccatcagcacccacagcaagttctgcttccccggcagcagaagaagccccgccagcgccagccaggtggccggcaccaccggcgccagacaccacgccagactgatcttctgcatcttcagcagagacgtggtgagcccctgctag

SEQ ID NO: 79727 - DNA, 597 bp, Artificial Sequence
  Description of Artificial Sequence: Synthetic coding sequence
atggacagcctgcagaagcaggacctgagaagacccaagatccacggcgccgtgcaggccagcccctaccagccccccaccctggccagcctgcagagactgctgtgggtgagacaggccgccaccctgaaccacatcgacgaggtgtggcccagcctgttcctgggcgacgcctacgccgccagagacaagagcaagctgatccagctgggcatcacccacgtggtgaacgccgccgccggcaagttccaggtggacaccggcgccaagttctacagaggcatgagcctggagtactacggcatcgaggccgacgacaaccccttcttcgacctgagcgtgtacttcctgcccgtggccagatacatcagagccgccctgagcgtgccccagggcagagtgctggtgcactgcgccatgggcgtgagcagaagcgccaccctggtgctggccttcctgatgatctgcgagaacatgaccctggtggaggccatccagaccgtgcaggcccacagaaacatctgccccaacagcggcttcctgagacagctgcaggtgctggacaacagactgggcagagagaccggcagattctag

SEQ ID NO: 79728 - DNA, 747 bp, Artificial Sequence
  Description of Artificial Sequence: Synthetic coding sequence
atggccgagaccagcctgcccgagctgggcggcgaggacaaggccaccccctgccccagcatcctggagctggaggagctgctgagagccggcaagagcagctgcagcagagtggacgaggtgtggcccaacctgttcatcggcgacgccatggacagcctgcagaagcaggacctgagaagacccaagatccacggcgccgtgcaggccagcccctaccagccccccaccctggccagcctgcagagactgctgtgggtgagacaggccgccaccctgaaccacatcgacgaggtgtggcccagcctgttcctgggcgacgcctacgccgccagagacaagagcaagctgatccagctgggcatcacccacgtggtgaacgccgccgccggcaagttccaggtggacaccggcgccaagttctacagaggcatgagcctggagtactacggcatcgaggccgacgacaaccccttcttcgacctgagcgtgtacttcctgcccgtggccagatacatcagagccgccctgagcgtgccccagggcagagtgctggtgcactgcgccatgggcgtgagcagaagcgccaccctggtgctggccttcctgatgatctgcgagaacatgaccctggtggaggccatccagaccgtgcaggcccacagaaacatctgccccaacagcggcttcctgagacagctgcaggtgctggacaacagactgggcagagagaccggcagattctag

SEQ ID NO: 79729 - DNA, 567 bp, Artificial Sequence
  Description of Artificial Sequence: Synthetic coding sequence
atggccgagaccagcctgcccgagctgggcggcgaggacaaggccaccccctgccccagcatcctggagctggaggagctgctgagagccggcaagagcagctgcagcagagtggacgaggtgtggcccaacctgttcatcggcgacgccgccaccgccaacaacagattcgagctgtggaagctgggcatcacccacgtgctgaacgccgcccacaagggcctgtactgccagggcggccccgacttctacggcagcagcgtgagctacctgggcgtgcccgcccacgacctgcccgacttcgacatcagcgcctacttcagcagcgccgccgacttcatccacagagccctgaacacccccggcgccaaggtgctggtgcactgcgtggtgggcgtgagcagaagcgccaccctggtgctggcctacctgatgctgcaccagagactgagcctgagacaggccgtgatcaccgtgagacagcacagatgggtgttccccaacagaggcttcctgcaccagctgtgcagactggaccagcagctgagaggcgccggccagagctag

SEQ ID NO: 79730 - DNA, 876 bp, Artificial Sequence
  Description of Artificial Sequence: Synthetic coding sequence
atgggcctgtgccacttcgccaccctggccctgatcctgctggtgctgctggaggccctggcccaggccgacacccagaagatggtggaggcccagagaggcgtgggccccagagcctgctacagcatctggctgctgctggcccccaccccccccctgagccactgcctgcagagcccccagaagcagcaccaggtgtgcggcgacagaagactgaaggccagcagcaccaactgccccagcgagaagtgcaccgcctgggccagatacagccacagaatggacagcctgcagaagcaggacctgagaagacccaagatccacggcgccgtgcaggccagcccctaccagccccccaccctggccagcctgcagagactgctgtgggtgagacaggccgccaccctgaaccacatcgacgaggtgtggcccagcctgttcctgggcgacgcctacgccgccagagacaagagcaagctgatccagctgggcatcacccacgtggtgaacgccgccgccggcaagttccaggtggacaccggcgccaagttctacagaggcatgagcctggagtactacggcatcgaggccgacgacaaccccttcttcgacctgagcgtgtacttcctgcccgtggccagatacatcagagccgccctgagcgtgccccagggcagagtgctggtgcactgcgccatgggcgtgagcagaagcgccaccctggtgctggccttcctgatgatctgcgagaacatgaccctggtggaggccatccagaccgtgcaggcccacagaaacatctgccccaacagcggcttcctgagacagctgcaggtgctggacaacagactgggcagagagaccggcagattctag

SEQ ID NO: 79731 - DNA, 597 bp, Artificial Sequence; identical to SEQ ID NO: 79727
  Description of Artificial Sequence: Synthetic coding sequence

SEQ ID NO: 79732 - DNA, 984 bp, Artificial Sequence
  Description of Artificial Sequence: Synthetic coding sequence
atgggcctgccccagcccagactgcccgcccccgccctgcaggccggccccgccaccgccggctgcagacccgagctgagaggccagagctggagcctgctgcccgccatgggcctgtgccacttcgccaccctggccctgatcctgctggtgctgctggaggccctggcccaggccgacacccagaagatggtggaggcccagagaggcgtgggccccagagcctgctacagcatctggctgctgctggcccccaccccccccctgagccactgcctgcagagcccccagaagcagcaccaggtgtgcggcgacagaagactgaaggccagcagcaccaactgccccagcgagaagtgcaccgcctgggccagatacagccacagaatggacagcctgcagaagcaggacctgagaagacccaagatccacggcgccgtgcaggccagcccctaccagccccccaccctggccagcctgcagagactgctgtgggtgagacaggccgccaccctgaaccacatcgacgaggtgtggcccagcctgttcctgggcgacgcctacgccgccagagacaagagcaagctgatccagctgggcatcacccacgtggtgaacgccgccgccggcaagttccaggtggacaccggcgccaagttctacagaggcatgagcctggagtactacggcatcgaggccgacgacaaccccttcttcgacctgagcgtgtacttcctgcccgtggccagatacatcagagccgccctgagcgtgccccagggcagagtgctggtgcactgcgccatgggcgtgagcagaagcgccaccctggtgctggccttcctgatgatctgcgagaacatgaccctggtggaggccatccagaccgtgcaggcccacagaaacatctgccccaacagcggcttcctgagacagctgcaggtgctggacaacagactgggcagagagaccggcagattctag

SEQ ID NO: 79733 - DNA, 597 bp, Artificial Sequence
  Description of Artificial Sequence: Synthetic coding sequence
atgagcagcagaggccacagcaccctgcccagaaccctgatggcccccagaatgatcagcgagggcgacatcggcggcatcgcccagatcaccagcagcctgttcctgggcagaggcagcgtggccagcaacagacacctgctgcaggccagaggcatcacctgcatcgtgaacgccaccatcgagatccccaacttcaactggccccagttcgagtacgtgaaggtgcccctggccgacatgccccacgcccccatcggcctgtacttcgacaccgtggccgacaagatccacagcgtgagcagaaagcacggcgccaccctggtgcactgcgccgccggcgtgagcagaagcgccaccctgtgcatcgcctacctgatgaagttccacaacgtgtgcctgctggaggcctacaactgggtgaaggccagaagacccgtgatcagacccaacgtgggcttctggagacagctgatcgactacgagagacagctgttcggcaagagcaccgtgaagatggtgcagaccccctacggcatcgtgcccgacgtgtacgagaaggagagcagacacctgatgccctactggggcatctag

SEQ ID NO: 79734 - DNA, 597 bp, Artificial Sequence; identical to SEQ ID NO: 79733
  Description of Artificial Sequence: Synthetic coding sequence

SEQ ID NO: 79735 - DNA, 945 bp, Artificial Sequence
  Description of Artificial Sequence: Synthetic coding sequence
atgggcctggaggccgccagagagctggagtgcgccgccctgggcaccctgctgagagaccccagagaggccgagagaaccctgctgctggactgcagacccttcctggccttctgcagaagacacgtgagagccgccagacccgtgccctggaacgccctgctgagaagaagagccagaggcccccccgccgccgtgctggcctgcctgctgcccgacagagccctgagaaccagactggtgagaggcgagctggccagagccgtggtgctggacgagggcagcgccagcgtggccgagctgagacccgacagccccgcccacgtgctgctggccgccctgctgcacgagaccagagccggccccaccgccgtgtacttcctgagaggcggcttcgacggcttccagggctgctgccccgacctgtgcagcgaggcccccgcccccgccctgccccccaccggcgacaagaccagcagaagcgacagcagagcccccgtgtacgaccagggcggccccgtggagatcctgccctacctgttcctgggcagctgcagccacagcagcgacctgcagggcctgcaggcctgcggcatcaccgccgtgctgaacgtgagcgccagctgccccaaccacttcgagggcctgttcagatacaagagcatccccgtggaggacaaccagatggtggagatcagcgcctggttccaggaggccatcggcttcatcgactgggtgaagaacagcggcggcagagtgctggtgcactgccaggccggcatcagcagaagcgccaccatctgcctggcctacctgatgcagagcagaagagtgagactggacgaggccttcgacttcgtgaagcagagaagaggcgtgatcagccccaacttcagcttcatgggccagctgctgcagttcgagacccaggtgctgtgccactag

SEQ ID NO: 79736 - DNA, 288 bp, Artificial Sequence
  Description of Artificial Sequence: Synthetic coding sequence
atggccgccgccagactgtgcctgagcctgctgctgctgagcacctgcgtggccctgctgctgcagcccctgctgggcgcccagggcgcccccctggagcccgtgtaccccggcgacaacgccacccccgagcagatggcccagtacgccgccgacctgagaagatacatcaacatgctgaccagacccagatacggcaagagacacaaggaggacaccctggccttcagcgagtggggcagcccccacgccgccgtgcccagagagctgagccccctggacctgtag

SEQ ID NO: 79737 - DNA, 435 bp, Artificial Sequence
  Description of Artificial Sequence: Synthetic coding sequence
atgagcgtggcccaggacatccccaagctgcagaagctgggcatcacccacgtgctgaacgccgccgagggcagaagcttcatgcacgtgaacaccaacgccaacttctacaaggacagcggcatcacctacctgggcatcaaggccaacgacacccaggagttcaacctgagcgcctacttcgagagagccgccgacttcatcgaccaggccctggcccagaagaacggcagagtgctggtgcactgcagagagggctacagcagaagccccaccctggtgatcgcctacctgatgatgagacagaagatggacgtgaagagcgccctgagcatcgtgagacagaacagagagatcggccccaacgacggcttcctggcccagctgtgccagctgaacgacagactggccaaggagggcaagctgaagccctag

SEQ ID NO: 79738 - DNA, 1185 bp, Artificial Sequence
  Description of Artificial Sequence: Synthetic coding sequence
atggtgaccatggaggagctgagagagatggactgcagcgtgctgaagagactgatgaacagagacgagaacggcggcggcgccggcggcagcggcagccacggcaccctgggcctgcccagcggcggcaagtgcctgctgctggactgcagacccttcctggcccacagcgccggctacatcctgggcagcgtgaacgtgagatgcaacaccatcgtgagaagaagagccaagggcagcgtgagcctggagcagatcctgcccgccgaggaggaggtgagagccagactgagaagcggcctgtacagcgccgtgatcgtgtacgacgagagaagccccagagccgagagcctgagagaggacagcaccgtgagcctggtggtgcaggccctgagaagaaacgccgagagaaccgacatctgcctgctgaagggcggctacgagagattcagcagcgagtaccccgagttctgcagcaagaccaaggccctggccgccatccccccccccgtgccccccagcgccaccgagcccctggacctgggctgcagcagctgcggcacccccctgcacgaccagggcggccccgtggagatcctgcccttcctgtacctgggcagcgcctaccacgccgccagaagagacatgctggacgccctgggcatcaccgccctgctgaacgtgagcagcgactgccccaaccacttcgagggccactaccagtacaagtgcatccccgtggaggacaaccacaaggccgacatcagcagctggttcatggaggccatcgagtacatcgacgccgtgaaggactgcagaggcagagtgctggtgcactgccaggccggcatcagcagaagcgccaccatctgcctggcctacctgatgatgaagaagagagtgagactggaggaggccttcgagttcgtgaagcagagaagaagcatcatcagccccaacttcagcttcatgggccagctgctgcagttcgagagccaggtgctggccaccagctgcgccgccgaggccgccagccccagcggccccctgagagagagaggcaagacccccgccacccccaccagccagttcgtgttcagcttccccgtgagcgtgggcgtgcacagcgcccccagcagcctgccctacctgcacagccccatcaccaccagccccagctgctag

SEQ ID NO: 79739 - DNA, 912 bp, Artificial Sequence
  Description of Artificial Sequence: Synthetic coding sequence
atgggcagaaaggtgcacagcaacggcagccagttcgccgagcacagcagaagccccagaagaaccggcagagactgcaagcccgtgagagcccccagcatggccctgggcgtgagccagctggccggcagaagcagatgcctgtgcagcgagagccagggcggctacgagagattcagcagcgagtaccccgagttctgcagcaagaccaaggccctggccgccatccccccccccgtgccccccagcgccaccgagcccctggacctgggctgcagcagctgcggcacccccctgcacgaccagggcggccccgtggagatcctgcccttcctgtacctgggcagcgcctaccacgccgccagaagagacatgctggacgccctgggcatcaccgccctgctgaacgtgagcagcgactgccccaaccacttcgagggccactaccagtacaagtgcatccccgtggaggacaaccacaaggccgacatcagcagctggttcatggaggccatcgagtacatcgacgccgtgaaggactgcagaggcagagtgctggtgcactgccaggccggcatcagcagaagcgccaccatctgcctggcctacctgatgatgaagaagagagtgagactggaggaggccttcgagttcgtgaagcagagaagaagcatcatcagccccaacttcagcttcatgggccagctgctgcagttcgagagccaggtgctggccaccagctgcgccgccgaggccgccagccccagcggccccctgagagagagaggcaagacccccgccacccccaccagccagttcgtgttcagcttccccgtgagcgtgggcgtgcacagcgcccccagcagcctgccctacctgcacagccccatcaccaccagccccagctgctag

SEQ ID NO: 79740 - DNA, 1155 bp, Artificial Sequence
  Description of Artificial Sequence: Synthetic coding sequence
atgaaggtgaccagcctggacggcagacagctgagaaagatgctgagaaaggaggccgccgccagatgcgtggtgctggactgcagaccctacctggccttcgccgccagcaacgtgagaggcagcctgaacgtgaacctgaacagcgtggtgctgagaagagccagaggcggcgccgtgagcgccagatacgtgctgcccgacgaggccgccagagccagactgctgcaggagggcggcggcggcgtggccgccgtggtggtgctggaccagggcagcagacactggcagaagctgagagaggagagcgccgccagagtggtgctgaccagcctgctggcctgcctgcccgccggccccagagtgtacttcctgaagggcggctacgagaccttctacagcgagtaccccgagtgctgcgtggacgtgaagcccatcagccaggagaagatcgagagcgagagagccctgatcagccagtgcggcaagcccgtggtgaacgtgagctacagacccgcctacgaccagggcggccccgtggagatcctgcccttcctgtacctgggcagcgcctaccacgccagcaagtgcgagttcctggccaacctgcacatcaccgccctgctgaacgtgagcagaagaaccagcgaggcctgcgccacccacctgcactacaagtggatccccgtggaggacagccacaccgccgacatcagcagccacttccaggaggccatcgacttcatcgactgcgtgagagagaagggcggcaaggtgctggtgcactgcgaggccggcatcagcagaagccccaccatctgcatggcctacctgatgaagaccaagcagttcagactgaaggaggccttcgactacatcaagcagagaagaagcatggtgagccccaacttcggcttcatgggccagctgctgcagtacgagagcgagatcctgcccagcacccccaacccccagccccccagctgccagggcgaggccgccggcagcagcctgatcggccacctgcagaccctgagccccgacatgcagggcgcctactgcaccttccccgccagcgtgctggcccccgtgcccacccacagcaccgtgagcgagctgagcagaagccccgtggccaccgccaccagctgctag

SEQ ID NO: 79741 - DNA, 1107 bp, Artificial Sequence
  Description of Artificial Sequence: Synthetic coding sequence
atgccctgcaagagcgccgagtggctgcaggaggagctggaggccagaggcggcgccagcctgctgctgctggactgcagaccccacgagctgttcgagagcagccacatcgagaccgccatcaacctggccatccccggcctgatgctgagaagactgagaaagggcaacctgcccatcagaagcatcatccccaaccacgccgacaaggagagattcgccaccagatgcaaggccgccaccgtgctgctgtacgacgaggccaccgccgagtggcagcccgagcccggcgcccccgccagcgtgctgggcctgctgctgcagaagctgagagacgacggctgccaggcctactacctgcagggcggcttcaacaagttccagaccgagtacagcgagcactgcgagaccaacgtggacagcagcagcagccccagcagcagcccccccaccagcgtgctgggcctgggcggcctgagaatcagcagcgactgcagcgacggcgagagcgacagagagctgcccagcagcgccaccgagagcgacggcagccccgtgcccagcagccagcccgccttccccgtgcagatcctgccctacctgtacctgggctgcgccaaggacagcaccaacctggacgtgctgggcaagtacggcatcaagtacatcctgaacgtgacccccaacctgcccaacgccttcgagcacggcggcgagttcacctacaagcagatccccatcagcgaccactggagccagaacctgagccagttcttccccgaggccatcagcttcatcgacgaggccagaagcaagaagtgcggcgtgctggtgcactgcctggccggcatcagcagaagcgtgaccgtgaccgtggcctacctgatgcagaagatgaacctgagcctgaacgacgcctacgacttcgtgaagagaaagaagagcaacatcagccccaacttcaacttcatgggccagctgctggacttcgagagaaccctgggcctgagcagcccctgcgacaaccacgccagcagcgagcagctgtacttcagcacccccaccaaccacaacctgttccccctgaacaccctggagagcacctag

SEQ ID NO: 79742 - DNA, 1260 bp, Artificial Sequence
  Description of Artificial Sequence: Synthetic coding sequence
atgaagaaccagctgagaggcccccccgccagagcccacatgagcaccagcggcgccgccgccgccggcggcaccagagccggcagcgagcccggcgccggcagcggcagcggcgccggcaccggcgccggcgccgccaccggcgccggcgccatgccctgcaagagcgccgagtggctgcaggaggagctggaggccagaggcggcgccagcctgctgctgctggactgcagaccccacgagctgttcgagagcagccacatcgagaccgccatcaacctggccatccccggcctgatgctgagaagactgagaaagggcaacctgcccatcagaagcatcatccccaaccacgccgacaaggagagattcgccaccagatgcaaggccgccaccgtgctgctgtacgacgaggccaccgccgagtggcagcccgagcccggcgcccccgccagcgtgctgggcctgctgctgcagaagctgagagacgacggctgccaggcctactacctgcagggcggcttcaacaagttccagaccgagtacagcgagcactgcgagaccaacgtggacagcagcagcagccccagcagcagcccccccaccagcgtgctgggcctgggcggcctgagaatcagcagcgactgcagcgacggcgagagcgacagagagctgcccagcagcgccaccgagagcgacggcagccccgtgcccagcagccagcccgccttccccgtgcagatcctgccctacctgtacctgggctgcgccaaggacagcaccaacctggacgtgctgggcaagtacggcatcaagtacatcctgaacgtgacccccaacctgcccaacgccttcgagcacggcggcgagttcacctacaagcagatccccatcagcgaccactggagccagaacctgagccagttcttccccgaggccatcagcttcatcgacgaggccagaagcaagaagtgcggcgtgctggtgcactgcctggccggcatcagcagaagcgtgaccgtgaccgtggcctacctgatgcagaagatgaacctgagcctgaacgacgcctacgacttcgtgaagagaaagaagagcaacatcagccccaacttcaacttcatgggccagctgctggacttcgagagaaccctgggcctgagcagcccctgcgacaaccacgccagcagcgagcagctgtacttcagcacccccaccaaccacaacctgttccccctgaacaccctggagagcacctag

SEQ ID NO: 79743 - DNA, 1878 bp, Artificial Sequence
  Description of Artificial Sequence: Synthetic coding sequence
atggccggcgacagactgcccagaaaggtgatggacgccaagaagctggccagcctgctgagaggcggccccggcggccccctggtgatcgacagcagaagcttcgtggagtacaacagctggcacgtgctgagcagcgtgaacatctgctgcagcaagctggtgaagagaagactgcagcagggcaaggtgaccatcgccgagctgatccagcccgccgccagaagccaggtggaggccaccgagccccaggacgtggtggtgtacgaccagagcaccagagacgccagcgtgctggccgccgacagcttcctgagcatcctgctgagcaagctggacggctgcttcgacagcgtggccatcctgaccggcggcttcgccaccttcagcagctgcttccccggcctgtgcgagggcaagcccgccgccctgctgcccatgagcctgagccagccctgcctgcccgtgcccagcgtgggcctgaccagaatcctgccccacctgtacctgggcagccagaaggacgtgctgaacaaggacctgatgacccagaacggcatcagctacgtgctgaacgccagcaacagctgccccaagcccgacttcatctgcgagagcagattcatgagagtgcccatcaacgacaactactgcgagaagctgctgccctggctggacaagagcatcgagttcatcgacaaggccaagctgagcagctgccaggtgatcgtgcactgcctggccggcatcagcagaagcgccaccatcgccatcgcctacatcatgaagaccatgggcatgagcagcgacgacgcctacagattcgtgaaggacagaagacccagcatcagccccaacttcaacttcctgggccagctgctggagtacgagagaagcctgaagctgctggccgccctgcagggcgaccccggcacccccagcggcacccccgagcccccccccagccccgccgccggcgcccccctgcccagactgcccccccccaccagcgagagcgccgccaccggcaacgccgccgccagagagggcggcctgagcgccggcggcgagccccccgccccccccaccccccccgccaccagcgccctgcagcagggcctgagaggcctgcacctgagcagcgacagactgcaggacaccaacagactgaagagaagcttcagcctggacatcaagagcgcctacgcccccagcagaagacccgacggccccggcccccccgaccccggcgaggcccccaagctgtgcaagctggacagccccagcggcgccgccctgggcctgagcagccccagccccgacagccccgacgccgcccccgaggccagacccagacccagaagaagacccagaccccccgccggcagccccgccagaagccccgcccacagcctgggcctgaacttcggcgacgccgccagacagacccccagacacggcctgagcgccctgagcgcccccggcctgcccggccccggccagcccgccggccccggcgcctgggccccccccctggacagccccggcacccccagccccgacggcccctggtgcttcagccccgagggcgcccagggcgccggcggcgtgctgttcgcccccttcggcagagccggcgcccccggccccggcggcggcagcgacctgagaagaagagaggccgccagagccgagcccagagacgccagaaccggctggcccgaggagcccgcccccgagacccagttcaagagaagaagctgccagatggagttcgaggagggcatggtggagggcagagccagaggcgaggagctggccgccctgggcaagcaggccagcttcagcggcagcgtggaggtgatcgaggtgagctag

SEQ ID NO: 79744 - DNA, 1878 bp, Artificial Sequence; identical to SEQ ID NO: 79743
  Description of Artificial Sequence: Synthetic coding sequence

SEQ ID NO: 79745 - DNA, 1626 bp, Artificial Sequence
  Description of Artificial Sequence: Synthetic coding sequence
atgcacaccggcggcgagaccagcgcctgcaagcccagcagcgtgagactggcccccagcttcagcttccacgccgccggcctgcagatggccggccagatgccccacagccaccagtacagcgacagaagacagcccaacatcagcgaccagcaggtgagcgccctgagctacagcgaccagatccagcagcccctgaccaaccaggtgatgcccgacatcgtgatgctgcagagaagaatgccccagaccttcagagaccccgccaccgcccccctgagaaagctgagcgtggacctgatcaagacctacaagcacatcaacgaggtgtactacgccaagaagaagagaagacaccagcagggccagggcgacgacagcagccacaagaaggagagaaaggtgtacaacgacggctacgacgacgacaactacgactacatcgtgaagaacggcgagaagtggatggacagatacgagatcgacagcctgatcggcaagggcagcttcggccaggtggtgaaggcctacgacagagtggagcaggagtgggtggccatcaagatcatcaagaacaagaaggccttcctgaaccaggcccagatcgaggtgagactgctggagctgatgaacaagcacgacaccgagatgaagtactacatcgtgcacctgaagagacacttcatgttcagaaaccacctgtgcctggtgttcgagatgctgagctacaacctgtacgacctgctgagaaacaccaacttcagaggcgtgagcctgaacctgaccagaaagttcgcccagcagatgtgcaccgccctgctgttcctggccacccccgagctgagcatcatccactgcgacctgaagcccgagaacatcctgctgtgcaaccccaagagaagcgccatcaagatcgtggacttcggcagcagctgccagctgggccagagaatctaccagtacatccagagcagattctacagaagccccgaggtgctgctgggcatgccctacgacctggccatcgacatgtggagcctgggctgcatcctggtggagatgcacaccggcgagcccctgttcagcggcgccaacgaggtggaccagatgaacaagatcgtggaggtgctgggcatcccccccgcccacatcctggaccaggcccccaaggccagaaagttcttcgagaagctgcccgacggcacctggaacctgaagaagaccaaggacggcaagagagagtacaagccccccggcaccagaaagctgcacaacatcctgggcgtggagaccggcggccccggcggcagaagagccggcgagagcggccacaccgtggccgactacctgaagttcaaggacctgatcctgagaatgctggactacgaccccaagaccagaatccagccctactacgccctgcagcacagcttcttcaagaagaccgccgacgagggcaccaacaccagcaacagcgtgagcaccagccccgccatggagcagagccagagcagcggcaccaccagcagcaccagcagcagcagcgtggtggagcagcactggatgcccggcgccttcagaatgaccgtgagcttcaccctggaggtgcacgacgtgcccgtgtag

SEQ ID NO: 79746 - DNA, 1755 bp, Artificial Sequence
  Description of Artificial Sequence: Synthetic coding sequence
atgcacaccggcggcgagaccagcgcctgcaagcccagcagcgtgagactggcccccagcttcagcttccacgccgccggcctgcagatggccggccagatgccccacagccaccagtacagcgacagaagacagcccaacatcagcgaccagcaggtgagcgccctgagctacagcgaccagatccagcagcccctgaccaaccaggtgatgcccgacatcgtgatgctgcagagaagaatgccccagaccttcagagaccccgccaccgcccccctgagaaagctgagcgtggacctgatcaagacctacaagcacatcaacgaggtgtactacgccaagaagaagagaagacaccagcagggccagggcgacgacagcagccacaagaaggagagaaaggtgtacaacgacggctacgacgacgacaactacgactacatcgtgaagaacggcgagaagtggatggacagatacgagatcgacagcctgatcggcaagggcagcttcggccaggtggtgaaggcctacgacagagtggagcaggagtgggtggccatcaagatcatcaagaacaagaaggccttcctgaaccaggcccagatcgaggtgagactgctggagctgatgaacaagcacgacaccgagatgaagtactacatcgtgcacctgaagagacacttcatgttcagaaaccacctgtgcctggtgttcgagatgctgagctacaacctgtacgacctgctgagaaacaccaacttcagaggcgtgagcctgaacctgaccagaaagttcgcccagcagatgtgcaccgccctgctgttcctggccacccccgagctgagcatcatccactgcgacctgaagcccgagaacatcctgctgtgcaaccccaagagaagcgccatcaagatcgtggacttcggcagcagctgccagctgggccagagaatctaccagtacatccagagcagattctacagaagccccgaggtgctgctgggcatgccctacgacctggccatcgacatgtggagcctgggctgcatcctggtggagatgcacaccggcgagcccctgttcagcggcgccaacgaggtggaccagatgaacaagatcgtggaggtgctgggcatcccccccgcccacatcctggaccaggcccccaaggccagaaagttcttcgagaagctgcccgacggcacctggaacctgaagaagaccaaggacggcaagagagagtacaagccccccggcaccagaaagctgcacaacatcctgggcgtggagaccggcggccccggcggcagaagagccggcgagagcggccacaccgtggccgactacctgaagttcaaggacctgatcctgagaatgctggactacgaccccaagaccagaatccagccctactacgccctgcagcacagcttcttcaagaagaccgccgacgagggcaccaacaccagcaacagcgtgagcaccagccccgccatggagcagagccagagcagcggcaccaccagcagcaccagcagcagcagcggcggcagcagcggcaccagcaacagcggcagagccagaagcgaccccacccaccagcacagacacagcggcggccacttcaccgccgccgtgcaggccatggactgcgagacccacagcccccaggtgagcagccacgtggtgcacctgctggtgagccccgccatcctgagatggagcagcaccggctgccaggtgcccctggagtag

SEQ ID NO: 79747 - DNA, 2265 bp, Artificial Sequence
  Description of Artificial Sequence: Synthetic coding sequence
atgcacaccggcggcgagaccagcgcctgcaagcccagcagcgtgagactggcccccagcttcagcttccacgccgccggcctgcagatggccggccagatgccccacagccaccagtacagcgacagaagacagcccaacatcagcgaccagcaggtgagcgccctgagctacagcgaccagatccagcagcccctgaccaaccagagaagaatgccccagaccttcagagaccccgccaccgcccccctgagaaagctgagcgtggacctgatcaagacctacaagcacatcaacgaggtgtactacgccaagaagaagagaagacaccagcagggccagggcgacgacagcagccacaagaaggagagaaaggtgtacaacgacggctacgacgacgacaactacgactacatcgtgaagaacggcgagaagtggatggacagatacgagatcgacagcctgatcggcaagggcagcttcggccaggtggtgaaggcctacgacagagtggagcaggagtgggtggccatcaagatcatcaagaacaagaaggccttcctgaaccaggcccagatcgaggtgagactgctggagctgatgaacaagcacgacaccgagatgaagtactacatcgtgcacctgaagagacacttcatgttcagaaaccacctgtgcctggtgttcgagatgctgagctacaacctgtacgacctgctgagaaacaccaacttcagaggcgtgagcctgaacctgaccagaaagttcgcccagcagatgtgcaccgccctgctgttcctggccacccccgagctgagcatcatccactgcgacctgaagcccgagaacatcctgctgtgcaaccccaagagaagcgccatcaagatcgtggacttcggcagcagctgccagctgggccagagaatctaccagtacatccagagcagattctacagaagccccgaggtgctgctgggcatgccctacgacctggccatcgacatgtggagcctgggctgcatcctggtggagatgcacaccggcgagcccctgttcagcggcgccaacgaggtggaccagatgaacaagatcgtggaggtgctgggcatcccccccgcccacatcctggaccaggcccccaaggccagaaagttcttcgagaagctgcccgacggcacctggaacctgaagaagaccaaggacggcaagagagagtacaagccccccggcaccagaaagctgcacaacatcctgggcgtggagaccggcggccccggcggcagaagagccggcgagagcggccacaccgtggccgactacctgaagttcaaggacctgatcctgagaatgctggactacgaccccaagaccagaatccagccctactacgccctgcagcacagcttcttcaagaagaccgccgacgagggcaccaacaccagcaacagcgtgagcaccagccccgccatggagcagagccagagcagcggcaccaccagcagcaccagcagcagcagcggcggcagcagcggcaccagcaacagcggcagagccagaagcgaccccacccaccagcacagacacagcggcggccacttcaccgccgccgtgcaggccatggactgcgagacccacagcccccaggtgagacagcagttccccgcccccctgggctggagcggcaccgaggcccccacccaggtgaccgtggagacccaccccgtgcaggagaccaccttccacgtggccccccagcagaacgccctgcaccaccaccacggcaacagcagccaccaccaccaccaccaccaccaccaccaccaccaccacggccagcaggccctgggcaacagaaccagacccagagtgtacaacagccccaccaacagcagcagcacccaggacagcatggaggtgggccacagccaccacagcatgaccagcctgagcagcagcaccaccagcagcagcaccagcagcagcagcaccggcaaccagggcaaccaggcctaccagaacagacccgtggccgccaacaccctggacttcggccagaacggcgccatggacgtgaacctgaccgtgtacagcaaccccagacaggagaccggcatcgccggccaccccacctaccagttcagcgccaacaccggccccgcccactacatgaccgagggccacctgaccatgagacagggcgccgacagagaggagagccccatgaccggcgtgtgcgtgcagcagagccccgtggccagcagctag

SEQ ID NO: 79748 - DNA, 1590 bp, Artificial Sequence
  Description of Artificial Sequence: Synthetic coding sequence
atgcacaccggcggcgagaccagcgcctgcaagcccagcagcgtgagactggcccccagcttcagcttccacgccgccggcctgcagatggccggccagatgccccacagccaccagtacagcgacagaagacagcccaacatcagcgaccagcaggtgagcgccctgagctacagcgaccagatccagcagcccctgaccaaccaggtgatgcccgacatcgtgatgctgcagagaagaatgccccagaccttcagagaccccgccaccgcccccctgagaaagctgagcgtggacctgatcaagacctacaagcacatcaacgaggtgtactacgccaagaagaagagaagacaccagcagggccagggcgacgacagcagccacaagaaggagagaaaggtgtacaacgacggctacgacgacgacaactacgactacatcgtgaagaacggcgagaagtggatggacagatacgagatcgacagcctgatcggcaagggcagcttcggccaggtggtgaaggcctacgacagagtggagcaggagtgggtggccatcaagatcatcaagaacaagaaggccttcctgaaccaggcccagatcgaggtgagactgctggagctgatgaacaagcacgacaccgagatgaagtactacatcgtgcacctgaagagacacttcatgttcagaaaccacctgtgcctggtgttcgagatgctgagctacaacctgtacgacctgctgagaaacaccaacttcagaggcgtgagcctgaacctgaccagaaagttcgcccagcagatgtgcaccgccctgctgttcctggccacccccgagctgagcatcatccactgcgacctgaagcccgagaacatcctgctgtgcaaccccaagagaagcgccatcaagatcgtggacttcggcagcagctgccagctgggccagagaatctaccagtacatccagagcagattctacagaagccccgaggtgctgctgggcatgccctacgacctggccatcgacatgtggagcctgggctgcatcctggtggagatgcacaccggcgagcccctgttcagcggcgccaacgaggtggaccagatgaacaagatcgtggaggtgctgggcatcccccccgcccacatcctggaccaggcccccaaggccagaaagttcttcgagaagctgcccgacggcacctggaacctgaagaagaccaaggacggcaagagagagtacaagccccccggcaccagaaagctgcacaacatcctgggcgtggagaccggcggccccggcggcagaagagccggcgagagcggccacaccgtggccgactacctgaagttcaaggacctgatcctgagaatgctggactacgaccccaagaccagaatccagccctactacgccctgcagcacagcttcttcaagaagaccgccgacgagggcaccaacaccagcaacagcgtgagcaccagccccgccatggagcagagccagagcagcggcaccaccagcagcaccagcagcagcagcggcgccagcgccatcagctgcagcagctggctggtgagacactag

SEQ ID NO: 79749 - DNA, 2292 bp, Artificial Sequence
  Description of Artificial Sequence: Synthetic coding sequence
atgcacaccggcggcgagaccagcgcctgcaagcccagcagcgtgagactggcccccagcttcagcttccacgccgccggcctgcagatggccggccagatgccccacagccaccagtacagcgacagaagacagcccaacatcagcgaccagcaggtgagcgccctgagctacagcgaccagatccagcagcccctgaccaaccaggtgatgcccgacatcgtgatgctgcagagaagaatgccccagaccttcagagaccccgccaccgcccccctgagaaagctgagcgtggacctgatcaagacctacaagcacatcaacgaggtgtactacgccaagaagaagagaagacaccagcagggccagggcgacgacagcagccacaagaaggagagaaaggtgtacaacgacggctacgacgacgacaactacgactacatcgtgaagaacggcgagaagtggatggacagatacgagatcgacagcctgatcggcaagggcagcttcggccaggtggtgaaggcctacgacagagtggagcaggagtgggtggccatcaagatcatcaagaacaagaaggccttcctgaaccaggcccagatcgaggtgagactgctggagctgatgaacaagcacgacaccgagatgaagtactacatcgtgcacctgaagagacacttcatgttcagaaaccacctgtgcctggtgttcgagatgctgagctacaacctgtacgacctgctgagaaacaccaacttcagaggcgtgagcctgaacctgaccagaaagttcgcccagcagatgtgcaccgccctgctgttcctggccacccccgagctgagcatcatccactgcgacctgaagcccgagaacatcctgctgtgcaaccccaagagaagcgccatcaagatcgtggacttcggcagcagctgccagctgggccagagaatctaccagtacatccagagcagattctacagaagccccgaggtgctgctgggcatgccctacgacctggccatcgacatgtggagcctgggctgcatcctggtggagatgcacaccggcgagcccctgttcagcggcgccaacgaggtggaccagatgaacaagatcgtggaggtgctgggcatcccccccgcccacatcctggaccaggcccccaaggccagaaagttcttcgagaagctgcccgacggcacctggaacctgaagaagaccaaggacggcaagagagagtacaagccccccggcaccagaaagctgcacaacatcctgggcgtggagaccggcggccccggcggcagaagagccggcgagagcggccacaccgtggccgactacctgaagttcaaggacctgatcctgagaatgctggactacgaccccaagaccagaatccagccctactacgccctgcagcacagcttcttcaagaagaccgccgacgagggcaccaacaccagcaacagcgtgagcaccagccccgccatggagcagagccagagcagcggcaccaccagcagcaccagcagcagcagcggcggcagcagcggcaccagcaacagcggcagagccagaagcgaccccacccaccagcacagacacagcggcggccacttcaccgccgccgtgcaggccatggactgcgagacccacagcccccaggtgagacagcagttccccgcccccctgggctggagcggcaccgaggcccccacccaggtgaccgtggagacccaccccgtgcaggagaccaccttccacgtggccccccagcagaacgccctgcaccaccaccacggcaacagcagccaccaccaccaccaccaccaccaccaccaccaccaccacggccagcaggccctgggcaacagaaccagacccagagtgtacaacagccccaccaacagcagcagcacccaggacagcatggaggtgggccacagccaccacagcatgaccagcctgagcagcagcaccaccagcagcagcaccagcagcagcagcaccggcaaccagggcaaccaggcctaccagaacagacccgtggccgccaacaccctggacttcggccagaacggcgccatggacgtgaacctgaccgtgtacagcaaccccagacaggagaccggcatcgccggccaccccacctaccagttcagcgccaacaccggccccgcccactacatgaccgagggccacctgaccatgagacagggcgccgacagagaggagagccccatgaccggcgtgtgcgtgcagcagagccccgtggccagcagctag

SEQ ID NO: 79750 - DNA, 396 bp, Artificial Sequence
  Description of Artificial Sequence: Synthetic coding sequence
atgcacaccggcggcgagaccagcgcctgcaagcccagcagcgtgagactggcccccagcttcagcttccacgccgccggcctgcagatggccggccagatgccccacagccaccagtacagcgacagaagacagcccaacatcagcgaccagcaggtgagcgccctgagctacagcgaccagatccagcagcccctgaccaaccaggtgatgcccgacatcgtgatgctgcagagaagaatgccccagaccttcagagaccccgccaccgcccccctgagaaagctgagcgtggacctgatcaagacctacaagcacatcaacgaggtgtactacgccaagaagaagagaagacaccagcagggccagggcgacgacagcagccacaagaagtag

SEQ ID NO: 79751 - DNA, 1755 bp, Artificial Sequence; identical to SEQ ID NO: 79746
  Description of Artificial Sequence: Synthetic coding sequence

SEQ ID NO: 79752 - DNA, 141 bp, Artificial Sequence
  Description of Artificial Sequence: Synthetic coding sequence
atgcacaccggcggcgagaccagcgcctgcaagcccagcagcgtgagactggcccccagcttcagcttccacgccgccggcctgcagatggccggccagatgccccacagccaccagtacagcgacagaagacagccctag

SEQ ID NO: 79753 - DNA, 1608 bp, Artificial Sequence
  Description of Artificial Sequence: Synthetic coding sequence
atgttcagaaaccacctgtgcctggtgttcgagatgctgagctacaacctgtacgacctgctgagaaacaccaacttcagaggcgtgagcctgaacctgaccagaaagttcgcccagcagatgtgcaccgccctgctgttcctggccacccccgagctgagcatcatccactgcgacctgaagcccgagaacatcctgctgtgcaaccccaagagaagcgccatcaagatcgtggacttcggcagcagctgccagctgggccagagaatctaccagtacatccagagcagattctacagaagccccgaggtgctgctgggcatgccctacgacctggccatcgacatgtggagcctgggctgcatcctggtggagatgcacaccggcgagcccctgttcagcggcgccaacgaggtggaccagatgaacaagatcgtggaggtgctgggcatcccccccgcccacatcctggaccaggcccccaaggccagaaagttcttcgagaagctgcccgacggcacctggaacctgaagaagaccaaggacggcaagagagagtacaagccccccggcaccagaaagctgcacaacatcctgggcgtggagaccggcggccccggcggcagaagagccggcgagagcggccacaccgtggccgactacctgaagttcaaggacctgatcctgagaatgctggactacgaccccaagaccagaatccagccctactacgccctgcagcacagcttcttcaagaagaccgccgacgagggcaccaacaccagcaacagcgtgagcaccagccccgccatggagcagagccagagcagcggcaccaccagcagcaccagcagcagcagcggcggcagcagcggcaccagcaacagcggcagagccagaagcgaccccacccaccagcacagacacagcggcggccacttcaccgccgccgtgcaggccatggactgcgagacccacagcccccaggtgagacagcagttccccgcccccctgggctggagcggcaccgaggcccccacccaggtgaccgtggagacccaccccgtgcaggagaccaccttccacgtggccccccagcagaacgccctgcaccaccaccacggcaacagcagccaccaccaccaccaccaccaccaccaccaccaccaccacggccagcaggccctgggcaacagaaccagacccagagtgtacaacagccccaccaacagcagcagcacccaggacagcatggaggtgggccacagccaccacagcatgaccagcctgagcagcagcaccaccagcagcagcaccagcagcagcagcaccggcaaccagggcaaccaggcctaccagaacagacccgtggccgccaacaccctggacttcggccagaacggcgccatggacgtgaacctgaccgtgtacagcaaccccagacaggagaccggcatcgccggccaccccacctaccagttcagcgccaacaccggccccgcccactacatgaccgagggccacctgaccatgagacagggcgccgacagagaggagagccccatgaccggcgtgtgcgtgcagcagagccccgtggccagcagctag

SEQ ID NO: 79754 - DNA, 1890 bp, Artificial Sequence
  Description of Artificial Sequence: Synthetic coding sequence
atggccgtgccccccggccacggccccttcagcggcttccccggcccccaggagcacacccaggtgctgcccgacgtgagactgctgcccagaagactgcccctggccttcagagacgccaccagcgcccccctgagaaagctgagcgtggacctgatcaagacctacaagcacatcaacgaggtgtactacgccaagaagaagagaagagcccagcaggcccccccccaggacagcagcaacaagaaggagaagaaggtgctgaaccacggctacgacgacgacaaccacgactacatcgtgagaagcggcgagagatggctggagagatacgagatcgacagcctgatcggcaagggcagcttcggccaggtggtgaaggcctacgaccaccagacccaggagctggtggccatcaagatcatcaagaacaagaaggccttcctgaaccaggcccagatcgagctgagactgctggagctgatgaaccagcacgacaccgagatgaagtactacatcgtgcacctgaagagacacttcatgttcagaaaccacctgtgcctggtgttcgagctgctgagctacaacctgtacgacctgctgagaaacacccacttcagaggcgtgagcctgaacctgaccagaaagctggcccagcagctgtgcaccgccctgctgttcctggccacccccgagctgagcatcatccactgcgacctgaagcccgagaacatcctgctgtgcaaccccaagagaagcgccatcaagatcgtggacttcggcagcagctgccagctgggccagagaatctaccagtacatccagagcagattctacagaagccccgaggtgctgctgggcaccccctacgacctggccatcgacatgtggagcctgggctgcatcctggtggagatgcacaccggcgagcccctgttcagcggcagcaacgaggtggaccagatgaacagaatcgtggaggtgctgggcatcccccccgccgccatgctggaccaggcccccaaggccagaaagtacttcgagagactgcccggcggcggctggaccctgagaagaaccaaggagctgagaaaggactaccagggccccggcaccagaagactgcaggaggtgctgggcgtgcagaccggcggccccggcggcagaagagccggcgagcccggccacagccccgccgactacctgagattccaggacctggtgctgagaatgctggagtacgagcccgccgccagaatcagccccctgggcgccctgcagcacggcttcttcagaagaaccgccgacgaggccaccaacaccggccccgccggcagcagcgccagcaccagccccgcccccctggacacctgccccagcagcagcaccgccagcagcatcagcagcagcggcggcagcagcggcagcagcagcgacaacagaacctacagatacagcaacagatactgcggcggccccggcccccccatcaccgactgcgagatgaacagcccccaggtgccccccagccagcccctgagaccctgggccggcggcgacgtgccccacaagacccaccaggcccccgccagcgccagcagcctgcccggcaccggcgcccagctgcccccccagcccagatacctgggcagaccccccagccccaccagcccccccccccccgagctgatggacgtgagcctggtgggcggccccgccgactgcagccccccccaccccgcccccgccccccagcaccccgccgccagcgccctgagaaccagaatgaccggcggcagaccccccctgcccccccccgacgaccccgccaccctgggcccccacctgggcctgagaggcgtgccccagagcaccgccgccagcagctag

SEQ ID NO: 79755 - DNA, 1806 bp, Artificial Sequence
  Description of Artificial Sequence: Synthetic coding sequence
atggccgtgccccccggccacggccccttcagcggcttccccggcccccaggagcacacccaggtgctgcccgacgtgagactgctgcccagaagactgcccctggccttcagagacgccaccagcgcccccctgagaaagctgagcgtggacctgatcaagacctacaagcacatcaacgaggtgtactacgccaagaagaagagaagagcccagcaggcccccccccaggacagcagcaacaagaaggagaagaaggtgctgaaccacggctacgacgacgacaaccacgactacatcgtgagaagcggcgagagatggctggagagatacgagatcgacagcctgatcggcaagggcagcttcggccaggtggtgaaggcctacgaccaccagacccaggagctggtggccatcaagatcatcaagaacaagaaggccttcctgaaccaggcccagatcgagctgagactgctggagctgatgaaccagcacgacaccgagatgaagtactacatcgtgcacctgaagagacacttcatgttcagaaaccacctgtgcctggtgttcgagctgctgagctacaacctgtacgacctgctgagaaacacccacttcagaggcgtgagcctgaacctgaccagaaagctggcccagcagctgtgcaccgccctgctgttcctggccacccccgagctgagcatcatccactgcgacctgaagcccgagaacatcctgctgtgcaaccccaagagaagcgccatcaagatcgtggacttcggcagcagctgccagctgggccagagaatctaccagtacatccagagcagattctacagaagccccgaggtgctgctgggcaccccctacgacctggccatcgacatgtggagcctgggctgcatcctggtggagatgcacaccggcgagcccctgttcagcggcagcaacgaggtggaccagatgaacagaatcgtggaggtgctgggcatcccccccgccgccatgctggaccaggcccccaaggccagaaagtacttcgagagactgcccggcggcggctggaccctgagaagaaccaaggagctgagaaaggactaccagggccccggcaccagaagactgcaggaggacctggtgctgagaatgctggagtacgagcccgccgccagaatcagccccctgggcgccctgcagcacggcttcttcagaagaaccgccgacgaggccaccaacaccggccccgccggcagcagcgccagcaccagccccgcccccctggacacctgccccagcagcagcaccgccagcagcatcagcagcagcggcggcagcagcggcagcagcagcgacaacagaacctacagatacagcaacagatactgcggcggccccggcccccccatcaccgactgcgagatgaacagcccccaggtgccccccagccagcccctgagaccctgggccggcggcgacgtgccccacaagacccaccaggcccccgccagcgccagcagcctgcccggcaccggcgcccagctgcccccccagcccagatacctgggcagaccccccagccccaccagcccccccccccccgagctgatggacgtgagcctggtgggcggccccgccgactgcagccccccccaccccgcccccgccccccagcaccccgccgccagcgccctgagaaccagaatgaccggcggcagaccccccctgcccccccccgacgaccccgccaccctgggcccccacctgggcctgagaggcgtgccccagagcaccgccgccagcagctag

SEQ ID NO: 79756 - DNA, 1770 bp, Artificial Sequence
  Description of Artificial Sequence: Synthetic coding sequence
atggccgtgccccccggccacggccccttcagcggcttccccggcccccaggagcacacccaggtgctgcccgacgtgagactgctgcccagaagactgcccctggccttcagagacgccaccagcgcccccctgagaaagctgagcgtggacctgatcaagacctacaagcacatcaacgaggtgtactacgccaagaagaagagaagagcccagcaggcccccccccaggacagcagcaacaagaaggagaagaaggtgctgaaccacggctacgacgacgacaaccacgactacatcgtgagaagcggcgagagatggctggagagatacgagatcgacagcctgatcggcaagggcagcttcggccaggtggtgaaggcctacgaccaccagacccaggagctggtggccatcaagatcatcaagaacaagaaggccttcctgaaccaggcccagatcgagctgagactgctggagctgatgaaccagcacgacaccgagatgaagtactacatcgtgcacctgaagagacacttcatgttcagaaaccacctgtgcctggtgttcgagctgctgagctacaacctgtacgacctgctgagaaacacccacttcagaggcgtgagcctgaacctgaccagaaagctggcccagcagctgtgcaccgccctgctgttcctggccacccccgagctgagcatcatccactgcgacctgaagcccgagaacatcctgctgtgcaaccccaagagaagcgccatcaagatcgtggacttcggcagcagctgccagctgggccagagaatctaccagtacatccagagcagattctacagaagccccgaggtgctgctgggcaccccctacgacctggccatcgacatgtggagcctgggctgcatcctggtggagatgcacaccggcgagcccctgttcagcggcagcaacgaggtggaccagatgaacagaatcgtggaggtgctgggcatcccccccgccgccatgctggaccaggcccccaaggccagaaagtacttcgagagactgcccggcggcggctggaccctgagaagaaccaaggagctgagaaaggacctggtgctgagaatgctggagtacgagcccgccgccagaatcagccccctgggcgccctgcagcacggcttcttcagaagaaccgccgacgaggccaccaacaccggccccgccggcagcagcgccagcaccagccccgcccccctggacacctgccccagcagcagcaccgccagcagcatcagcagcagcggcggcagcagcggcagcagcagcgacaacagaacctacagatacagcaacagatactgcggcggccccggcccccccatcaccgactgcgagatgaacagcccccaggtgccccccagccagcccctgagaccctgggccggcggcgacgtgccccacaagacccaccaggcccccgccagcgccagcagcctgcccggcaccggcgcccagctgcccccccagcccagatacctgggcagaccccccagccccaccagcccccccccccccgagctgatggacgtgagcctggtgggcggccccgccgactgcagccccccccaccccgcccccgccccccagcaccccgccgccagcgccctgagaaccagaatgaccggcggcagaccccccctgcccccccccgacgaccccgccaccctgggcccccacctgggcctgagaggcgtgccccagagcaccgccgccagcagctag

SEQ ID NO: 79757 - DNA, 285 bp, Artificial Sequence
  Description of Artificial Sequence: Synthetic coding sequence
atgaacgaccacctgcacgtgggcagccacgcccacggccagatccaggtgcagcagctgttcgaggacaacagcaacaagagaaccgtgctgaccacccagcccaacggcctgaccaccgtgggcaagaccggcctgcccgtggtgcccgagagacagctggacagcatccacagaagacagggcagcagcaccagcctgaagagcatggagggcatgggcaaggtgaaggccacccccatgacccccgagcaggccatgaagcagtacatgcagaagctgtag

SEQ ID NO: 79758 - DNA, 1806 bp, Artificial Sequence
  Description of Artificial Sequence: Synthetic coding sequence
atgctgaccagaaagcccagcgccgccgcccccgccgcctaccccaccggcagaggcggcgacagcgccgtgagacagctgcaggccagccccggcctgggcgccggcgccaccagaagcggcgtgggcaccggcccccccagccccatcgccctgccccccctgagagccagcaacgccgccgccgccgcccacaccatcggcggcagcaagcacaccatgaacgaccacctgcacgtgggcagccacgcccacggccagatccaggtgcagcagctgttcgaggacaacagcaacaagagaaccgtgctgaccacccagcccaacggcctgaccaccgtgggcaagaccggcctgcccgtggtgcccgagagacagctggacagcatccacagaagacagggcagcagcaccagcctgaagagcatggagggcatgggcaaggtgaaggccacccccatgacccccgagcaggccatgaagcagtacatgcagaagctgaccgccttcgagcaccacgagatcttcagctaccccgagatctacttcctgggcctgaacgccaagaagagacagggcatgaccggcggccccaacaacggcggctacgacgacgaccagggcagctacgtgcaggtgccccacgaccacgtggcctacagatacgaggtgctgaaggtgatcggcaagggcagcttcggccaggtggtgaaggcctacgaccacaaggtgcaccagcacgtggccctgaagatggtgagaaacgagaagagattccacagacaggccgccgaggagatcagaatcctggagcacctgagaaagcaggacaaggacaacaccatgaacgtgatccacatgctggagaacttcaccttcagaaaccacatctgcatgaccttcgagctgctgagcatgaacctgtacgagctgatcaagaagaacaagttccagggcttcagcctgcccctggtgagaaagttcgcccacagcatcctgcagtgcctggacgccctgcacaagaacagaatcatccactgcgacctgaagcccgagaacatcctgctgaagcagcagggcagaagcggcatcaaggtgatcgacttcggcagcagctgctacgagcaccagagagtgtacacctacatccagagcagattctacagagcccccgaggtgatcctgggcgccagatacggcatgcccatcgacatgtggagcctgggctgcatcctggccgagctgctgaccggctaccccctgctgcccggcgaggacgagggcgaccagctggcctgcatgatcgagctgctgggcatgcccagccagaagctgctggacgccagcaagagagccaagaacttcgtgagcagcaagggctaccccagatactgcaccgtgaccaccctgagcgacggcagcgtggtgctgaacggcggcagaagcagaagaggcaagctgagaggcccccccgagagcagagagtggggcaacgccctgaagggctgcgacgaccccctgttcctggacttcctgaagcagtgcctggagtgggaccccgccgtgagaatgacccccggccaggccctgagacacccctggctgagaagaagactgcccaagccccccaccggcgagaagaccagcgtgaagagaatcaccgagagcaccggcgccatcaccagcatcagcaagctgcccccccccagcagcagcgccagcaagctgagaaccaacctggcccagatgaccgacgccaacggcaacatccagcagagaaccgtgctgcccaagctggtgagctag

SEQ ID NO: 79759 - DNA, 1587 bp, Artificial Sequence
  Description of Artificial Sequence: Synthetic coding sequence
atgaacgaccacctgcacgtgggcagccacgcccacggccagatccaggtgcagcagctgttcgaggacaacagcaacaagagaaccgtgctgaccacccagcccaacggcctgaccaccgtgggcaagaccggcctgcccgtggtgcccgagagacagctggacagcatccacagaagacagggcagcagcaccagcctgaagagcatggagggcatgggcaaggtgaaggccacccccatgacccccgagcaggccatgaagcagtacatgcagaagctgaccgccttcgagcaccacgagatcttcagctaccccgagatctacttcctgggcctgaacgccaagaagagacagggcatgaccggcggccccaacaacggcggctacgacgacgaccagggcagctacgtgcaggtgccccacgaccacgtggcctacagatacgaggtgctgaaggtgatcggcaagggcagcttcggccaggtggtgaaggcctacgaccacaaggtgcaccagcacgtggccctgaagatggtgagaaacgagaagagattccacagacaggccgccgaggagatcagaatcctggagcacctgagaaagcaggacaaggacaacaccatgaacgtgatccacatgctggagaacttcaccttcagaaaccacatctgcatgaccttcgagctgctgagcatgaacctgtacgagctgatcaagaagaacaagttccagggcttcagcctgcccctggtgagaaagttcgcccacagcatcctgcagtgcctggacgccctgcacaagaacagaatcatccactgcgacctgaagcccgagaacatcctgctgaagcagcagggcagaagcggcatcaaggtgatcgacttcggcagcagctgctacgagcaccagagagtgtacacctacatccagagcagattctacagagcccccgaggtgatcctgggcgccagatacggcatgcccatcgacatgtggagcctgggctgcatcctggccgagctgctgaccggctaccccctgctgcccggcgaggacgagggcgaccagctggcctgcatgatcgagctgctgggcatgcccagccagaagctgctggacgccagcaagagagccaagaacttcgtgagcagcaagggctaccccagatactgcaccgtgaccaccctgagcgacggcagcgtggtgctgaacggcggcagaagcagaagaggcaagctgagaggcccccccgagagcagagagtggggcaacgccctgaagggctgcgacgaccccctgttcctggacttcctgaagcagtgcctggagtgggaccccgccgtgagaatgacccccggccaggccctgagacacccctggctgagaagaagactgcccaagccccccaccggcgagaagaccagcgtgaagagaatcaccgagagcaccggcgccatcaccagcatcagcaagctgcccccccccagcagcagcgccagcaagctgagaaccaacctggcccagatgaccgacgccaacggcaacatccagcagagaaccgtgctgcccaagctggtgagctag

SEQ ID NO: 79760 - DNA, 471 bp, Artificial Sequence
  Description of Artificial Sequence: Synthetic coding sequence
atgaacgaccacctgcacgtgggcagccacgcccacggccagatccaggtgcagcagctgttcgaggacaacagcaacaagagaaccgtgctgaccacccagcccaacggcctgaccaccgtgggcaagaccggcctgcccgtggtgcccgagagacagctggacagcatccacagaagacagggcagcagcaccagcctgaagagcatggagggcatgggcaaggtgaaggccacccccatgacccccgagcaggccatgaagcagtacatgcagaagctgaccgccttcgagcaccacgagatcttcagctaccccgagatctacttcctgggcctgaacgccaagaagagacagggcatgaccggcggccccaacaacggcggctacgacgacgaccagggcagctacgtgcaggtgccccacgaccacgtggcctacagatacgaggtgctgaaggtgatcggctag

SEQ ID NO: 79761 - DNA, 1707 bp, Artificial Sequence
  Description of Artificial Sequence: Synthetic coding sequence
atgaagtggaaggagaagctgggcgacggcgtgtacgacaccttcatgatgatcgacgagaccaagtgccccccctgcagcaacgtgctgtgcaaccccagcgagccccccccccccagaagactgaacatgaccaccgagcagttcaccggcgaccacacccagcacttcctggacggcggcgagatgaaggtggagcagctgttccaggagttcggcaacagaaagagcaacaccatccagagcgacggcatcagcgacagcgagaagtgcagccccaccgtgagccagggcaagagcagcgactgcctgaacaccgtgaagagcaacagcagcagcaaggcccccaaggtggtgcccctgacccccgagcaggccctgaagcagtacaagcaccacctgaccgcctacgagaagctggagatcatcaactaccccgagatctacttcgtgggccccaacgccaagaagagacacggcgtgatcggcggccccaacaacggcggctacgacgacgccgacggcgcctacatccacgtgcccagagaccacctggcctacagatacgaggtgctgaagatcatcggcaagggcagcttcggccaggtggccagagtgtacgaccacaagctgagacagtacgtggccctgaagatggtgagaaacgagaagagattccacagacaggccgccgaggagatcagaatcctggagcacctgaagaagcaggacaagaccggcagcatgaacgtgatccacatgctggagagcttcaccttcagaaaccacgtgtgcatggccttcgagctgctgagcatcgacctgtacgagctgatcaagaagaacaagttccagggcttcagcgtgcagctggtgagaaagttcgcccagagcatcctgcagagcctggacgccctgcacaagaacaagatcatccactgcgacctgaagcccgagaacatcctgctgaagcaccacggcagaagcagcaccaaggtgatcgacttcggcagcagctgcttcgagtaccagaagctgtacacctacatccagagcagattctacagagcccccgagatcatcctgggcagcagatacagcacccccatcgacatctggagcttcggctgcatcctggccgagctgctgaccggccagcccctgttccccggcgaggacgagggcgaccagctggcctgcatgatggagctgctgggcatgcccccccccaagctgctggagcagagcaagagagccaagtacttcatcaacagcaagggcatccccagatactgcagcgtgaccacccaggccgacggcagagtggtgctggtgggcggcagaagcagaagaggcaagaagagaggcccccccggcagcaaggactggggcaccgccctgaagggctgcgacgactacctgttcatcgagttcctgaagagatgcctgcactgggaccccagcgccagactgacccccgcccaggccctgagacacccctggatcagcaagagcgtgcccagacccctgaccaccatcgacaaggtgagcggcaagagagtggtgaaccccgccagcgccttccagggcctgggcagcaagctgccccccgtggtgggcatcgccaacaagctgaaggccaacctgatgagcgagaccaacggcagcatccccctgtgcagcgtgctgcccaagctgatcagctag

SEQ ID NO: 79762 - DNA, 1707 bp, Artificial Sequence; identical to SEQ ID NO: 79761
  Description of Artificial Sequence: Synthetic coding sequence

SEQ ID NO: 79763 - DNA, 1767 bp, Artificial Sequence
  Description of Artificial Sequence: Synthetic coding sequence
atgggcggcaccgccagaggccccggcagaaaggacgccggcccccccggcgccggcctgcccccccagcagagaagactgggcgacggcgtgtacgacaccttcatgatgatcgacgagaccaagtgccccccctgcagcaacgtgctgtgcaaccccagcgagccccccccccccagaagactgaacatgaccaccgagcagttcaccggcgaccacacccagcacttcctggacggcggcgagatgaaggtggagcagctgttccaggagttcggcaacagaaagagcaacaccatccagagcgacggcatcagcgacagcgagaagtgcagccccaccgtgagccagggcaagagcagcgactgcctgaacaccgtgaagagcaacagcagcagcaaggcccccaaggtggtgcccctgacccccgagcaggccctgaagcagtacaagcaccacctgaccgcctacgagaagctggagatcatcaactaccccgagatctacttcgtgggccccaacgccaagaagagacacggcgtgatcggcggccccaacaacggcggctacgacgacgccgacggcgcctacatccacgtgcccagagaccacctggcctacagatacgaggtgctgaagatcatcggcaagggcagcttcggccaggtggccagagtgtacgaccacaagctgagacagtacgtggccctgaagatggtgagaaacgagaagagattccacagacaggccgccgaggagatcagaatcctggagcacctgaagaagcaggacaagaccggcagcatgaacgtgatccacatgctggagagcttcaccttcagaaaccacgtgtgcatggccttcgagctgctgagcatcgacctgtacgagctgatcaagaagaacaagttccagggcttcagcgtgcagctggtgagaaagttcgcccagagcatcctgcagagcctggacgccctgcacaagaacaagatcatccactgcgacctgaagcccgagaacatcctgctgaagcaccacggcagaagcagcaccaaggtgatcgacttcggcagcagctgcttcgagtaccagaagctgtacacctacatccagagcagattctacagagcccccgagatcatcctgggcagcagatacagcacccccatcgacatctggagcttcggctgcatcctggccgagctgctgaccggccagcccctgttccccggcgaggacgagggcgaccagctggcctgcatgatggagctgctgggcatgcccccccccaagctgctggagcagagcaagagagccaagtacttcatcaacagcaagggcatccccagatactgcagcgtgaccacccaggccgacggcagagtggtgctggtgggcggcagaagcagaagaggcaagaagagaggcccccccggcagcaaggactggggcaccgccctgaagggctgcgacgactacctgttcatcgagttcctgaagagatgcctgcactgggaccccagcgccagactgacccccgcccaggccctgagacacccctggatcagcaagagcgtgcccagacccctgaccaccatcgacaaggtgagcggcaagagagtggtgaaccccgccagcgccttccagggcctgggcagcaagctgccccccgtggtgggcatcgccaacaagctgaaggccaacctgatgagcgagaccaacggcagcatccccctgtgcagcgtgctgcccaagctgatcagctag

SEQ ID NO: 79764 - DNA, 732 bp, Artificial Sequence
  Description of Artificial Sequence: Synthetic coding sequence
atgaagtggaaggagaagctgggcgacggcgtgtacgacaccttcatgatgatcgacgagaccaagtgccccccctgcagcaacgtgctgtgcaaccccagcgagccccccccccccagaagactgaacatgaccaccgagcagttcaccggcgaccacacccagcacttcctggacggcggcgagatgaaggtggagcagctgttccaggagttcggcaacagaaagagcaacaccatccagagcgacggcatcagcgacagcgagaagtgcagccccaccgtgagccagggcaagagcagcgactgcctgaacaccgtgaagagcaacagcagcagcaaggcccccaaggtggtgcccctgacccccgagcaggccctgaagcagtacaagcaccacctgaccgcctacgagaagctggagatcatcaactaccccgagatctacttcgtgggccccaacgccaagaagagacacggcgtgatcggcggccccaacaacggcggctacgacgacgccgacggcgcctacatccacgtgcccagagaccacctggcctacagatacgaggtgctgaagatcatcggcaagggcagcttcggccaggtggccagagtgtacgaccacaagctgagacagtacgtggccctgaagatggtgagaaacgagaagagattccacagacaggccgccgaggagatcagaatcctggagcacctgaagaagcagtag

SEQ ID NO: 79765 - DNA, 1563 bp, Artificial Sequence
  Description of Artificial Sequence: Synthetic coding sequence
atgcccgccagcgagctgaaggccagcgagatccccttccaccccagcatcaagacccaggaccccaaggccgaggagaagagccccaagaagcagaaggtgaccctgaccgccgccgaggccctgaagctgttcaagaaccagctgagcccctacgagcagagcgagatcctgggctacgccgagctgtggttcctgggcctggaggccaagaagctggacaccgcccccgagaagttcagcaagaccagcttcgacgacgagcacggcttctacctgaaggtgctgcacgaccacatcgcctacagatacgaggtgctggagaccatcggcaagggcagcttcggccaggtggccaagtgcctggaccacaagaacaacgagctggtggccctgaagatcatcagaaacaagaagagattccaccagcaggccctgatggagctgaagatcctggaggccctgagaaagaaggacaaggacaacacctacaacgtggtgcacatgaaggacttcttctacttcagaaaccacttctgcatcaccttcgagctgctgggcatcaacctgtacgagctgatgaagaacaacaacttccagggcttcagcctgagcatcgtgagaagattcaccctgagcgtgctgaagtgcctgcagatgctgagcgtggagaagatcatccactgcgacctgaagcccgagaacatcgtgctgtaccagaagggccaggccagcgtgaaggtgatcgacttcggcagcagctgctacgagcaccagaaggtgtacacctacatccagagcagattctacagaagccccgaggtgatcctgggccacccctacgacgtggccatcgacatgtggagcctgggctgcatcaccgccgagctgtacaccggctaccccctgttccccggcgagaacgaggtggagcagctggcctgcatcatggaggtgctgggcctgccccccgccggcttcatccagaccgccagcagaagacagaccttcttcgacagcaagggcttccccaagaacatcaccaacaacagaggcaagaagagataccccgacagcaaggacctgaccatggtgctgaagacctacgacaccagcttcctggacttcctgagaagatgcctggtgtgggagcccagcctgagaatgacccccgaccaggccctgaagcacgcctggatccaccagagcagaaacctgaagccccagcccagaccccagaccctgagaaagagcaacagcttcttccccagcgagaccagaaaggacaaggtgcagggctgccaccacagcagcagaaaggccgacgagatcaccaaggagaccaccgagaagaccaaggacagccccaccaagcacgtgcagcacagcggcgaccagcaggactgcctgcagcacggcgccgacaccgtgcagctgccccagctggtggacgcccccaagaagagcgaggccgccgtgggcgccgaggtgagcatgaccagccccggccagagcaagaacttcagcctgaagaacaccaacgtgctgccccccatcgtgtag

SEQ ID NO: 79766 - DNA, 1563 bp, Artificial Sequence; identical to SEQ ID NO: 79765
  Description of Artificial Sequence: Synthetic coding sequence

SEQ ID NO: 79767 - DNA, 1560 bp, Artificial Sequence
  Description of Artificial Sequence: Synthetic coding sequence
atgcccgccagcgagctgaaggccagcgagatccccttccaccccagcatcaagacccaggaccccaaggccgaggagaagagccccaagaagcagaaggtgaccctgaccgccgccgaggccctgaagctgttcaagaaccagctgagcccctacgagcagagcgagatcctgggctacgccgagctgtggttcctgggcctggaggccaagaagctggacaccgcccccgagaagttcagcaagaccagcttcgacgacgagcacggcttctacctgaaggtgctgcacgaccacatcgcctacagatacgaggtgctggagaccatcggcaagggcagcttcggccaggtggccaagtgcctggaccacaagaacaacgagctggtggccctgaagatcatcagaaacaagaagagattccaccagcaggccctgatggagctgaagatcctggaggccctgagaaagaaggacaaggacaacacctacaacgtggtgcacatgaaggacttcttctacttcagaaaccacttctgcatcaccttcgagctgctgggcatcaacctgtacgagctgatgaagaacaacaacttccagggcttcagcctgagcatcgtgagaagattcaccctgagcgtgctgaagtgcctgcagatgctgagcgtggagaagatcatccactgcgacctgaagcccgagaacatcgtgctgtaccagaagggccaggccagcgtgaaggtgatcgacttcggcagcagctgctacgagcaccagaaggtgtacacctacatccagagcagattctacagaagccccgaggtgatcctgggccacccctacgacgtggccatcgacatgtggagcctgggctgcatcaccgccgagctgtacaccggctaccccctgttccccggcgagaacgaggtggagcagctggcctgcatcatggaggtgctgggcctgccccccgccggcttcatccagaccgccagcagaagacagaccttcttcgacagcaagggcttccccaagaacatcaccaacaacagaggcaagaagagataccccgacagcaaggacctgaccatggtgctgaagacctacgacaccagcttcctggacttcctgagaagatgcctggtgtgggagcccagcctgagaatgacccccgaccaggccctgaagcacgcctggatccaccagagcagaaacctgaagccccagcccagaccccagaccctgagaaagagcaacagcttcttccccagcgagaccagaaaggacaaggtgcagggctgccaccacagcagcagaaaggacgagatcaccaaggagaccaccgagaagaccaaggacagccccaccaagcacgtgcagcacagcggcgaccagcaggactgcctgcagcacggcgccgacaccgtgcagctgccccagctggtggacgcccccaagaagagcgaggccgccgtgggcgccgaggtgagcatgaccagccccggccagagcaagaacttcagcctgaagaacaccaacgtgctgccccccatcgtgtag

SEQ ID NO: 79768 - DNA, 474 bp, Artificial Sequence
  Description of Artificial Sequence: Synthetic coding sequence
atggtgctgaagacctacgacaccagcttcctggacttcctgagaagatgcctggtgtgggagcccagcctgagaatgacccccgaccaggccctgaagcacgcctggatccaccagagcagaaacctgaagccccagcccagaccccagaccctgagaaagagcaacagcttcttccccagcgagaccagaaaggacaaggtgcagggctgccaccacagcagcagaaaggccgacgagatcaccaaggagaccaccgagaagaccaaggacagccccaccaagcacgtgcagcacagcggcgaccagcaggactgcctgcagcacggcgccgacaccgtgcagctgccccagctggtggacgcccccaagaagagcgaggccgccgtgggcgccgaggtgagcatgaccagccccggccagagcaagaacttcagcctgaagaacaccaacgtgctgccccccatcgtgtag

SEQ ID NO: 79769 - DNA, 1011 bp, Artificial Sequence
  Description of Artificial Sequence: Synthetic coding sequence
atgggcaactgcctgcacagagccgagctgagccccagcaccgagaacagcagccagctggacttcgaggacgtgtggaacagcagctacggcgtgaacgacagcttccccgacggcgactacggcgccaacctggaggccgccgccccctgccacagctgcaacctgctggacgacagcgccctgcccttcttcatcctgaccagcgtgctgggcatcctggccagcagcaccgtgctgttcatgctgttcagacccctgttcagatggcagctgtgccccggctggcccgtgctggcccagctggccgtgggcagcgccctgttcagcatcgtggtgcccgtgctggcccccggcctgggcagcaccagaagcagcgccctgtgcagcctgggctactgcgtgtggtacggcagcgccttcgcccaggccctgctgctgggctgccacgccagcctgggccacagactgggcgccggccaggtgcccggcctgaccctgggcctgaccgtgggcatctggggcgtggccgccctgctgaccctgcccgtgaccctggccagcggcgccagcggcggcctgtgcaccctgatctacagcaccgagctgaaggccctgcaggccacccacaccgtggcctgcctggccatcttcgtgctgctgcccctgggcctgttcggcgccaagggcctgaagaaggccctgggcatgggccccggcccctggatgaacatcctgtgggcctggttcatcttctggtggccccacggcgtggtgctgggcctggacttcctggtgagaagcaagctgctgctgctgagcacctgcctggcccagcaggccctggacctgctgctgaacctggccgaggccctggccatcctgcactgcgtggccacccccctgctgctggccctgttctgccaccaggccaccagaaccctgctgcccagcctgcccctgcccgagggctggagcagccacctggacaccctgggcagcaagagctag

SEQ ID NO: 79770 - DNA, 1017 bp, Artificial Sequence
  Description of Artificial Sequence: Synthetic coding sequence
atggccagcagcggctacgtgctgcaggccgagctgagccccagcaccgagaacagcagccagctggacttcgaggacgtgtggaacagcagctacggcgtgaacgacagcttccccgacggcgactacggcgccaacctggaggccgccgccccctgccacagctgcaacctgctggacgacagcgccctgcccttcttcatcctgaccagcgtgctgggcatcctggccagcagcaccgtgctgttcatgctgttcagacccctgttcagatggcagctgtgccccggctggcccgtgctggcccagctggccgtgggcagcgccctgttcagcatcgtggtgcccgtgctggcccccggcctgggcagcaccagaagcagcgccctgtgcagcctgggctactgcgtgtggtacggcagcgccttcgcccaggccctgctgctgggctgccacgccagcctgggccacagactgggcgccggccaggtgcccggcctgaccctgggcctgaccgtgggcatctggggcgtggccgccctgctgaccctgcccgtgaccctggccagcggcgccagcggcggcctgtgcaccctgatctacagcaccgagctgaaggccctgcaggccacccacaccgtggcctgcctggccatcttcgtgctgctgcccctgggcctgttcggcgccaagggcctgaagaaggccctgggcatgggccccggcccctggatgaacatcctgtgggcctggttcatcttctggtggccccacggcgtggtgctgggcctggacttcctggtgagaagcaagctgctgctgctgagcacctgcctggcccagcaggccctggacctgctgctgaacctggccgaggccctggccatcctgcactgcgtggccacccccctgctgctggccctgttctgccaccaggccaccagaaccctgctgcccagcctgcccctgcccgagggctggagcagccacctggacaccctgggcagcaagagctag

SEQ ID NO: 79771 - DNA, 1011 bp, Artificial Sequence; identical to SEQ ID NO: 79769
  Description of Artificial Sequence: Synthetic coding sequence

SEQ ID NO: 79772 - DNA, 468 bp, Artificial Sequence
  Description of Artificial Sequence: Synthetic coding sequence
atggccagcagcggctacgtgctgcaggccgagctgagccccagcaccgagaacagcagccagctggacttcgaggacgtgtggaacagcagctacggcgtgaacgacagcttccccgacggcgactacggcgccaacctggaggccgccgccccctgccacagctgcaacctgctggacgacagcgccctgcccttcttcatcctgaccagcgtgctgggcatcctggccagcagcaccgtgctgttcatgctgttcagacccctgttcagatggcagctgtgccccggctggcccgtgctggcccagctggccgtgggcagcgccctgttcagcatcgtggtgcccgtgctggcccccggcctgggcagcaccagaagcagcgccctgtgcagcctgggctactgcgtgtggtacggcagcgccttcgcccaggccctgctgctgggctgccacgccagcctgtag

SEQ ID NO: 79773 - DNA, 1011 bp, Artificial Sequence; identical to SEQ ID NO: 79769
  Description of Artificial Sequence: Synthetic coding sequence

SEQ ID NO: 79774 - DNA, 2010 bp, Artificial Sequence
  Description of Artificial Sequence: Synthetic coding sequence
atgggcagcaacagcagcagaatcggcgacctgcccaagaacgagtacctgaagaagctgagcggcaccgagagcatcagcgagaacgaccccttctggaaccagctgctgagcttcagcttccccgcccccaccagcagcagcgagctgaagctgctggaggaggccaccatcagcgtgtgcagaagcctggtggagaacaaccccagaaccggcaacctgggcgccctgatcaaggtgttcctgagcagaaccaaggagctgaagctgagcgccgagtgccagaaccacatcttcatctggcagacccacaacgccctgttcatcatctgctgcctgctgaaggtgttcatctgccagatgagcgaggaggagctgcagctgcacttcacctacgaggagaagagccccggcaactacagcagcgacagcgaggacctgctggaggagctgctgtgctgcctgatgcagctgatcaccgacatccccctgctggacatcacctacgagatcagcgtggaggccatcagcaccatggtggtgttcctgagctgccagctgttccacaaggaggtgctgagacagagcatcagccacaagtacctgatgagaggcccctgcctgccctacaccagcaagctggtgaagaccctgctgtacaacttcatcagacaggagaagccccccccccccggcgcccacgtgttcccccagcagagcgacggcggcggcctgctgtacggcctggccagcggcgtggccaccggcctgtggaccgtgttcaccctgggcggcgtgggcagcaaggccgccgccagccccgagctgagcagccccctggccaaccagagcctgctgctgctgctggtgctggccaacctgaccgacgccagcgacgcccccaacccctacagacaggccatcatgagcttcaagaacacccaggacagcagccccttccccagcagcatcccccacgccttccagatcaacttcaacagcctgtacaccgccctgtgcgagcagcagaccagcgaccaggccaccctgctgctgtacaccctgctgcaccagaacagcaacatcagaacctacatgctggccagaaccgacatggagaacctggtgctgcccatcctggagatcctgtaccacgtggaggagagaaacagccaccacgtgtacatggccctgatcatcctgctgatcctgaccgaggacgacggcttcaacagaagcatccacgaggtgatcctgaagaacatcacctggtacagcgagagagtgctgaccgagatcagcctgggcagcctgctgatcctggtggtgatcagaaccatccagtacaacatgaccagaaccagagacaagtacctgcacaccaactgcctggccgccctggccaacatgagcgcccagttcagaagcctgcaccagtacgccgcccagagaatcatcagcctgttcagcctgctgagcaagaagcacaacaaggtgctggagcaggccacccagagcctgagaggcagcctgagcagcaacgacgtgcccctgcccgactacgcccaggacctgaacgtgatcgaggaggtgatcagaatgatgctggagatcatcaacagctgcctgaccaacagcctgcaccacaaccccaacctggtgtacgccctgctgtacaagagagacctgttcgagcagttcagaacccaccccagcttccaggacatcatgcagaacatcgacctggtgatcagcttcttcagcagcagactgctgcaggccggcgccgagctgagcgtggagagagtgctggagatcatcaagcagggcgtggtggccctgcccaaggacagactgaagaagttccccgagctgaagttcaagtacgtggaggaggagcagcccgaggagttcttcatcccctacgtgtggagcctggtgtacaacagcgccgtgggcctgtactggaacccccaggacatccagctgttcaccatggacagcgactag

SEQ ID NO: 79775 - DNA, 519 bp, Artificial Sequence
  Description of Artificial Sequence: Synthetic coding sequence
atggccctgatcatcctgctgatcctgaccgaggacgacggcttcaacagaagcatccacgaggtgatcctgaagaacatcacctggtacagcgagagagtgctgaccgagatcagcctgggcagcctgctgatcctggtggtgatcagaaccatccagtacaacatgaccagaaccagagacaagtacctgcacaccaactgcctggccgccctggccaacatgagcgcccagttcagaagcctgcaccagtacgccgcccagagaatcatcagctacacctgcagacacctgagaagatacgtgtacgtgctggacaagctgtacttcccccacagccactgcagcaccctgcagcactgcttcagcaccctgagcgacaacggcgaggagctgctgagcctgacctgcagccacatcctgagaagctacgccagcagcctgttcagcctgctgagcaagaagcacaacaaggtgctggagcaggccacccagagcctgagaggcagcctgagctag

SEQ ID NO: 79776 - DNA, 1440 bp, Artificial Sequence
  Description of Artificial Sequence: Synthetic coding sequence
atgggcagcaacagcagcagaatcggcgacctgcccaagaacgagtacctgaagaagctgagcggcaccgagagcatcagcgagaacgaccccttctggaaccagctgctgagcttcagcttccccgcccccaccagcagcagcgagctgaagctgctggaggaggccaccatcagcgtgtgcagaagcctggccggcctgtggaccgtgttcaccctgggcggcgtgggcagcaaggccgccgccagccccgagctgagcagccccctggccaaccagagcctgctgctgctgctggtgctggccaacctgaccgacgccagcgacgcccccaacccctacagacaggccatcatgagcttcaagaacacccaggacagcagccccttccccagcagcatcccccacgccttccagatcaacttcaacagcctgtacaccgccctgtgcgagcagcagaccagcgaccaggccaccctgctgctgtacaccctgctgcaccagaacagcaacatcagaacctacatgctggccagaaccgacatggagaacctggtgctgcccatcctggagatcctgtaccacgtggaggagagaaacagccaccacgtgtacatggccctgatcatcctgctgatcctgaccgaggacgacggcttcaacagaagcatccacgaggtgatcctgaagaacatcacctggtacagcgagagagtgctgaccgagatcagcctgggcagcctgctgatcctggtggtgatcagaaccatccagtacaacatgaccagaaccagagacaagtacctgcacaccaactgcctggccgccctggccaacatgagcgcccagttcagaagcctgcaccagtacgccgcccagagaatcatcagcctgttcagcctgctgagcaagaagcacaacaaggtgctggagcaggccacccagagcctgagaggcagcctgagcagcaacgacgtgcccctgcccgactacgcccaggacctgaacgtgatcgaggaggtgatcagaatgatgctggagatcatcaacagctgcctgaccaacagcctgcaccacaaccccaacctggtgtacgccctgctgtacaagagagacctgttcgagcagttcagaacccaccccagcttccaggacatcatgcagaacatcgacctggtgatcagcttcttcagcagcagactgctgcaggccggcgccgagctgagcgtggagagagtgctggagatcatcaagcagggcgtggtggccctgcccaaggacagactgaagaagttccccgagctgaagttcaagtacgtggaggaggagcagcccgaggagttcttcatcccctacgtgtggagcctggtgtacaacagcgccgtgggcctgtactggaacccccaggacatccagctgttcaccatggacagcgactag

SEQ ID NO: 79777 - DNA, 3837 bp, Artificial Sequence
  Description of Artificial Sequence: Synthetic coding sequence
atggcccagagcaagagacacgtgtacagcagaacccccagcggcagcagaatgagcgccgaggccagcgccagacccctgagagtgggcagcagagtggaggtgatcggcaagggccacagaggcaccgtggcctacgtgggcgccaccctgttcgccaccggcaagtgggtgggcgtgatcctggacgaggccaagggcaagaacgacggcaccgtgcagggcagaaagtacttcacctgcgacgagggccacggcatcttcgtgagacagagccagatccaggtgttcgaggacggcgccgacaccaccagccccgagacccccgacagcagcgccagcaaggtgctgaagagagagggcaccgacaccaccgccaagaccagcaagctgagaggcctgaagcccaagaaggcccccaccgccagaaagaccaccaccagaagacccaagcccaccagacccgccagcaccggcgtggccggcgccagcagcagcctgggccccagcggcagcgccagcgccggcgagctgagcagcagcgagcccagcacccccgcccagacccccctggccgcccccatcatccccacccccgtgctgaccagccccggcgccgtgccccccctgcccagccccagcaaggaggaggagggcctgagagcccaggtgagagacctggaggagaagctggagaccctgagactgaagagagccgaggacaaggccaagctgaaggagctggagaagcacaagatccagctggagcaggtgcaggagtggaagagcaagatgcaggagcagcaggccgacctgcagagaagactgaaggaggccagaaaggaggccaaggaggccctggaggccaaggagagatacatggaggagatggccgacaccgccgacgccatcgagatggccaccctggacaaggagatggccgaggagagagccgagagcctgcagcaggaggtggaggccctgaaggagagagtggacgagctgaccaccgacctggagatcctgaaggccgagatcgaggagaagggcagcgacggcgccgccagcagctaccagctgaagcagctggaggagcagaacgccagactgaaggacgccctggtgagaatgagagacctgagcagcagcgagaagcaggagcacgtgaagctgcagaagctgatggagaagaagaaccaggagctggaggtggtgagacagcagagagagagactgcaggaggagctgagccaggccgagagcaccatcgacgagctgaaggagcaggtggacgccgccctgggcgccgaggagatggtggagatgctgaccgacagaaacctgaacctggaggagaaggtgagagagctgagagagaccgtgggcgacctggaggccatgaacgagatgaacgacgagctgcaggagaacgccagagagaccgagctggagctgagagagcagctggacatggccggcgccagagtgagagaggcccagaagagagtggaggccgcccaggagaccgtggccgactaccagcagaccatcaagaagtacagacagctgaccgcccacctgcaggacgtgaacagagagctgaccaaccagcaggaggccagcgtggagagacagcagcagcccccccccgagaccttcgacttcaagatcaagttcgccgagaccaaggcccacgccaaggccatcgagatggagctgagacagatggaggtggcccaggccaacagacacatgagcctgctgaccgccttcatgcccgacagcttcctgagacccggcggcgaccacgactgcgtgctggtgctgctgctgatgcccagactgatctgcaaggccgagctgatcagaaagcaggcccaggagaagttcgagctgagcgagaactgcagcgagagacccggcctgagaggcgccgccggcgagcagctgagcttcgccgccggcctggtgtacagcctgagcctgctgcaggccaccctgcacagatacgagcacgccctgagccagtgcagcgtggacgtgtacaagaaggtgggcagcctgtaccccgagatgagcgcccacgagagaagcctggacttcctgatcgagctgctgcacaaggaccagctggacgagaccgtgaacgtggagcccctgaccaaggccatcaagtactaccagcacctgtacagcatccacctggccgagcagcccgaggactgcaccatgcagctggccgaccacatcaagttcacccagagcgccctggactgcatgagcgtggaggtgggcagactgagagccttcctgcagggcggccaggaggccaccgacatcgccctgctgctgagagacctggagaccagctgcagcgacatcagacagttctgcaagaagatcagaagaagaatgcccggcaccgacgcccccggcatccccgccgccctggccttcggcccccaggtgagcgacaccctgctggactgcagaaagcacctgacctgggtggtggccgtgctgcaggaggtggccgccgccgccgcccagctgatcgcccccctggccgagaacgagggcctgctggtggccgccctggaggagctggccttcaaggccagcgagcagatctacggcacccccagcagcagcccctacgagtgcctgagacagagctgcaacatcctgatcagcaccatgaacaagctggccaccgccatgcaggagggcgagtacgacgccgagagaccccccagcaagcccccccccgtggagctgagagccgccgccctgagagccgagatcaccgacgccgagggcctgggcctgaagctggaggacagagagaccgtgatcaaggagctgaagaagagcctgaagatcaagggcgaggagctgagcgaggccaacgtgagactgagcctgctggagaagaagctggacagcgccgccaaggacgccgacgagagaatcgagaaggtgcagaccagactggaggagacccaggccctgctgagaaagaaggagaaggagttcgaggagaccatggacgccctgcaggccgacatcgaccagctggaggccgagaaggccgagctgaagcagagactgaacagccagagcaagagaaccatcgagggcctgagaggccccccccccagcggcatcgccaccctggtgagcggcatcgccggcgaggagcagcagagaggcgccatccccggccaggcccccggcagcgtgcccggccccggcctggtgaaggacagccccctgctgctgcagcagatcagcgccatgagactgcacatcagccagctgcagcacgagaacagcatcctgaagggcgcccagatgaaggccagcctggccagcctgccccccctgcacgtggccaagctgagccacgagggccccggcagcgagctgcccgccggcgccctgtacagaaagaccagccagctgctggagaccctgaaccagctgagcacccacacccacgtggtggacatcaccagaaccagccccgccgccaagagccccagcgcccagctgatggagcaggtggcccagctgaagagcctgagcgacaccgtggagaagctgaaggacgaggtgctgaaggagaccgtgagccagagacccggcgccaccgtgcccaccgacttcgccaccttccccagcagcgccttcctgagagccaaggaggagcagcaggacgacaccgtgtacatgggcaaggtgaccttcagctgcgccgccggcttcggccagagacacagactggtgctgacccaggagcagctgcaccagctgcacagcagactgatcagctag

SEQ ID NO: 79778 - DNA, 3786 bp, Artificial Sequence
  Description of Artificial Sequence: Synthetic coding sequence
atgagcgccgaggccagcgccagacccctgagagtgggcagcagagtggaggtgatcggcaagggccacagaggcaccgtggcctacgtgggcgccaccctgttcgccaccggcaagtgggtgggcgtgatcctggacgaggccaagggcaagaacgacggcaccgtgcagggcagaaagtacttcacctgcgacgagggccacggcatcttcgtgagacagagccagatccaggtgttcgaggacggcgccgacaccaccagccccgagacccccgacagcagcgccagcaaggtgctgaagagagagggcaccgacaccaccgccaagaccagcaagctgagaggcctgaagcccaagaaggcccccaccgccagaaagggcagaagagtgagaaccaagcccaccagacccgccagcaccggcgtggccggcgccagcagcagcctgggccccagcggcagcgccagcgccggcgagctgagcagcagcgagcccagcacccccgcccagacccccctggccgcccccatcatccccacccccgtgctgaccagccccggcgccgtgccccccctgcccagccccagcaaggaggaggagggcctgagagcccaggtgagagacctggaggagaagctggagaccctgagactgaagagagccgaggacaaggccaagctgaaggagctggagaagcacaagatccagctggagcaggtgcaggagtggaagagcaagatgcaggagcagcaggccgacctgcagagaagactgaaggaggccagaaaggaggccaaggaggccctggaggccaaggagagatacatggaggagatggccgacaccgccgacgccatcgagatggccaccctggacaaggagatggccgaggagagagccgagagcctgcagcaggaggtggaggccctgaaggagagagtggacgagctgaccaccgacctggagatcctgaaggccgagatcgaggagaagggcagcgacggcgccgccagcagctaccagctgaagcagctggaggagcagaacgccagactgaaggacgccctggtgagaatgagagacctgagcagcagcgagaagcaggagcacgtgaagctgcagaagctgatggagaagaagaaccaggagctggaggtggtgagacagcagagagagagactgcaggaggagctgagccaggccgagagcaccatcgacgagctgaaggagcaggtggacgccgccctgggcgccgaggagatggtggagatgctgaccgacagaaacctgaacctggaggagaaggtgagagagctgagagagaccgtgggcgacctggaggccatgaacgagatgaacgacgagctgcaggagaacgccagagagaccgagctggagctgagagagcagctggacatggccggcgccagagtgagagaggcccagaagagagtggaggccgcccaggagaccgtggccgactaccagcagaccatcaagaagtacagacagctgaccgcccacctgcaggacgtgaacagagagctgaccaaccagcaggaggccagcgtggagagacagcagcagcccccccccgagaccttcgacttcaagatcaagttcgccgagaccaaggcccacgccaaggccatcgagatggagctgagacagatggaggtggcccaggccaacagacacatgagcctgctgaccgccttcatgcccgacagcttcctgagacccggcggcgaccacgactgcgtgctggtgctgctgctgatgcccagactgatctgcaaggccgagctgatcagaaagcaggcccaggagaagttcgagctgagcgagaactgcagcgagagacccggcctgagaggcgccgccggcgagcagctgagcttcgccgccggcctggtgtacagcctgagcctgctgcaggccaccctgcacagatacgagcacgccctgagccagtgcagcgtggacgtgtacaagaaggtgggcagcctgtaccccgagatgagcgcccacgagagaagcctggacttcctgatcgagctgctgcacaaggaccagctggacgagaccgtgaacgtggagcccctgaccaaggccatcaagtactaccagcacctgtacagcatccacctggccgagcagcccgaggactgcaccatgcagctggccgaccacatcaagttcacccagagcgccctggactgcatgagcgtggaggtgggcagactgagagccttcctgcagggcggccaggaggccaccgacatcgccctgctgctgagagacctggagaccagctgcagcgacatcagacagttctgcaagaagatcagaagaagaatgcccggcaccgacgcccccggcatccccgccgccctggccttcggcccccaggtgagcgacaccctgctggactgcagaaagcacctgacctgggtggtggccgtgctgcaggaggtggccgccgccgccgcccagctgatcgcccccctggccgagaacgagggcctgctggtggccgccctggaggagctggccttcaaggccagcgagcagatctacggcacccccagcagcagcccctacgagtgcctgagacagagctgcaacatcctgatcagcaccatgaacaagctggccaccgccatgcaggagggcgagtacgacgccgagagaccccccagcaagcccccccccgtggagctgagagccgccgccctgagagccgagatcaccgacgccgagggcctgggcctgaagctggaggacagagagaccgtgatcaaggagctgaagaagagcctgaagatcaagggcgaggagctgagcgaggccaacgtgagactgagcctgctggagaagaagctggacagcgccgccaaggacgccgacgagagaatcgagaaggtgcagaccagactggaggagacccaggccctgctgagaaagaaggagaaggagttcgaggagaccatggacgccctgcaggccgacatcgaccagctggaggccgagaaggccgagctgaagcagagactgaacagccagagcaagagaaccatcgagggcctgagaggccccccccccagcggcatcgccaccctggtgagcggcatcgccggcgaggagcagcagagaggcgccatccccggccaggcccccggcagcgtgcccggccccggcctggtgaaggacagccccctgctgctgcagcagatcagcgccatgagactgcacatcagccagctgcagcacgagaacagcatcctgaagggcgcccagatgaaggccagcctggccagcctgccccccctgcacgtggccaagctgagccacgagggccccggcagcgagctgcccgccggcgccctgtacagaaagaccagccagctgctggagaccctgaaccagctgagcacccacacccacgtggtggacatcaccagaaccagccccgccgccaagagccccagcgcccagctgatggagcaggtggcccagctgaagagcctgagcgacaccgtggagaagctgaaggacgaggtgctgaaggagaccgtgagccagagacccggcgccaccgtgcccaccgacttcgccaccttccccagcagcgccttcctgagagccaaggaggagcagcaggacgacaccgtgtacatgggcaaggtgaccttcagctgcgccgccggcttcggccagagacacagactggtgctgacccaggagcagctgcaccagctgcacagcagactgatcagctag

SEQ ID NO: 79779 - DNA, 3816 bp, Artificial Sequence
  Description of Artificial Sequence: Synthetic coding sequence
atggcccagagcaagagacacgtgtacagcagaacccccagcggcagcagaatgagcgccgaggccagcgccagacccctgagagtgggcagcagagtggaggtgatcggcaagggccacagaggcaccgtggcctacgtgggcgccaccctgttcgccaccggcaagtgggtgggcgtgatcctggacgaggccaagggcaagaacgacggcaccgtgcagggcagaaagtacttcacctgcgacgagggccacggcatcttcgtgagacagagccagatccaggtgttcgaggacggcgccgacaccaccagccccgagacccccgacagcagcgccagcaaggtgctgaagagagagggcaccgacaccaccgccaagaccagcaagctggcccccaccgccagaaagaccaccaccagaagacccaagcccaccagacccgccagcaccggcgtggccggcgccagcagcagcctgggccccagcggcagcgccagcgccggcgagctgagcagcagcgagcccagcacccccgcccagacccccctggccgcccccatcatccccacccccgtgctgaccagccccggcgccgtgccccccctgcccagccccagcaaggaggaggagggcctgagagcccaggtgagagacctggaggagaagctggagaccctgagactgaagagagccgaggacaaggccaagctgaaggagctggagaagcacaagatccagctggagcaggtgcaggagtggaagagcaagatgcaggagcagcaggccgacctgcagagaagactgaaggaggccagaaaggaggccaaggaggccctggaggccaaggagagatacatggaggagatggccgacaccgccgacgccatcgagatggccaccctggacaaggagatggccgaggagagagccgagagcctgcagcaggaggtggaggccctgaaggagagagtggacgagctgaccaccgacctggagatcctgaaggccgagatcgaggagaagggcagcgacggcgccgccagcagctaccagctgaagcagctggaggagcagaacgccagactgaaggacgccctggtgagaatgagagacctgagcagcagcgagaagcaggagcacgtgaagctgcagaagctgatggagaagaagaaccaggagctggaggtggtgagacagcagagagagagactgcaggaggagctgagccaggccgagagcaccatcgacgagctgaaggagcaggtggacgccgccctgggcgccgaggagatggtggagatgctgaccgacagaaacctgaacctggaggagaaggtgagagagctgagagagaccgtgggcgacctggaggccatgaacgagatgaacgacgagctgcaggagaacgccagagagaccgagctggagctgagagagcagctggacatggccggcgccagagtgagagaggcccagaagagagtggaggccgcccaggagaccgtggccgactaccagcagaccatcaagaagtacagacagctgaccgcccacctgcaggacgtgaacagagagctgaccaaccagcaggaggccagcgtggagagacagcagcagcccccccccgagaccttcgacttcaagatcaagttcgccgagaccaaggcccacgccaaggccatcgagatggagctgagacagatggaggtggcccaggccaacagacacatgagcctgctgaccgccttcatgcccgacagcttcctgagacccggcggcgaccacgactgcgtgctggtgctgctgctgatgcccagactgatctgcaaggccgagctgatcagaaagcaggcccaggagaagttcgagctgagcgagaactgcagcgagagacccggcctgagaggcgccgccggcgagcagctgagcttcgccgccggcctggtgtacagcctgagcctgctgcaggccaccctgcacagatacgagcacgccctgagccagtgcagcgtggacgtgtacaagaaggtgggcagcctgtaccccgagatgagcgcccacgagagaagcctggacttcctgatcgagctgctgcacaaggaccagctggacgagaccgtgaacgtggagcccctgaccaaggccatcaagtactaccagcacctgtacagcatccacctggccgagcagcccgaggactgcaccatgcagctggccgaccacatcaagttcacccagagcgccctggactgcatgagcgtggaggtgggcagactgagagccttcctgcagggcggccaggaggccaccgacatcgccctgctgctgagagacctggagaccagctgcagcgacatcagacagttctgcaagaagatcagaagaagaatgcccggcaccgacgcccccggcatccccgccgccctggccttcggcccccaggtgagcgacaccctgctggactgcagaaagcacctgacctgggtggtggccgtgctgcaggaggtggccgccgccgccgcccagctgatcgcccccctggccgagaacgagggcctgctggtggccgccctggaggagctggccttcaaggccagcgagcagatctacggcacccccagcagcagcccctacgagtgcctgagacagagctgcaacatcctgatcagcaccatgaacaagctggccaccgccatgcaggagggcgagtacgacgccgagagaccccccagcaagcccccccccgtggagctgagagccgccgccctgagagccgagatcaccgacgccgagggcctgggcctgaagctggaggacagagagaccgtgatcaaggagctgaagaagagcctgaagatcaagggcgaggagctgagcgaggccaacgtgagactgagcctgctggagaagaagctggacagcgccgccaaggacgccgacgagagaatcgagaaggtgcagaccagactggaggagacccaggccctgctgagaaagaaggagaaggagttcgaggagaccatggacgccctgcaggccgacatcgaccagctggaggccgagaaggccgagctgaagcagagactgaacagccagagcaagagaaccatcgagggcctgagaggccccccccccagcggcatcgccaccctggtgagcggcatcgccggcgaggagcagcagagaggcgccatccccggccaggcccccggcagcgtgcccggccccggcctggtgaaggacagccccctgctgctgcagcagatcagcgccatgagactgcacatcagccagctgcagcacgagaacagcatcctgaagggcgcccagatgaaggccagcctggccagcctgccccccctgcacgtggccaagctgagccacgagggccccggcagcgagctgcccgccggcgccctgtacagaaagaccagccagctgctggagaccctgaaccagctgagcacccacacccacgtggtggacatcaccagaaccagccccgccgccaagagccccagcgcccagctgatggagcaggtggcccagctgaagagcctgagcgacaccgtggagaagctgaaggacgaggtgctgaaggagaccgtgagccagagacccggcgccaccgtgcccaccgacttcgccaccttccccagcagcgccttcctgagagccaaggaggagcagcaggacgacaccgtgtacatgggcaaggtgaccttcagctgcgccgccggcttcggccagagacacagactggtgctgacccaggagcagctgcaccagctgcacagcagactgatcagctag

SEQ ID NO: 79780 - DNA, 3435 bp, Artificial Sequence
  Description of Artificial Sequence: Synthetic coding sequence
atgatgagacaggcccccaccgccagaaagaccaccaccagaagacccaagcccaccagacccgccagcaccggcgtggccggcgccagcagcagcctgggccccagcggcagcgccagcgccggcgagctgagcagcagcgagcccagcacccccgcccagacccccctggccgcccccatcatccccacccccgtgctgaccagccccggcgccgtgccccccctgcccagccccagcaaggaggaggagggcctgagagcccaggtgagagacctggaggagaagctggagaccctgagactgaagagagccgaggacaaggccaagctgaaggagctggagaagcacaagatccagctggagcaggtgcaggagtggaagagcaagatgcaggagcagcaggccgacctgcagagaagactgaaggaggccagaaaggaggccaaggaggccctggaggccaaggagagatacatggaggagatggccgacaccgccgacgccatcgagatggccaccctggacaaggagatggccgaggagagagccgagagcctgcagcaggaggtggaggccctgaaggagagagtggacgagctgaccaccgacctggagatcctgaaggccgagatcgaggagaagggcagcgacggcgccgccagcagctaccagctgaagcagctggaggagcagaacgccagactgaaggacgccctggtgagaatgagagacctgagcagcagcgagaagcaggagcacgtgaagctgcagaagctgatggagaagaagaaccaggagctggaggtggtgagacagcagagagagagactgcaggaggagctgagccaggccgagagcaccatcgacgagctgaaggagcaggtggacgccgccctgggcgccgaggagatggtggagatgctgaccgacagaaacctgaacctggaggagaaggtgagagagctgagagagaccgtgggcgacctggaggccatgaacgagatgaacgacgagctgcaggagaacgccagagagaccgagctggagctgagagagcagctggacatggccggcgccagagtgagagaggcccagaagagagtggaggccgcccaggagaccgtggccgactaccagcagaccatcaagaagtacagacagctgaccgcccacctgcaggacgtgaacagagagctgaccaaccagcaggaggccagcgtggagagacagcagcagcccccccccgagaccttcgacttcaagatcaagttcgccgagaccaaggcccacgccaaggccatcgagatggagctgagacagatggaggtggcccaggccaacagacacatgagcctgctgaccgccttcatgcccgacagcttcctgagacccggcggcgaccacgactgcgtgctggtgctgctgctgatgcccagactgatctgcaaggccgagctgatcagaaagcaggcccaggagaagttcgagctgagcgagaactgcagcgagagacccggcctgagaggcgccgccggcgagcagctgagcttcgccgccggcctggtgtacagcctgagcctgctgcaggccaccctgcacagatacgagcacgccctgagccagtgcagcgtggacgtgtacaagaaggtgggcagcctgtaccccgagatgagcgcccacgagagaagcctggacttcctgatcgagctgctgcacaaggaccagctggacgagaccgtgaacgtggagcccctgaccaaggccatcaagtactaccagcacctgtacagcatccacctggccgagcagcccgaggactgcaccatgcagctggccgaccacatcaagttcacccagagcgccctggactgcatgagcgtggaggtgggcagactgagagccttcctgcagggcggccaggaggccaccgacatcgccctgctgctgagagacctggagaccagctgcagcgacatcagacagttctgcaagaagatcagaagaagaatgcccggcaccgacgcccccggcatccccgccgccctggccttcggcccccaggtgagcgacaccctgctggactgcagaaagcacctgacctgggtggtggccgtgctgcaggaggtggccgccgccgccgcccagctgatcgcccccctggccgagaacgagggcctgctggtggccgccctggaggagctggccttcaaggccagcgagcagatctacggcacccccagcagcagcccctacgagtgcctgagacagagctgcaacatcctgatcagcaccatgaacaagctggccaccgccatgcaggagggcgagtacgacgccgagagaccccccagcaagcccccccccgtggagctgagagccgccgccctgagagccgagatcaccgacgccgagggcctgggcctgaagctggaggacagagagaccgtgatcaaggagctgaagaagagcctgaagatcaagggcgaggagctgagcgaggccaacgtgagactgagcctgctggagaagaagctggacagcgccgccaaggacgccgacgagagaatcgagaaggtgcagaccagactggaggagacccaggccctgctgagaaagaaggagaaggagttcgaggagaccatggacgccctgcaggccgacatcgaccagctggaggccgagaaggccgagctgaagcagagactgaacagccagagcaagagaaccatcgagggcctgagaggccccccccccagcggcatcgccaccctggtgagcggcatcgccggcgaggagcagcagagaggcgccatccccggccaggcccccggcagcgtgcccggccccggcctggtgaaggacagccccctgctgctgcagcagatcagcgccatgagactgcacatcagccagctgcagcacgagaacagcatcctgaagggcgcccagatgaaggccagcctggccagcctgccccccctgcacgtggccaagctgagccacgagggccccggcagcgagctgcccgccggcgccctgtacagaaagaccagccagctgctggagaccctgaaccagctgagcacccacacccacgtggtggacatcaccagaaccagccccgccgccaagagccccagcgcccagctgatggagcaggtggcccagctgaagagcctgagcgacaccgtggagaagctgaaggacgaggtgctgaaggagaccgtgagccagagacccggcgccaccgtgcccaccgacttcgccaccttccccagcagcgccttcctgagagccaaggaggagcagcaggacgacaccgtgtacatgggcaaggtgaccttcagctgcgccgccggcttcggccagagacacagactggtgctgacccaggagcagctgcaccagctgcacagcagactgatcagctag

SEQ ID NO: 79781 - DNA, 3771 bp, Artificial Sequence
  Description of Artificial Sequence: Synthetic coding sequence
atgagcgccgaggccagcgccagacccctgagagtgggcagcagagtggaggtgatcggcaagggccacagaggcaccgtggcctacgtgggcgccaccctgttcgccaccggcaagtgggtgggcgtgatcctggacgaggccaagggcaagaacgacggcaccgtgcagggcagaaagtacttcacctgcgacgagggccacggcatcttcgtgagacagagccagatccaggtgttcgaggacggcgccgacaccaccagccccgagacccccgacagcagcgccagcaaggtgctgaagagagagggcaccgacaccaccgccaagaccagcaagctgagaggcctgaagcccaagaaggcccccaccgccagaaagaccaccaccagaagacccaagcccaccagacccgccagcaccggcgtggccggcgccagcagcagcctgggccccagcggcagcgccagcgccggcgagctgagcagcagcgagcccagcacccccgcccagacccccctggccgcccccatcatccccacccccgtgctgaccagccccggcgccgtgccccccctgcccagccccagcaaggaggaggagggcctgagagcccaggtgagagacctggaggagaagctggagaccctgagactgaagagagccgaggacaaggccaagctgaaggagctggagaagcacaagatccagctggagcaggtgcaggagtggaagagcaagatgcaggagcagcaggccgacctgcagagaagactgaaggaggccagaaaggaggccaaggaggccctggaggccaaggagagatacatggaggagatggccgacaccgccgacgccatcgagatggccaccctggacaaggagatggccgaggagagagccgagagcctgcagcaggaggtggaggccctgaaggagagagtggacgagctgaccaccgacctggagatcctgaaggccgagatcgaggagaagggcagcgacggcgccgccagcagctaccagctgaagcagctggaggagcagaacgccagactgaaggacgccctggtgagaatgagagacctgagcagcagcgagaagcaggagcacgtgaagctgcagaagctgatggagaagaagaaccaggagctggaggtggtgagacagcagagagagagactgcaggaggagctgagccaggccgagagcaccatcgacgagctgaaggagcaggtggacgccgccctgggcgccgaggagatggtggagatgctgaccgacagaaacctgaacctggaggagaaggtgagagagctgagagagaccgtgggcgacctggaggccatgaacgagatgaacgacgagctgcaggagaacgccagagagaccgagctggagctgagagagcagctggacatggccggcgccagagtgagagaggcccagaagagagtggaggccgcccaggagaccgtggccgactaccagcagaccatcaagaagtacagacagctgaccgcccacctgcaggacgtgaacagagagctgaccaaccagcaggaggccagcgtggagagacagcagcagcccccccccgagaccttcgacttcaagatcaagttcgccgagaccaaggcccacgccaaggccatcgagatggagctgagacagatggaggtggcccaggccaacagacacatgagcctgctgaccgccttcatgcccgacagcttcctgagacccggcggcgaccacgactgcgtgctggtgctgctgctgatgcccagactgatctgcaaggccgagctgatcagaaagcaggcccaggagaagttcgagctgagcgagaactgcagcgagagacccggcctgagaggcgccgccggcgagcagctgagcttcgccgccggcctggtgtacagcctgagcctgctgcaggccaccctgcacagatacgagcacgccctgagccagtgcagcgtggacgtgtacaagaaggtgggcagcctgtaccccgagatgagcgcccacgagagaagcctggacttcctgatcgagctgctgcacaaggaccagctggacgagaccgtgaacgtggagcccctgaccaaggccatcaagtactaccagcacctgtacagcatccacctggccgagcagcccgaggactgcaccatgcagctggccgaccacatcaagttcacccagagcgccctggactgcatgagcgtggaggtgggcagactgagagccttcctgcagggcggccaggaggccaccgacatcgccctgctgctgagagacctggagaccagctgcagcgacatcagacagttctgcaagaagatcagaagaagaatgcccggcaccgacgcccccggcatccccgccgccctggccttcggcccccaggtgagcgacaccctgctggactgcagaaagcacctgacctgggtggtggccgtgctgcaggaggtggccgccgccgccgcccagctgatcgcccccctggccgagaacgagggcctgctggtggccgccctggaggagctggccttcaaggccagcgagcagatctacggcacccccagcagcagcccctacgagtgcctgagacagagctgcaacatcctgatcagcaccatgaacaagctggccaccgccatgcaggagggcgagtacgacgccgagagaccccccagcaagcccccccccgtggagctgagagccgccgccctgagagccgagatcaccgacgccgagggcctgggcctgaagctggaggacagagagaccgtgatcaaggagctgaagaagagcctgaagatcaagggcgaggagctgagcgaggccaacgtgagactgagcctgctggagaagaagctggacagcgccgccaaggacgccgacgagagaatcgagaaggtgcagaccagactggaggagacccaggccctgctgagaaagaaggagaaggagttcgaggagaccatggacgccctgcaggccgacatcgaccagctggaggccgagaaggccgagctgaagcagagactgaacagccagagcaagagaaccatcgagggcctgagaggccccccccccagcggcatcgccaccctggtgagcggcatcgccggcggcgccatccccggccaggcccccggcagcgtgcccggccccggcctggtgaaggacagccccctgctgctgcagcagatcagcgccatgagactgcacatcagccagctgcagcacgagaacagcatcctgaagggcgcccagatgaaggccagcctggccagcctgccccccctgcacgtggccaagctgagccacgagggccccggcagcgagctgcccgccggcgccctgtacagaaagaccagccagctgctggagaccctgaaccagctgagcacccacacccacgtggtggacatcaccagaaccagccccgccgccaagagccccagcgcccagctgatggagcaggtggcccagctgaagagcctgagcgacaccgtggagaagctgaaggacgaggtgctgaaggagaccgtgagccagagacccggcgccaccgtgcccaccgacttcgccaccttccccagcagcgccttcctgagagccaaggaggagcagcaggacgacaccgtgtacatgggcaaggtgaccttcagctgcgccgccggcttcggccagagacacagactggtgctgacccaggagcagctgcaccagctgcacagcagactgatcagctag

SEQ ID NO: 79782 - DNA, 2673 bp, Artificial Sequence
  Description of Artificial Sequence: Synthetic coding sequence
atgagcgccgaggccagcgccagacccctgagagtgggcagcagagtggaggtgatcggcaagggccacagaggcaccgtggcctacgtgggcgccaccctgttcgccaccggcaagtgggtgggcgtgatcctggacgaggccaagggcaagaacgacggcaccgtgcagggcagaaagtacttcacctgcgacgagggccacggcatcttcgtgagacagagccagatccaggtgttcgaggacggcgccgacaccaccagccccgagacccccgacagcagcgccagcaaggtgctgaagagagagggcaccgacaccaccgccaagaccagcaagctgcccaccagacccgccagcaccggcgtggccggcgccagcagcagcctgggccccagcggcagcgccagcgccggcgagctgagcagcagcgagcccagcacccccgcccagacccccctggccgcccccatcatccccacccccgtgctgaccagccccggcgccgtgccccccctgcccagccccagcaaggaggaggagggcctgagagcccaggtgagagacctggaggagaagctggagaccctgagactgaagagagccgaggacaaggccaagctgaaggagctggagaagcacaagatccagctggagcaggtgcaggagtggaagagcaagatgcaggagcagcaggccgacctgcagagaagactgaaggaggccagaaaggaggccaaggaggccctggaggccaaggagagatacatggaggagatggccgacaccgccgacgccatcgagatggccaccctggacaaggagatggccgaggagagagccgagagcctgcagcaggaggtggaggccctgaaggagagagtggacgagctgaccaccgacctggagatcctgaaggccgagatcgaggagaagggcagcgacggcgccgccagcagctaccagctgaagcagctggaggagcagaacgccagactgaaggacgccctggtgagaatgagagacctgagcagcagcgagaagcaggagcacgtgaagctgcagaagctgatggagaagaagaaccaggagctggaggtggtgagacagcagagagagagactgcaggaggagctgagccaggccgagagcaccatcgacgagctgaaggagcaggtggacgccgccctgggcgccgaggagatggtggagatgctgaccgacagaaacctgaacctggaggagaaggtgagagagctgagagagaccgtgggcgacctggaggccatgaacgagatgaacgacgagctgcaggagaacgccagagagaccgagctggagctgagagagcagctggacatggccggcgccagagtgagagaggcccagaagagagtggaggccgcccaggagaccgtggccgactaccagcagaccatcaagaagtacagacagctgaccgcccacctgcaggacgtgaacagagagctgaccaaccagcaggaggccagcgtggagagacagcagcagcccccccccgagaccttcgacttcaagatcaagttcgccgagaccaaggcccacgccaaggccatcgagatggagctgagacagatggaggtggcccaggccaacagacacatgagcctgctgaccgccttcatgcccgacagcttcctgagacccggcggcgaccacgactgcgtgctggtgctgctgctgatgcccagactgatctgcaaggccgagctgatcagaaagcaggcccaggagaagttcgagctgagcgagaactgcagcgagagacccggcctgagaggcgccgccggcgagcagctgagcttcgccgccggcctggtgtacagcctgagcctgctgcaggccaccctgcacagatacgagcacgccctgagccagtgcagcgtggacgtgtacaagaaggtgggcagcctgtaccccgagatgagcgcccacgagagaagcctggacttcctgatcgagctgctgcacaaggaccagctggacgagaccgtgaacgtggagcccctgaccaaggccatcaagtactaccagcacctgtacagcatccacctggccgagcagcccgaggactgcaccatgcagctggccgaccacatcaagttcacccagagcgccctggactgcatgagcgtggaggtgggcagactgagagccttcctgcagggcggccaggaggccaccgacatcgccctgctgctgagagacctggagaccagctgcagcgacatcagacagttctgcaagaagatcagaagaagaatgcccggcaccgacgcccccggcatccccgccgccctggccttcggcccccaggtgagcgacaccctgctggactgcagaaagcacctgacctgggtggtggccgtgctgcaggaggtggccgccgccgccgcccagctgatcgcccccctggccgagaacgagggcctgctggtggccgccctggaggagctggccttcaaggccagcgagcaggtgggcctggacggctgggtggagggcgtgggcagagtgagcgaccagtgcggcgccttcaccagcgccctgggcagctgcagaagcatgggccccccccccgccgcccccatgagcgtgtgcgccagccacgccaccagcagcagcgtgccctag

SEQ ID NO: 79783 - DNA, 561 bp, Artificial Sequence
  Description of Artificial Sequence: Synthetic coding sequence
atgctgatgggcctgctgagaccctacatcctgggcgagagaggcaccgtgatgacccccagcggcagcagaatgagcgccgaggccagcgccagacccctgagagtgggcagcagagtggaggtgatcggcaagggccacagaggcaccgtggcctacgtgggcgccaccctgttcgccaccggcaagtgggtgggcgtgatcctggacgaggccaagggcaagaacgacggcaccgtgcagggcagaaagtacttcacctgcgacgagggccacggcatcttcgtgagacagagccagatccaggtgttcgaggacggcgccgacaccaccagccccgagacccccgacagcagcgccagcaaggtgctgaagagagagggcaccgacaccaccgccaagaccagcaagctgagaggcctgaagcccaagaaggcccccaccgccagaaagaccaccaccagaagacccaagcccaccagacccgccagcaccggcgtggccggcgccagcagcagcctgggccccagcggcagcgccagcgccggcgagctgagctag

SEQ ID NO: 79784 - DNA, 3711 bp, Artificial Sequence
  Description of Artificial Sequence: Synthetic coding sequence
atgagcgccgaggccagcgccagacccctgagagtgggcagcagagtggaggtgatcggcaagggccacagaggcaccgtggcctacgtgggcgccaccctgttcgccaccggcaagtgggtgggcgtgatcctggacgaggccaagggcaagaacgacggcaccgtgcagggcagaaagtacttcacctgcgacgagggccacggcatcttcgtgagacagagccagatccaggtgttcgaggacggcgccgacaccaccagccccgagacccccgacagcagcgccagcaaggtgctgaagagagagggcaccgacaccaccgccaagaccagcaagctgcccaccagacccgccagcaccggcgtggccggcgccagcagcagcctgggccccagcggcagcgccagcgccggcgagctgagcagcagcgagcccagcacccccgcccagacccccctggccgcccccatcatccccacccccgtgctgaccagccccggcgccgtgccccccctgcccagccccagcaaggaggaggagggcctgagagcccaggtgagagacctggaggagaagctggagaccctgagactgaagagagccgaggacaaggccaagctgaaggagctggagaagcacaagatccagctggagcaggtgcaggagtggaagagcaagatgcaggagcagcaggccgacctgcagagaagactgaaggaggccagaaaggaggccaaggaggccctggaggccaaggagagatacatggaggagatggccgacaccgccgacgccatcgagatggccaccctggacaaggagatggccgaggagagagccgagagcctgcagcaggaggtggaggccctgaaggagagagtggacgagctgaccaccgacctggagatcctgaaggccgagatcgaggagaagggcagcgacggcgccgccagcagctaccagctgaagcagctggaggagcagaacgccagactgaaggacgccctggtgagaatgagagacctgagcagcagcgagaagcaggagcacgtgaagctgcagaagctgatggagaagaagaaccaggagctggaggtggtgagacagcagagagagagactgcaggaggagctgagccaggccgagagcaccatcgacgagctgaaggagcaggtggacgccgccctgggcgccgaggagatggtggagatgctgaccgacagaaacctgaacctggaggagaaggtgagagagctgagagagaccgtgggcgacctggaggccatgaacgagatgaacgacgagctgcaggagaacgccagagagaccgagctggagctgagagagcagctggacatggccggcgccagagtgagagaggcccagaagagagtggaggccgcccaggagaccgtggccgactaccagcagaccatcaagaagtacagacagctgaccgcccacctgcaggacgtgaacagagagctgaccaaccagcaggaggccagcgtggagagacagcagcagcccccccccgagaccttcgacttcaagatcaagttcgccgagaccaaggcccacgccaaggccatcgagatggagctgagacagatggaggtggcccaggccaacagacacatgagcctgctgaccgccttcatgcccgacagcttcctgagacccggcggcgaccacgactgcgtgctggtgctgctgctgatgcccagactgatctgcaaggccgagctgatcagaaagcaggcccaggagaagttcgagctgagcgagaactgcagcgagagacccggcctgagaggcgccgccggcgagcagctgagcttcgccgccggcctggtgtacagcctgagcctgctgcaggccaccctgcacagatacgagcacgccctgagccagtgcagcgtggacgtgtacaagaaggtgggcagcctgtaccccgagatgagcgcccacgagagaagcctggacttcctgatcgagctgctgcacaaggaccagctggacgagaccgtgaacgtggagcccctgaccaaggccatcaagtactaccagcacctgtacagcatccacctggccgagcagcccgaggactgcaccatgcagctggccgaccacatcaagttcacccagagcgccctggactgcatgagcgtggaggtgggcagactgagagccttcctgcagggcggccaggaggccaccgacatcgccctgctgctgagagacctggagaccagctgcagcgacatcagacagttctgcaagaagatcagaagaagaatgcccggcaccgacgcccccggcatccccgccgccctggccttcggcccccaggtgagcgacaccctgctggactgcagaaagcacctgacctgggtggtggccgtgctgcaggaggtggccgccgccgccgcccagctgatcgcccccctggccgagaacgagggcctgctggtggccgccctggaggagctggccttcaaggccagcgagcagatctacggcacccccagcagcagcccctacgagtgcctgagacagagctgcaacatcctgatcagcaccatgaacaagctggccaccgccatgcaggagggcgagtacgacgccgagagaccccccagcaagcccccccccgtggagctgagagccgccgccctgagagccgagatcaccgacgccgagggcctgggcctgaagctggaggacagagagaccgtgatcaaggagctgaagaagagcctgaagatcaagggcgaggagctgagcgaggccaacgtgagactgagcctgctggagaagaagctggacagcgccgccaaggacgccgacgagagaatcgagaaggtgcagaccagactggaggagacccaggccctgctgagaaagaaggagaaggagttcgaggagaccatggacgccctgcaggccgacatcgaccagctggaggccgagaaggccgagctgaagcagagactgaacagccagagcaagagaaccatcgagggcctgagaggccccccccccagcggcatcgccaccctggtgagcggcatcgccggcggcgccatccccggccaggcccccggcagcgtgcccggccccggcctggtgaaggacagccccctgctgctgcagcagatcagcgccatgagactgcacatcagccagctgcagcacgagaacagcatcctgaagggcgcccagatgaaggccagcctggccagcctgccccccctgcacgtggccaagctgagccacgagggccccggcagcgagctgcccgccggcgccctgtacagaaagaccagccagctgctggagaccctgaaccagctgagcacccacacccacgtggtggacatcaccagaaccagccccgccgccaagagccccagcgcccagctgatggagcaggtggcccagctgaagagcctgagcgacaccgtggagaagctgaaggacgaggtgctgaaggagaccgtgagccagagacccggcgccaccgtgcccaccgacttcgccaccttccccagcagcgccttcctgagagccaaggaggagcagcaggacgacaccgtgtacatgggcaaggtgaccttcagctgcgccgccggcttcggccagagacacagactggtgctgacccaggagcagctgcaccagctgcacagcagactgatcagctag

SEQ ID NO: 79785 - DNA, 3420 bp, Artificial Sequence
  Description of Artificial Sequence: Synthetic coding sequence
atgatgagacaggcccccaccgccagaaagaccaccaccagaagacccaagcccaccagacccgccagcaccggcgtggccggcgccagcagcagcctgggccccagcggcagcgccagcgccggcgagctgagcagcagcgagcccagcacccccgcccagacccccctggccgcccccatcatccccacccccgtgctgaccagccccggcgccgtgccccccctgcccagccccagcaaggaggaggagggcctgagagcccaggtgagagacctggaggagaagctggagaccctgagactgaagagagccgaggacaaggccaagctgaaggagctggagaagcacaagatccagctggagcaggtgcaggagtggaagagcaagatgcaggagcagcaggccgacctgcagagaagactgaaggaggccagaaaggaggccaaggaggccctggaggccaaggagagatacatggaggagatggccgacaccgccgacgccatcgagatggccaccctggacaaggagatggccgaggagagagccgagagcctgcagcaggaggtggaggccctgaaggagagagtggacgagctgaccaccgacctggagatcctgaaggccgagatcgaggagaagggcagcgacggcgccgccagcagctaccagctgaagcagctggaggagcagaacgccagactgaaggacgccctggtgagaatgagagacctgagcagcagcgagaagcaggagcacgtgaagctgcagaagctgatggagaagaagaaccaggagctggaggtggtgagacagcagagagagagactgcaggaggagctgagccaggccgagagcaccatcgacgagctgaaggagcaggtggacgccgccctgggcgccgaggagatggtggagatgctgaccgacagaaacctgaacctggaggagaaggtgagagagctgagagagaccgtgggcgacctggaggccatgaacgagatgaacgacgagctgcaggagaacgccagagagaccgagctggagctgagagagcagctggacatggccggcgccagagtgagagaggcccagaagagagtggaggccgcccaggagaccgtggccgactaccagcagaccatcaagaagtacagacagctgaccgcccacctgcaggacgtgaacagagagctgaccaaccagcaggaggccagcgtggagagacagcagcagcccccccccgagaccttcgacttcaagatcaagttcgccgagaccaaggcccacgccaaggccatcgagatggagctgagacagatggaggtggcccaggccaacagacacatgagcctgctgaccgccttcatgcccgacagcttcctgagacccggcggcgaccacgactgcgtgctggtgctgctgctgatgcccagactgatctgcaaggccgagctgatcagaaagcaggcccaggagaagttcgagctgagcgagaactgcagcgagagacccggcctgagaggcgccgccggcgagcagctgagcttcgccgccggcctggtgtacagcctgagcctgctgcaggccaccctgcacagatacgagcacgccctgagccagtgcagcgtggacgtgtacaagaaggtgggcagcctgtaccccgagatgagcgcccacgagagaagcctggacttcctgatcgagctgctgcacaaggaccagctggacgagaccgtgaacgtggagcccctgaccaaggccatcaagtactaccagcacctgtacagcatccacctggccgagcagcccgaggactgcaccatgcagctggccgaccacatcaagttcacccagagcgccctggactgcatgagcgtggaggtgggcagactgagagccttcctgcagggcggccaggaggccaccgacatcgccctgctgctgagagacctggagaccagctgcagcgacatcagacagttctgcaagaagatcagaagaagaatgcccggcaccgacgcccccggcatccccgccgccctggccttcggcccccaggtgagcgacaccctgctggactgcagaaagcacctgacctgggtggtggccgtgctgcaggaggtggccgccgccgccgcccagctgatcgcccccctggccgagaacgagggcctgctggtggccgccctggaggagctggccttcaaggccagcgagcagatctacggcacccccagcagcagcccctacgagtgcctgagacagagctgcaacatcctgatcagcaccatgaacaagctggccaccgccatgcaggagggcgagtacgacgccgagagaccccccagcaagcccccccccgtggagctgagagccgccgccctgagagccgagatcaccgacgccgagggcctgggcctgaagctggaggacagagagaccgtgatcaaggagctgaagaagagcctgaagatcaagggcgaggagctgagcgaggccaacgtgagactgagcctgctggagaagaagctggacagcgccgccaaggacgccgacgagagaatcgagaaggtgcagaccagactggaggagacccaggccctgctgagaaagaaggagaaggagttcgaggagaccatggacgccctgcaggccgacatcgaccagctggaggccgagaaggccgagctgaagcagagactgaacagccagagcaagagaaccatcgagggcctgagaggccccccccccagcggcatcgccaccctggtgagcggcatcgccggcggcgccatccccggccaggcccccggcagcgtgcccggccccggcctggtgaaggacagccccctgctgctgcagcagatcagcgccatgagactgcacatcagccagctgcagcacgagaacagcatcctgaagggcgcccagatgaaggccagcctggccagcctgccccccctgcacgtggccaagctgagccacgagggccccggcagcgagctgcccgccggcgccctgtacagaaagaccagccagctgctggagaccctgaaccagctgagcacccacacccacgtggtggacatcaccagaaccagccccgccgccaagagccccagcgcccagctgatggagcaggtggcccagctgaagagcctgagcgacaccgtggagaagctgaaggacgaggtgctgaaggagaccgtgagccagagacccggcgccaccgtgcccaccgacttcgccaccttccccagcagcgccttcctgagagccaaggaggagcagcaggacgacaccgtgtacatgggcaaggtgaccttcagctgcgccgccggcttcggccagagacacagactggtgctgacccaggagcagctgcaccagctgcacagcagactgatcagctag

SEQ ID NO: 79786 - DNA, 3762 bp, Artificial Sequence
  Description of Artificial Sequence: Synthetic coding sequence
atggcccagagcaagagacacgtgtacagcagaacccccagcggcagcagaatgagcgccgaggccagcgccagacccctgagagtgggcagcagagtggaggtgatcggcaagggccacagaggcaccgtggcctacgtgggcgccaccctgttcgccaccggcaagtgggtgggcgtgatcctggacgaggccaagggcaagaacgacggcaccgtgcagggcagaaagtacttcacctgcgacgagggccacggcatcttcgtgagacagagccagatccaggtgttcgaggacggcgccgacaccaccagccccgagacccccgacagcagcgccagcaaggtgctgaagagagagggcaccgacaccaccgccaagaccagcaagctgcccaccagacccgccagcaccggcgtggccggcgccagcagcagcctgggccccagcggcagcgccagcgccggcgagctgagcagcagcgagcccagcacccccgcccagacccccctggccgcccccatcatccccacccccgtgctgaccagccccggcgccgtgccccccctgcccagccccagcaaggaggaggagggcctgagagcccaggtgagagacctggaggagaagctggagaccctgagactgaagagagccgaggacaaggccaagctgaaggagctggagaagcacaagatccagctggagcaggtgcaggagtggaagagcaagatgcaggagcagcaggccgacctgcagagaagactgaaggaggccagaaaggaggccaaggaggccctggaggccaaggagagatacatggaggagatggccgacaccgccgacgccatcgagatggccaccctggacaaggagatggccgaggagagagccgagagcctgcagcaggaggtggaggccctgaaggagagagtggacgagctgaccaccgacctggagatcctgaaggccgagatcgaggagaagggcagcgacggcgccgccagcagctaccagctgaagcagctggaggagcagaacgccagactgaaggacgccctggtgagaatgagagacctgagcagcagcgagaagcaggagcacgtgaagctgcagaagctgatggagaagaagaaccaggagctggaggtggtgagacagcagagagagagactgcaggaggagctgagccaggccgagagcaccatcgacgagctgaaggagcaggtggacgccgccctgggcgccgaggagatggtggagatgctgaccgacagaaacctgaacctggaggagaaggtgagagagctgagagagaccgtgggcgacctggaggccatgaacgagatgaacgacgagctgcaggagaacgccagagagaccgagctggagctgagagagcagctggacatggccggcgccagagtgagagaggcccagaagagagtggaggccgcccaggagaccgtggccgactaccagcagaccatcaagaagtacagacagctgaccgcccacctgcaggacgtgaacagagagctgaccaaccagcaggaggccagcgtggagagacagcagcagcccccccccgagaccttcgacttcaagatcaagttcgccgagaccaaggcccacgccaaggccatcgagatggagctgagacagatggaggtggcccaggccaacagacacatgagcctgctgaccgccttcatgcccgacagcttcctgagacccggcggcgaccacgactgcgtgctggtgctgctgctgatgcccagactgatctgcaaggccgagctgatcagaaagcaggcccaggagaagttcgagctgagcgagaactgcagcgagagacccggcctgagaggcgccgccggcgagcagctgagcttcgccgccggcctggtgtacagcctgagcctgctgcaggccaccctgcacagatacgagcacgccctgagccagtgcagcgtggacgtgtacaagaaggtgggcagcctgtaccccgagatgagcgcccacgagagaagcctggacttcctgatcgagctgctgcacaaggaccagctggacgagaccgtgaacgtggagcccctgaccaaggccatcaagtactaccagcacctgtacagcatccacctggccgagcagcccgaggactgcaccatgcagctggccgaccacatcaagttcacccagagcgccctggactgcatgagcgtggaggtgggcagactgagagccttcctgcagggcggccaggaggccaccgacatcgccctgctgctgagagacctggagaccagctgcagcgacatcagacagttctgcaagaagatcagaagaagaatgcccggcaccgacgcccccggcatccccgccgccctggccttcggcccccaggtgagcgacaccctgctggactgcagaaagcacctgacctgggtggtggccgtgctgcaggaggtggccgccgccgccgcccagctgatcgcccccctggccgagaacgagggcctgctggtggccgccctggaggagctggccttcaaggccagcgagcagatctacggcacccccagcagcagcccctacgagtgcctgagacagagctgcaacatcctgatcagcaccatgaacaagctggccaccgccatgcaggagggcgagtacgacgccgagagaccccccagcaagcccccccccgtggagctgagagccgccgccctgagagccgagatcaccgacgccgagggcctgggcctgaagctggaggacagagagaccgtgatcaaggagctgaagaagagcctgaagatcaagggcgaggagctgagcgaggccaacgtgagactgagcctgctggagaagaagctggacagcgccgccaaggacgccgacgagagaatcgagaaggtgcagaccagactggaggagacccaggccctgctgagaaagaaggagaaggagttcgaggagaccatggacgccctgcaggccgacatcgaccagctggaggccgagaaggccgagctgaagcagagactgaacagccagagcaagagaaccatcgagggcctgagaggccccccccccagcggcatcgccaccctggtgagcggcatcgccggcggcgccatccccggccaggcccccggcagcgtgcccggccccggcctggtgaaggacagccccctgctgctgcagcagatcagcgccatgagactgcacatcagccagctgcagcacgagaacagcatcctgaagggcgcccagatgaaggccagcctggccagcctgccccccctgcacgtggccaagctgagccacgagggccccggcagcgagctgcccgccggcgccctgtacagaaagaccagccagctgctggagaccctgaaccagctgagcacccacacccacgtggtggacatcaccagaaccagccccgccgccaagagccccagcgcccagctgatggagcaggtggcccagctgaagagcctgagcgacaccgtggagaagctgaaggacgaggtgctgaaggagaccgtgagccagagacccggcgccaccgtgcccaccgacttcgccaccttccccagcagcgccttcctgagagccaaggaggagcagcaggacgacaccgtgtacatgggcaaggtgaccttcagctgcgccgccggcttcggccagagacacagactggtgctgacccaggagcagctgcaccagctgcacagcagactgatcagctag

SEQ ID NO: 79787 - DNA, 1221 bp, Artificial Sequence
  Description of Artificial Sequence: Synthetic coding sequence
atggccgaccccaagtacgccgacctgcccggcatcgccagaaacgagcccgacgtgtacgagaccagcgacctgcccgaggacgaccaggccgagttcgacgccttcgcccaggagctggaggagctgaccagcaccagcgtggagcacatcatcgtgaaccccaacgccgcctacgacaagttcaaggacaagagagtgggcaccaagggcctggacttcagcgacagaatcggcaagaccaagagaaccggctacgagagcggcgagtacgagatgctgggcgagggcctgggcgtgaaggagaccccccagcagaagtaccagagactgctgcacgaggtgcaggagctgaccaccgaggtggagaagatcaagaccaccgtgaaggagagcgccaccgaggagaagctgacccccgtgctgctggccaagcagctggccgccctgaagcagcagctggtggccagccacctggagaagctgctgggccccgacgccgccatcaacctgaccgaccccgacggcgccctggccaagagactgctgctgcagctggaggccaccaagaacagcaagggcggcagcggcggcaagaccaccggcaccccccccgacagcagcctggtgacctacgagctgcacagcagacccgagcaggacaagttcagccaggccgccaaggtggccgagctggagaagagactgaccgagctggagaccgccgtgagatgcgaccaggacgcccagaaccccctgagcgccggcctgcagggcgcctgcctgatggagaccgtggagctgctgcaggccaaggtgagcgccctggacctggccgtgctggaccaggtggaggccagactgcagagcgtgctgggcaaggtgaacgagatcgccaagcacaaggccagcgtggaggacgccgacacccagagcaaggtgcaccagctgtacgagaccatccagagatggagccccatcgccagcaccctgcccgagctggtgcagagactggtgaccatcaagcagctgcacgagcaggccatgcagttcggccagctgctgacccacctggacaccacccagcagatgatcgccaacagcctgaaggacaacaccaccctgctgacccaggtgcagaccaccatgagagagaacctggccaccgtggagggcaacttcgccagcatcgacgagagaatgaagaagctgggcaagtag

SEQ ID NO: 79788 - DNA, 1137 bp, Artificial Sequence
  Description of Artificial Sequence: Synthetic coding sequence
atgtacgcccagggcaccgaggacagcagaaccctggaggagctgaccagcaccagcgtggagcacatcatcgtgaaccccaacgccgcctacgacaagttcaaggacaagagagtgggcaccaagggcctggacttcagcgacagaatcggcaagaccaagagaaccggctacgagagcggcgagtacgagatgctgggcgagggcctgggcgtgaaggagaccccccagcagaagtaccagagactgctgcacgaggtgcaggagctgaccaccgaggtggagaagatcaagaccaccgtgaaggagagcgccaccgaggagaagctgacccccgtgctgctggccaagcagctggccgccctgaagcagcagctggtggccagccacctggagaagctgctgggccccgacgccgccatcaacctgaccgaccccgacggcgccctggccaagagactgctgctgcagctggaggccaccaagaacagcaagggcggcagcggcggcaagaccaccggcaccccccccgacagcagcctggtgacctacgagctgcacagcagacccgagcaggacaagttcagccaggccgccaaggtggccgagctggagaagagactgaccgagctggagaccgccgtgagatgcgaccaggacgcccagaaccccctgagcgccggcctgcagggcgcctgcctgatggagaccgtggagctgctgcaggccaaggtgagcgccctggacctggccgtgctggaccaggtggaggccagactgcagagcgtgctgggcaaggtgaacgagatcgccaagcacaaggccagcgtggaggacgccgacacccagagcaaggtgcaccagctgtacgagaccatccagagatggagccccatcgccagcaccctgcccgagctggtgcagagactggtgaccatcaagcagctgcacgagcaggccatgcagttcggccagctgctgacccacctggacaccacccagcagatgatcgccaacagcctgaaggacaacaccaccctgctgacccaggtgcagaccaccatgagagagaacctggccaccgtggagggcaacttcgccagcatcgacgagagaatgaagaagctgggcaagtag

SEQ ID NO: 79789 - DNA, 945 bp, Artificial Sequence
  Description of Artificial Sequence: Synthetic coding sequence
atgctgggcgagggcctgggcgtgaaggagaccccccagcagaagtaccagagactgctgcacgaggtgcaggagctgaccaccgaggtggagaagatcaagaccaccgtgaaggagagcgccaccgaggagaagctgacccccgtgctgctggccaagcagctggccgccctgaagcagcagctggtggccagccacctggagaagctgctgggccccgacgccgccatcaacctgaccgaccccgacggcgccctggccaagagactgctgctgcagctggaggccaccaagaacagcaagggcggcagcggcggcaagaccaccggcaccccccccgacagcagcctggtgacctacgagctgcacagcagacccgagcaggacaagttcagccaggccgccaaggtggccgagctggagaagagactgaccgagctggagaccgccgtgagatgcgaccaggacgcccagaaccccctgagcgccggcctgcagggcgcctgcctgatggagaccgtggagctgctgcaggccaaggtgagcgccctggacctggccgtgctggaccaggtggaggccagactgcagagcgtgctgggcaaggtgaacgagatcgccaagcacaaggccagcgtggaggacgccgacacccagagcaaggtgcaccagctgtacgagaccatccagagatggagccccatcgccagcaccctgcccgagctggtgcagagactggtgaccatcaagcagctgcacgagcaggccatgcagttcggccagctgctgacccacctggacaccacccagcagatgatcgccaacagcctgaaggacaacaccaccctgctgacccaggtgcagaccaccatgagagagaacctggccaccgtggagggcaacttcgccagcatcgacgagagaatgaagaagctgggcaagtag

SEQ ID NO: 79790 - DNA, 1221 bp, Artificial Sequence
  Description of Artificial Sequence: Synthetic coding sequence
atggccgaccccaagtacgccgacctgcccggcatcgccagaaacgagcccgacgtgtacgagaccagcgacctgcccgaggacgaccaggccgagttcgacgccaccgtgcagcacctggaggagctgaccagcaccagcgtggagcacatcatcgtgaaccccaacgccgcctacgacaagttcaaggacaagagagtgggcaccaagggcctggacttcagcgacagaatcggcaagaccaagagaaccggctacgagagcggcgagtacgagatgctgggcgagggcctgggcgtgaaggagaccccccagcagaagtaccagagactgctgcacgaggtgcaggagctgaccaccgaggtggagaagatcaagaccaccgtgaaggagagcgccaccgaggagaagctgacccccgtgctgctggccaagcagctggccgccctgaagcagcagctggtggccagccacctggagaagctgctgggccccgacgccgccatcaacctgaccgaccccgacggcgccctggccaagagactgctgctgcagctggaggccaccaagaacagcaagggcggcagcggcggcaagaccaccggcaccccccccgacagcagcctggtgacctacgagctgcacagcagacccgagcaggacaagttcagccaggccgccaaggtggccgagctggagaagagactgaccgagctggagaccgccgtgagatgcgaccaggacgcccagaaccccctgagcgccggcctgcagggcgcctgcctgatggagaccgtggagctgctgcaggccaaggtgagcgccctggacctggccgtgctggaccaggtggaggccagactgcagagcgtgctgggcaaggtgaacgagatcgccaagcacaaggccagcgtggaggacgccgacacccagagcaaggtgcaccagctgtacgagaccatccagagatggagccccatcgccagcaccctgcccgagctggtgcagagactggtgaccatcaagcagctgcacgagcaggccatgcagttcggccagctgctgacccacctggacaccacccagcagatgatcgccaacagcctgaaggacaacaccaccctgctgacccaggtgcagaccaccatgagagagaacctggccaccgtggagggcaacttcgccagcatcgacgagagaatgaagaagctgggcaagtag

SEQ ID NO: 79791 - DNA, 1206 bp, Artificial Sequence
  Description of Artificial Sequence: Synthetic coding sequence
atggccgaccccaagtacgccgacctgcccggcatcgccagaaacgagcccgacgtgtacgagaccagcgacctgcccgaggacgaccaggccgagttcgacgccgaggagctgaccagcaccagcgtggagcacatcatcgtgaaccccaacgccgcctacgacaagttcaaggacaagagagtgggcaccaagggcctggacttcagcgacagaatcggcaagaccaagagaaccggctacgagagcggcgagtacgagatgctgggcgagggcctgggcgtgaaggagaccccccagcagaagtaccagagactgctgcacgaggtgcaggagctgaccaccgaggtggagaagatcaagaccaccgtgaaggagagcgccaccgaggagaagctgacccccgtgctgctggccaagcagctggccgccctgaagcagcagctggtggccagccacctggagaagctgctgggccccgacgccgccatcaacctgaccgaccccgacggcgccctggccaagagactgctgctgcagctggaggccaccaagaacagcaagggcggcagcggcggcaagaccaccggcaccccccccgacagcagcctggtgacctacgagctgcacagcagacccgagcaggacaagttcagccaggccgccaaggtggccgagctggagaagagactgaccgagctggagaccgccgtgagatgcgaccaggacgcccagaaccccctgagcgccggcctgcagggcgcctgcctgatggagaccgtggagctgctgcaggccaaggtgagcgccctggacctggccgtgctggaccaggtggaggccagactgcagagcgtgctgggcaaggtgaacgagatcgccaagcacaaggccagcgtggaggacgccgacacccagagcaaggtgcaccagctgtacgagaccatccagagatggagccccatcgccagcaccctgcccgagctggtgcagagactggtgaccatcaagcagctgcacgagcaggccatgcagttcggccagctgctgacccacctggacaccacccagcagatgatcgccaacagcctgaaggacaacaccaccctgctgacccaggtgcagaccaccatgagagagaacctggccaccgtggagggcaacttcgccagcatcgacgagagaatgaagaagctgggcaagtag

SEQ ID NO: 79792 - DNA, 561 bp, Artificial Sequence
  Description of Artificial Sequence: Synthetic coding sequence
atggccggcctgaccgacctgcagagactgcaggccagagtggaggagctggagagatgggtgtacggccccggcggcgccagaggcagcagaaaggtggccgacggcctggtgaaggtgcaggtggccctgggcaacatcagcagcaagagagagagagtgaagatcctgtacaagaagatcgaggacctgatcaagtacctggaccccgagtacatcgacagaatcgccatccccgacgccagcaagctgcagttcatcctggccgaggagcagttcatcctgagccaggtggccctgctggagcaggtgaacgccctggtgcccatgctggacagcgcccacatcaaggccgtgcccgagcacgccgccagactgcagagactggcccagatccacatccagcagcaggaccagtgcgtggagatcaccgaggagagcaaggccctgctggaggagtacaacaagaccaccatgctgctgagcaagcagttcgtgcagtgggacgagctgctgtgccagctggaggccgccacccaggtgaagcccgccgaggagtag

SEQ ID NO: 79793 - DNA, 531 bp, Artificial Sequence
  Description of Artificial Sequence: Synthetic coding sequence
atggccggcctgaccgacctgcagagactgcaggccagagtggaggagctggagagatgggtgtacggccccggcggcgccagaggcagcagaaaggtggccgacggcctggtgaaggtgcaggtggccctgggcaacatcagcagcaagagagagagagtgaagatcctgtacaagaagatcgaggacctgatcaagtacctggaccccgagtacatcgacagaatcgccatccccgacgccagcaagctgcagttcatcctggccgaggagcagttcatcctgagccaggtggccctgctggagcaggtgaacgccctggtgcccatgctggacagcgcccacatcaaggccgtgcccgagcacgccgccagactgcagagactggcccagatccacatccagcagcaggccccctggggcgtgggcgtgagagacgaggccggcagcctggtggaggacgtgggcttcgcccagttcctgagcgtgctgcacttcggccccaccggccccgtgtgcggcaaccactag

SEQ ID NO: 79794 - DNA, 486 bp, Artificial Sequence
  Description of Artificial Sequence: Synthetic coding sequence
atggccggcctgaccgacctgcagagactgcaggccagagtggaggagctggagagatgggtgtacggccccggcggcgccagaggcagcagaaaggtggccgacggcctggtgaaggtgcaggtggccctgggcaacatcagcagcaagagagagagagtgaagatcctgtacaagaagatcgaggacctgatcaagtacctggaccccgagtacatcgacagaatcgccatccccgacgccagcaagctgcagttcatcctggccggcaacgccggcctgcacgtgtacatgcacctgagaatgtgggtggtgggcgaggtgaagcacagagacggcctgagcatccagagcagcggcggctacaagccctggatgctgctgagcggcatcgtggcctggttctgggtggaggaccccatggaccccctggtggacatcgagtacagcatccccctgcaccagctgcaggccatggtgccctag

SEQ ID NO: 79795 - DNA, 315 bp, Artificial Sequence
  Description of Artificial Sequence: Synthetic coding sequence
atggccggcctgaccgacctgcagagactgcaggccagagtggaggagctggagagatgggtgtacggccccggcggcgccagaggcagcagaaaggtggccgacggcctggtgaaggtgcaggtggccctgggcaacatcagcagcaagagagagagagtgaagatcctgtacaagaagatcgaggacctgatcaagtacctggaccccgagtacatcgacagaatcgccatccccgacgccagcaagctgcagttcatcctggccgagagaagcagcctgagcttccccagactgcacagctggagcagatag

SEQ ID NO: 79796 - DNA, 477 bp, Artificial Sequence
  Description of Artificial Sequence: Synthetic coding sequence
atggccggcctgaccgacctgcagagactgcaggccagagtggaggagctggagagatgggtgtacggccccggcggcgccagaggcagcagaaaggtggccgacggcctggtgaaggtgcaggtggccctgggcaacatcagcagcaagagagagagagtgaagatcctgtacaagaagatcgaggacctgatcaagtacctggaccccgagtacatcgacagaatcgccatccccgacgccagcaagctgcagttcatcctggccgccgtgcccgagcacgccgccagactgcagagactggcccagatccacatccagcagcaggaccagtgcgtggagatcaccgaggagagcaaggccctgctggaggagtacaacaagaccaccatgctgctgagcaagcagttcgtgcagtgggacgagctgctgtgccagctggaggccgccacccaggtgaagcccgccgaggagtag

SEQ ID NO: 79797 - DNA, 456 bp, Artificial Sequence
  Description of Artificial Sequence: Synthetic coding sequence
cagagactgcaggccagagtggaggagctggagagatgggtgtacggccccggcggcgccagaggcagcagaaaggtggccgacggcctggtgaaggtgcaggtggccctgggcaacatcagcagcaagagagagagagtgaagatcctgtacaagaagatcgaggacctgatcaagtacctggaccccgagtacatcgacagaatcgccatccccgacgccagcaagctgcagttcatcctggccgccgtgcccgagcacgccgccagactgcagagactggcccagatccacatccagcagcaggaccagtgcgtggagatcaccgaggagagcaaggccctgctggaggagtacaacaagaccaccatgctgctgagcaagcagttcgtgcagtgggacgagctgctgtgccagctggaggccgccacccaggtgaagcccgccgaggagtag

SEQ ID NO: 79798 - DNA, 519 bp, Artificial Sequence
  Description of Artificial Sequence: Synthetic coding sequence
atggccggcctgaccgacctgcagagactgcaggccagagtggaggagctggagagatgggtgtacggccccggcggcgccagaggcagcagaaaggtggccgacggcctggtgaaggtgcaggtggccctgggcaacatcagcagcaagagagagagagtgaagatcctgtacaagaagatcgaggacctgatcaagtacctggaccccgagtacatcgacagaatcgccatccccgacgccagcaagctgcagttcatcctggccggcaacgccggcctgcacgtgtacatgcacctgagaatgtgggtggtgggcgaggtgaagcacagagacggcctgagcatccagagcagcggcggctacaagccctggatgctgctgagcggcatcgtggcctggttctgggtggaggaccccatggaccccctggtggacatcgagtacagcatccccctgcaccagctgcaggccatggtgcccgccaccgtgggcgccagccccgtgttctaccagtag

SEQ ID NO: 79799 - DNA, 549 bp, Artificial Sequence
  Description of Artificial Sequence: Synthetic coding sequence
atggagctgggcgagctgctgtacaacaagagcgagtacatcgagaccgccagcggcaacaaggtgagcagacagagcgtgctgtgcggcagccagaacatcgtgctgaacggcaagaccatcgtgatgaacgactgcatcatcagaggcgacctggccaacgtgagagtgggcagacactgcgtggtgaagagcagaagcgtgatcagaccccccttcaagaagttcagcaagggcgtggccttcttccccctgcacatcggcgaccacgtgttcatcgaggaggactgcgtggtgaacgccgcccagatcggcagctacgtgcacgtgggcaagaactgcgtgatcggcagaagatgcgtgctgaaggactgctgcaagatcctggacaacaccgtgctgccccccgagaccgtggtgccccccttcaccgtgttcagcggctgccccggcctgttcagcggcgagctgcccgagtgcacccaggagctgatgatcgacgtgaccaagagctactaccagaagttcctgcccctgacccaggtgtag

SEQ ID NO: 79800 - DNA, 255 bp, Artificial Sequence
  Description of Artificial Sequence: Synthetic coding sequence
atggagctgggcgagctgctgtacaacaagagcgagtacatcgagaccgccagcggcaacaaggtgagcagacagagcgtgctgtgcggcagccagaacatcgtgctgaacggcaagaacttcgtgatcagcgtgttcctgagcccctacatcagatgccacagcgcctgcagagacagaaagagaagcgacgagagcgtgagactgagcgtgaacaacagagagtggtggggcctggtgaactggagaatgtag

SEQ ID NO: 79801 - DNA, 1650 bp, Artificial Sequence
  Description of Artificial Sequence: Synthetic coding sequence
atggagttcgccgagctgatcaagacccccagagtggacaacgtggtgctgcacagacccttctaccccgccgtggagggcaccctgtgcctgaccggccaccacctgatcctgagcagcagacaggacaacaccgaggagctgtggctgctgcacagcaacatcgacgccatcgacaagagattcgtgggcagcctgggcaccatcatcatcaagtgcaaggacttcagaatcatccagctggacatccccggcatggaggagtgcctgaacatcgccagcagcatcgaggccctgagcaccctggacagcatcaccctgatgtaccccttcttctacagacccatgttcgaggtgatcgaggacggctggcacagcttcctgcccgagcaggagttcgagctgtacagcagcgccaccagcgagtggagactgagctacgtgaacaaggagttcgccgtgtgccccagctacccccccatcgtgaccgtgcccaagagcatcgacgacgaggccctgagaaaggtggccaccttcagacacggcggcagattccccgtgctgagctactaccacaagaagaacggcatggtgatcatgagaagcggccagcccctgaccggcaccaacggcagaagatgcaaggaggacgagaagctgatcaacgccaccctgagagccggcaagagaggctacatcatcgacaccagaagcctgaacgtggcccagcagaccagagccaagggcggcggcttcgagcaggaggcccactacccccagtggagaagaatccacaagagcatcgagagataccacatcctgcaggagagcctgatcaagctggtggaggcctgcaacgaccagacccacaacatggacagatggctgagcaagctggaggccagcaactggctgacccacatcaaggagatcctgaccaccgcctgcctggccgcccagtgcatcgacagagagggcgccagcatcctgatccacggcaccgagggcaccgacagcaccctgcaggtgaccagcctggcccagatcatcctggagcccagaagcagaaccatcagaggcttcgaggccctgatcgagagagagtggctgcaggccggccaccccttccagcagagatgcgcccagagcgcctactgcaacaccaagcagaagtgggaggcccccgtgttcctgctgttcctggactgcgtgtggcagatcctgagacagttcccctgcagcttcgagttcaacgagaacttcctgatcatgctgttcgagcacgcctacgccagccagttcggcaccttcctgggcaacaacgagagcgagagatgcaagctgaagctgcagcagaagaccatgagcctgtggagctgggtgaaccagcccagcgagctgagcaagttcaccaaccccctgttcgaggccaacaacctggtgatctggcccagcgtggccccccagagcctgcccctgtgggagggcatcttcctgagatggaacagaagcagcaagtacctggacgaggcctacgaggagatggtgaacatcatcgagtacaacaaggagctgcaggccaaggtgaacatcctgagaagacagctggccgagctggagaccgaggacggcatgcaggagagcccctag

SEQ ID NO: 79802 - DNA, 2556 bp, Artificial Sequence
  Description of Artificial Sequence: Synthetic coding sequence
atgggcaacagaggcatggaggacctgatccccctggtgaacagactgcaggacgccttcagcgccatcggccagaacgccgacctggacctgccccagatcgccgtggtgggcggccagagcgccggcaagagcagcgtgctggagaacttcgtgggcagagacttcctgcccagaggcagcggcatcgtgaccagaagacccctggtgctgcagctggtgaacgccaccaccgagtacgccgagttcctgcactgcaagggcaagaagttcaccgacttcgaggaggtgagactggagatcgaggccgagaccgacagagtgaccggcaccaacaagggcatcagccccgtgcccatcaacctgagagtgtacagcccccacgtgctgaacctgaccctggtggacctgcccggcatgaccaaggtgcccgtgggcgaccagccccccgacatcgagttccagatcagagacatgctgatgcagttcgtgaccaaggagaactgcctgatcctggccgtgagccccgccaacagcgacctggccaacagcgacgccctgaaggtggccaaggaggtggacccccagggccagagaaccatcggcgtgatcaccaagctggacctgatggacgagggcaccgacgccagagacgtgctggagaacaagctgctgcccctgagaagaggctacatcggcgtggtgaacagaagccagaaggacatcgacggcaagaaggacatcaccgccgccctggccgccgagagaaagttcttcctgagccaccccagctacagacacctggccgacagaatgggcaccccctacctgcagaaggtgctgaaccagcagctgaccaaccacatcagagacaccctgcccggcctgagaaacaagctgcagagccagctgctgagcatcgagaaggaggtggaggagtacaagaacttcagacccgacgaccccgccagaaagaccaaggccctgctgcagatggtgcagcagttcgccgtggacttcgagaagagaatcgagggcagcggcgaccagatcgacacctacgagctgagcggcggcgccagaatcaacagaatcttccacgagagattccccttcgagctggtgaagatggagttcgacgagaaggagctgagaagagagatcagctacgccatcaagaacatccacggcatcagaaccggcctgttcacccccgacatggccttcgagaccatcgtgaagaagcaggtgaagaagatcagagagccctgcctgaagtgcgtggacatggtgatcagcgagctgatcagcaccgtgagacagtgcaccaagaagctgcagcagtaccccagactgagagaggagatggagagaatcgtgaccacccacatcagagagagagagggcagaaccaaggagcaggtgatgctgctgatcgacatcgagctggcctacatgaacaccaaccacgaggacttcatcggcttcgccaacgcccagcagagaagcaaccagatgaacaagaagaagaccagcggcaaccaggacgagatcctggtgatcagaaagggctggctgaccatcaacaacatcggcatcatgaagggcggcagcaaggagtactggttcgtgctgaccgccgagaacctgagctggtacaaggacgacgaggagaaggagaagaagtacatgctgagcgtggacaacctgaagctgagagacgtggagaagggcttcatgagcagcaagcacatcttcgccctgttcaacaccgagcagagaaacgtgtacaaggactacagacagctggagctggcctgcgagacccaggaggaggtggacagctggaaggccagcttcctgagagccggcgtgtaccccgagagagtgggcgacaaggagaaggccagcgagaccgaggagaacggcagcgacagcttcatgcacagcatggacccccagctggagagacaggtggagaccatcagaaacctggtggacagctacatggccatcgtgaacaagaccgtgagagacctgatgcccaagaccatcatgcacctgatgatcaacaacaccaaggagttcatcttcagcgagctgctggccaacctgtacagctgcggcgaccagaacaccctgatggaggagagcgccgagcaggcccagagaagagacgagatgctgagaatgtaccacgccctgaaggaggccctgagcatcatcggcgacatcaacaccaccaccgtgagcacccccatgcccccccccgtggacgacagctggctgcaggtgcagagcgtgcccgccggcagaagaagccccaccagcagccccaccccccagagaagagcccccgccgtgccccccgccagacccggcagcagaggccccgcccccggccccccccccgccggcagcgccctgggcggcgccccccccgtgcccagcagacccggcgccagccccgaccccttcggcccccccccccaggtgcccagcagacccaacagagccccccccggcgtgcccagaatcaccatcagcgacccctag

SEQ ID NO: 79803 - DNA, 2595 bp, Artificial Sequence
  Description of Artificial Sequence: Synthetic coding sequence
atgggcaacagaggcatggaggacctgatccccctggtgaacagactgcaggacgccttcagcgccatcggccagaacgccgacctggacctgccccagatcgccgtggtgggcggccagagcgccggcaagagcagcgtgctggagaacttcgtgggcagagacttcctgcccagaggcagcggcatcgtgaccagaagacccctggtgctgcagctggtgaacgccaccaccgagtacgccgagttcctgcactgcaagggcaagaagttcaccgacttcgaggaggtgagactggagatcgaggccgagaccgacagagtgaccggcaccaacaagggcatcagccccgtgcccatcaacctgagagtgtacagcccccacgtgctgaacctgaccctggtggacctgcccggcatgaccaaggtgcccgtgggcgaccagccccccgacatcgagttccagatcagagacatgctgatgcagttcgtgaccaaggagaactgcctgatcctggccgtgagccccgccaacagcgacctggccaacagcgacgccctgaaggtggccaaggaggtggacccccagggccagagaaccatcggcgtgatcaccaagctggacctgatggacgagggcaccgacgccagagacgtgctggagaacaagctgctgcccctgagaagaggctacatcggcgtggtgaacagaagccagaaggacatcgacggcaagaaggacatcaccgccgccctggccgccgagagaaagttcttcctgagccaccccagctacagacacctggccgacagaatgggcaccccctacctgcagaaggtgctgaaccagcagctgaccaaccacatcagagacaccctgcccggcctgagaaacaagctgcagagccagctgctgagcatcgagaaggaggtggaggagtacaagaacttcagacccgacgaccccgccagaaagaccaaggccctgctgcagatggtgcagcagttcgccgtggacttcgagaagagaatcgagggcagcggcgaccagatcgacacctacgagctgagcggcggcgccagaatcaacagaatcttccacgagagattccccttcgagctggtgaagatggagttcgacgagaaggagctgagaagagagatcagctacgccatcaagaacatccacggcatcagaaccggcctgttcacccccgacatggccttcgagaccatcgtgaagaagcaggtgaagaagatcagagagccctgcctgaagtgcgtggacatggtgatcagcgagctgatcagcaccgtgagacagtgcaccaagaagctgcagcagtaccccagactgagagaggagatggagagaatcgtgaccacccacatcagagagagagagggcagaaccaaggagcaggtgatgctgctgatcgacatcgagctggcctacatgaacaccaaccacgaggacttcatcggcttcgccaacgcccagcagagaagcaaccagatgaacaagaagaagaccagcggcaaccaggacgagatcctggtgatcagaaagggctggctgaccatcaacaacatcggcatcatgaagggcggcagcaaggagtactggttcgtgctgaccgccgagaacctgagctggtacaaggacgacgaggagaaggagaagaagtacatgctgagcgtggacaacctgaagctgagagacgtggagaagggcttcatgagcagcaagcacatcttcgccctgttcaacaccgagcagagaaacgtgtacaaggactacagacagctggagctggcctgcgagacccaggaggaggtggacagctggaaggccagcttcctgagagccggcgtgtaccccgagagagtgggcgacaaggagaaggccagcgagaccgaggagaacggcagcgacagcttcatgcacagcatggacccccagctggagagacaggtggagaccatcagaaacctggtggacagctacatggccatcgtgaacaagaccgtgagagacctgatgcccaagaccatcatgcacctgatgatcaacaacaccaaggagttcatcttcagcgagctgctggccaacctgtacagctgcggcgaccagaacaccctgatggaggagagcgccgagcaggcccagagaagagacgagatgctgagaatgtaccacgccctgaaggaggccctgagcatcatcggcgacatcaacaccaccaccgtgagcacccccatgcccccccccgtggacgacagctggctgcaggtgcagagcgtgcccgccggcagaagaagccccaccagcagccccaccccccagagaagagcccccgccgtgccccccgccagacccggcagcagaggccccgcccccggccccccccccgccggcagcgccctgggcggcgccccccccgtgcccagcagacccggcgccagccccgaccccttcggcccccccccccaggtgcccagcagacccaacagagccccccccggcgtgcccagcagaagcggccaggccagccccagcagacccgagagccccagaccccccttcgacctgtag

SEQ ID NO: 79804 - DNA, 1989 bp, Artificial Sequence
  Description of Artificial Sequence: Synthetic coding sequence
atggaggacctgatccccctggtgaacagactgcaggacgccttcagcgccatcggccagaacgccgacctggacctgccccagatcgccgtggtgggcggccagagcgccggcaagagcagcgtgctggagaacttcgtgggcagagacttcctgcccagaggcagcggcatcgtgaccagaagacccctggtgctgcagctggtgaacgccaccaccgagtacgccgagttcctgcactgcaagggcaagaagttcaccgacttcgaggaggtgagactggagatcgaggccgagaccgacagagtgaccggcaccaacaagggcatcagccccgtgcccatcaacctgagagtgtacagcccccacgtgctgaacctgaccctggtggacctgcccggcatgaccaaggtgcccgtgggcgaccagccccccgacatcgagttccagatcagagacatgctgatgcagttcgtgaccaaggagaactgcctgatcctggccgtgagccccgccaacagcgacctggccaacagcgacgccctgaaggtggccaaggaggtggacccccagggccagagaaccatcggcgtgatcaccaagctggacctgatggacgagggcaccgacgccagagacgtgctggagaacaagctgctgcccctgagaagaggctacatcggcgtggtgaacagaagccagaaggacatcgacggcaagaaggacatcaccgccgccctggccgccgagagaaagttcttcctgagccaccccagctacagacacctggccgacagaatgggcaccccctacctgcagaaggtgctgaaccagcagctgaccaaccacatcagagacaccctgcccggcctgagaaacaagctgcagagccagctgctgagcatcgagaaggaggtggaggagtacaagaacttcagacccgacgaccccgccagaaagaccaaggccctgctgcagatggtgcagcagttcgccgtggacttcgagaagagaatcgagggcagcggcgaccagatcgacacctacgagctgagcggcggcgccagaatcaacagaatcttccacgagagattccccttcgagctggtgaagatggagttcgacgagaaggagctgagaagagagatcagctacgccatcaagaacatccacggcatcagaaccggcctgttcacccccgacatggccttcgagaccatcgtgaagaagcaggtgaagaagatcagagagccctgcctgaagtgcgtggacatggtgatcagcgagctgatcagcaccgtgagacagtgcaccaagaagctgcagcagtaccccagactgagagaggagatggagagaatcgtgaccacccacatcagagagagagagggcagaaccaaggagcaggtgatgctgctgatcgacatcgagctggcctacatgaacaccaaccacgaggacttcatcggcttcgccaacgcccagcagagaagcaaccagatgaacaagaagaagaccagcggcaaccagatcaccctgcaggtgatcagaaagggctggctgaccatcaacaacatcggcatcatgaagggcggcagcaaggagtactggttcgtgctgaccgccgagaacctgagctggtacaaggacgacgaggagaaggagaagaagtacatgctgagcgtggacaacctgaagctgagagacgtggagaagggcttcatgagcagcaagcacatcttcgccctgttcaacaccgagcagagaaacgtgtacaaggactacagacagctggagctggcctgcgagacccaggaggaggtggacagctggaaggccagcttcctgagagccggcgtgtaccccgagagagtgggcgacaaggagaaggtgagcgtgcccttcagctgcctgctgcccggcatctgcagcctggcccccgcccccgccagattcagcagcaagggccccggcgacgtgctgttctag

SEQ ID NO: 79805 - DNA, 2556 bp, Artificial Sequence
  Description of Artificial Sequence: Synthetic coding sequence
atgggcaacagaggcatggaggacctgatccccctggtgaacagactgcaggacgccttcagcgccatcggccagaacgccgacctggacctgccccagatcgccgtggtgggcggccagagcgccggcaagagcagcgtgctggagaacttcgtgggcagagacttcctgcccagaggcagcggcatcgtgaccagaagacccctggtgctgcagctggtgaacgccaccaccgagtacgccgagttcctgcactgcaagggcaagaagttcaccgacttcgaggaggtgagactggagatcgaggccgagaccgacagagtgaccggcaccaacaagggcatcagccccgtgcccatcaacctgagagtgtacagcccccacgtgctgaacctgaccctggtggacctgcccggcatgaccaaggtgcccgtgggcgaccagccccccgacatcgagttccagatcagagacatgctgatgcagttcgtgaccaaggagaactgcctgatcctggccgtgagccccgccaacagcgacctggccaacagcgacgccctgaaggtggccaaggaggtggacccccagggccagagaaccatcggcgtgatcaccaagctggacctgatggacgagggcaccgacgccagagacgtgctggagaacaagctgctgcccctgagaagaggctacatcggcgtggtgaacagaagccagaaggacatcgacggcaagaaggacatcaccgccgccctggccgccgagagaaagttcttcctgagccaccccagctacagacacctggccgacagaatgggcaccccctacctgcagaaggtgctgaaccagcagctgaccaaccacatcagagacaccctgcccggcctgagaaacaagctgcagagccagctgctgagcatcgagaaggaggtggaggagtacaagaacttcagacccgacgaccccgccagaaagaccaaggccctgctgcagatggtgcagcagttcgccgtggacttcgagaagagaatcgagggcagcggcgaccagatcgacacctacgagctgagcggcggcgccagaatcaacagaatcttccacgagagattccccttcgagctggtgaagatggagttcgacgagaaggagctgagaagagagatcagctacgccatcaagaacatccacggcatcagaaccggcctgttcacccccgacctggccttcgaggccaccgtgaagaagcaggtgcagaagctgaaggagcccagcatcaagtgcgtggacatggtggtgagcgagctgaccgccaccatcagaaagtgcagcgagaagctgcagcagtaccccagactgagagaggagatggagagaatcgtgaccacccacatcagagagagagagggcagaaccaaggagcaggtgatgctgctgatcgacatcgagctggcctacatgaacaccaaccacgaggacttcatcggcttcgccaacgcccagcagagaagcaaccagatgaacaagaagaagaccagcggcaaccaggacgagatcctggtgatcagaaagggctggctgaccatcaacaacatcggcatcatgaagggcggcagcaaggagtactggttcgtgctgaccgccgagaacctgagctggtacaaggacgacgaggagaaggagaagaagtacatgctgagcgtggacaacctgaagctgagagacgtggagaagggcttcatgagcagcaagcacatcttcgccctgttcaacaccgagcagagaaacgtgtacaaggactacagacagctggagctggcctgcgagacccaggaggaggtggacagctggaaggccagcttcctgagagccggcgtgtaccccgagagagtgggcgacaaggagaaggccagcgagaccgaggagaacggcagcgacagcttcatgcacagcatggacccccagctggagagacaggtggagaccatcagaaacctggtggacagctacatggccatcgtgaacaagaccgtgagagacctgatgcccaagaccatcatgcacctgatgatcaacaacaccaaggagttcatcttcagcgagctgctggccaacctgtacagctgcggcgaccagaacaccctgatggaggagagcgccgagcaggcccagagaagagacgagatgctgagaatgtaccacgccctgaaggaggccctgagcatcatcggcgacatcaacaccaccaccgtgagcacccccatgcccccccccgtggacgacagctggctgcaggtgcagagcgtgcccgccggcagaagaagccccaccagcagccccaccccccagagaagagcccccgccgtgccccccgccagacccggcagcagaggccccgcccccggccccccccccgccggcagcgccctgggcggcgccccccccgtgcccagcagacccggcgccagccccgaccccttcggcccccccccccaggtgcccagcagacccaacagagccccccccggcgtgcccagaatcaccatcagcgacccctag

SEQ ID NO: 79806 - DNA, 2556 bp, Artificial Sequence; identical to SEQ ID NO: 79805
  Description of Artificial Sequence: Synthetic coding sequence

SEQ ID NO: 79807 - DNA, 2595 bp, Artificial Sequence
  Description of Artificial Sequence: Synthetic coding sequence
atgggcaacagaggcatggaggacctgatccccctggtgaacagactgcaggacgccttcagcgccatcggccagaacgccgacctggacctgccccagatcgccgtggtgggcggccagagcgccggcaagagcagcgtgctggagaacttcgtgggcagagacttcctgcccagaggcagcggcatcgtgaccagaagacccctggtgctgcagctggtgaacgccaccaccgagtacgccgagttcctgcactgcaagggcaagaagttcaccgacttcgaggaggtgagactggagatcgaggccgagaccgacagagtgaccggcaccaacaagggcatcagccccgtgcccatcaacctgagagtgtacagcccccacgtgctgaacctgaccctggtggacctgcccggcatgaccaaggtgcccgtgggcgaccagccccccgacatcgagttccagatcagagacatgctgatgcagttcgtgaccaaggagaactgcctgatcctggccgtgagccccgccaacagcgacctggccaacagcgacgccctgaaggtggccaaggaggtggacccccagggccagagaaccatcggcgtgatcaccaagctggacctgatggacgagggcaccgacgccagagacgtgctggagaacaagctgctgcccctgagaagaggctacatcggcgtggtgaacagaagccagaaggacatcgacggcaagaaggacatcaccgccgccctggccgccgagagaaagttcttcctgagccaccccagctacagacacctggccgacagaatgggcaccccctacctgcagaaggtgctgaaccagcagctgaccaaccacatcagagacaccctgcccggcctgagaaacaagctgcagagccagctgctgagcatcgagaaggaggtggaggagtacaagaacttcagacccgacgaccccgccagaaagaccaaggccctgctgcagatggtgcagcagttcgccgtggacttcgagaagagaatcgagggcagcggcgaccagatcgacacctacgagctgagcggcggcgccagaatcaacagaatcttccacgagagattccccttcgagctggtgaagatggagttcgacgagaaggagctgagaagagagatcagctacgccatcaagaacatccacggcatcagaaccggcctgttcacccccgacctggccttcgaggccaccgtgaagaagcaggtgcagaagctgaaggagcccagcatcaagtgcgtggacatggtggtgagcgagctgaccgccaccatcagaaagtgcagcgagaagctgcagcagtaccccagactgagagaggagatggagagaatcgtgaccacccacatcagagagagagagggcagaaccaaggagcaggtgatgctgctgatcgacatcgagctggcctacatgaacaccaaccacgaggacttcatcggcttcgccaacgcccagcagagaagcaaccagatgaacaagaagaagaccagcggcaaccaggacgagatcctggtgatcagaaagggctggctgaccatcaacaacatcggcatcatgaagggcggcagcaaggagtactggttcgtgctgaccgccgagaacctgagctggtacaaggacgacgaggagaaggagaagaagtacatgctgagcgtggacaacctgaagctgagagacgtggagaagggcttcatgagcagcaagcacatcttcgccctgttcaacaccgagcagagaaacgtgtacaaggactacagacagctggagctggcctgcgagacccaggaggaggtggacagctggaaggccagcttcctgagagccggcgtgtaccccgagagagtgggcgacaaggagaaggccagcgagaccgaggagaacggcagcgacagcttcatgcacagcatggacccccagctggagagacaggtggagaccatcagaaacctggtggacagctacatggccatcgtgaacaagaccgtgagagacctgatgcccaagaccatcatgcacctgatgatcaacaacaccaaggagttcatcttcagcgagctgctggccaacctgtacagctgcggcgaccagaacaccctgatggaggagagcgccgagcaggcccagagaagagacgagatgctgagaatgtaccacgccctgaaggaggccctgagcatcatcggcgacatcaacaccaccaccgtgagcacccccatgcccccccccgtggacgacagctggctgcaggtgcagagcgtgcccgccggcagaagaagccccaccagcagccccaccccccagagaagagcccccgccgtgccccccgccagacccggcagcagaggccccgcccccggccccccccccgccggcagcgccctgggcggcgccccccccgtgcccagcagacccggcgccagccccgaccccttcggcccccccccccaggtgcccagcagacccaacagagccccccccggcgtgcccagcagaagcggccaggccagccccagcagacccgagagccccagaccccccttcgacctgtag

SEQ ID NO: 79808 - DNA, 1191 bp, Artificial Sequence
  Description of Artificial Sequence: Synthetic coding sequence
atggagagaatcgtgaccacccacatcagagagagagagggcagaaccaaggagcaggtgatgctgctgatcgacatcgagctggcctacatgaacaccaaccacgaggacttcatcggcttcgccaacgcccagcagagaagcaaccagatgaacaagaagaagaccagcggcaaccaggacgagatcctggtgatcagaaagggctggctgaccatcaacaacatcggcatcatgaagggcggcagcaaggagtactggttcgtgctgaccgccgagaacctgagctggtacaaggacgacgaggagaaggagaagaagtacatgctgagcgtggacaacctgaagctgagagacgtggagaagggcttcatgagcagcaagcacatcttcgccctgttcaacaccgagcagagaaacgtgtacaaggactacagacagctggagctggcctgcgagacccaggaggaggtggacagctggaaggccagcttcctgagagccggcgtgtaccccgagagagtgggcgacaaggagaaggccagcgagaccgaggagaacggcagcgacagcttcatgcacagcatggacccccagctggagagacaggtggagaccatcagaaacctggtggacagctacatggccatcgtgaacaagaccgtgagagacctgatgcccaagaccatcatgcacctgatgatcaacaacaccaaggagttcatcttcagcgagctgctggccaacctgtacagctgcggcgaccagaacaccctgatggaggagagcgccgagcaggcccagagaagagacgagatgctgagaatgtaccacgccctgaaggaggccctgagcatcatcggcgacatcaacaccaccaccgtgagcacccccatgcccccccccgtggacgacagctggctgcaggtgcagagcgtgcccgccggcagaagaagccccaccagcagccccaccccccagagaagagcccccgccgtgccccccgccagacccggcagcagaggccccgcccccggccccccccccgccggcagcgccctgggcggcgccccccccgtgcccagcagacccggcgccagccccgaccccttcggcccccccccccaggtgcccagcagacccaacagagccccccccggcgtgcccagaatcaccatcagcgacccctag

SEQ ID NO: 79809 - DNA, 1728 bp, Artificial Sequence
  Description of Artificial Sequence: Synthetic coding sequence
atggaggccctgatccccgtgatcaacaagctgcaggacgtgttcaacaccgtgggcgccgacatcatccagctgccccagatcgtggtggtgggcacccagagcagcggcaagagcagcgtgctggagagcctggtgggcagagacctgctgcccagaggcaccggcatcgtgaccagaagacccctgatcctgcagctggtgcacgtgagccaggaggacaagagaaagaccaccggcgaggagaacggcgtggaggccgaggagtggggcaagttcctgcacaccaagaacaagctgtacaccgacttcgacgagatcagacaggagatcgagaacgagaccgagagaatcagcggcaacaacaagggcgtgagccccgagcccatccacctgaagatcttcagccccaacgtggtgaacctgaccctggtggacctgcccggcatgaccaaggtgcccgtgggcgaccagcccaaggacatcgagctgcagatcagagagctgatcctgagattcatcagcaaccccaacagcatcatcctggccgtgaccgccgccaacaccgacatggccaccagcgaggccctgaagatcagcagagaggtggaccccgacggcagaagaaccctggccgtgatcaccaagctggacctgatggacgccggcaccgacgccatggacgtgctgatgggcagagtgatccccgtgaagctgggcatcatcggcgtggtgaacagaagccagctggacatcaacaacaagaagagcgtgaccgacagcatcagagacgagtacgccttcctgcagaagaagtaccccagcctggccaacagaaacggcaccaagtacctggccagaaccctgaacagactgctgatgcaccacatcagagactgcctgcccgagctgaagaccagaatcaacgtgctggccgcccagtaccagagcctgctgaacagctacggcgagcccgtggacgacaagagcgccaccctgctgcagctgatcaccaagttcgccaccgagtactgcaacaccatcgagggcaccgccaagtacatcgagaccagcgagctgtgcggcggcgccagaatctgctacatcttccacgagaccttcggcagaaccctggagagcgtggaccccctgggcggcctgaacaccatcgacatcctgaccgccatcagaaacgccaccggccccagacccgccctgttcgtgcccgaggtgagcttcgagctgctggtgaagagacagatcaagagactggaggagcccagcctgagatgcgtggagctggtgcacgaggagatgcagagaatcatccagcactgcagcaactacagcacccaggagctgctgagattccccaagctgcacgacgccatcgtggaggtggtgacctgcctgctgagaaagagactgcccgtgaccaacgagatggtgcacaacctggtggccatcgagctggcctacatcaacaccaagcaccccgacttcgccgacgcctgcggcctgatgaacaacaacatcgaggagcagagaagaaacagactggccagagagctgcccagcgccgtgagcagagacaaggtggccagcggcggcggcggcgtgggcgacggcgtgcaggagcccaccaccggcaactggagaggcatgctgaagaccagcaaggccgaggagctgctggccgagaagaagaagaagaagaagaagaagtag

SEQ ID NO: 79810 - DNA, 2100 bp, Artificial Sequence
  Description of Artificial Sequence: Synthetic coding sequence
atggaggccctgatccccgtgatcaacaagctgcaggacgtgttcaacaccgtgggcgccgacatcatccagctgccccagatcgtggtggtgggcacccagagcagcggcaagagcagcgtgctggagagcctggtgggcagagacctgctgcccagaggcaccggcatcgtgaccagaagacccctgatcctgcagctggtgcacgtgagccaggaggacaagagaaagaccaccggcgaggagaacggcgtggaggccgaggagtggggcaagttcctgcacaccaagaacaagctgtacaccgacttcgacgagatcagacaggagatcgagaacgagaccgagagaatcagcggcaacaacaagggcgtgagccccgagcccatccacctgaagatcttcagccccaacgtggtgaacctgaccctggtggacctgcccggcatgaccaaggtgcccgtgggcgaccagcccaaggacatcgagctgcagatcagagagctgatcctgagattcatcagcaaccccaacagcatcatcctggccgtgaccgccgccaacaccgacatggccaccagcgaggccctgaagatcagcagagaggtggaccccgacggcagaagaaccctggccgtgatcaccaagctggacctgatggacgccggcaccgacgccatggacgtgctgatgggcagagtgatccccgtgaagctgggcatcatcggcgtggtgaacagaagccagctggacatcaacaacaagaagagcgtgaccgacagcatcagagacgagtacgccttcctgcagaagaagtaccccagcctggccaacagaaacggcaccaagtacctggccagaaccctgaacagactgctgatgcaccacatcagagactgcctgcccgagctgaagaccagaatcaacgtgctggccgcccagtaccagagcctgctgaacagctacggcgagcccgtggacgacaagagcgccaccctgctgcagctgatcaccaagttcgccaccgagtactgcaacaccatcgagggcaccgccaagtacatcgagaccagcgagctgtgcggcggcgccagaatctgctacatcttccacgagaccttcggcagaaccctggagagcgtggaccccctgggcggcctgaacaccatcgacatcctgaccgccatcagaaacgccaccggccccagacccgccctgttcgtgcccgaggtgagcttcgagctgctggtgaagagacagatcaagagactggaggagcccagcctgagatgcgtggagctggtgcacgaggagatgcagagaatcatccagcactgcagcaactacagcacccaggagctgctgagattccccaagctgcacgacgccatcgtggaggtggtgacctgcctgctgagaaagagactgcccgtgaccaacgagatggtgcacaacctggtggccatcgagctggcctacatcaacaccaagcaccccgacttcgccgacgcctgcggcctgatgaacaacaacatcgaggagcagagaagaaacagactggccagagagctgcccagcgccgtgagcagagacaaggtggccagcggcggcggcggcgtgggcgacggcgtgcaggagcccaccaccggcaactggagaggcatgctgaagaccagcaaggccgaggagctgctggccgaggagaagagcaagcccatccccatcatgcccgccagcccccagaagggccacgccgtgaacctgctggacgtgcccgtgcccgtggccagaaagctgagcgccagagagcagagagactgcgaggtgatcgagagactgatcaagagctacttcctgatcgtgagaaagaacatccaggacagcgtgcccaaggccgtgatgcacttcctggtgaaccacgtgaaggacaccctgcagagcgagctggtgggccagctgtacaagagcagcctgctggacgacctgctgaccgagagcgaggacatggcccagagaagaaaggaggccgccgacatgctgaaggccctgcagggcgccagccagatcatcgccgagatcagagagacccacctgtggtag

SEQ ID NO: 79811 - DNA, 2376 bp, Artificial Sequence
  Description of Artificial Sequence: Synthetic coding sequence
atggcctgcagagagggcgccggcagcagaagagccagaagcaacggctgcagactgcccagaagaggcagaagaagaggcggcagaagaagaaccgtgggccccggccccatccactgcagaggcagaagagccctgggccccagagtgttcagagtgatggaggccctgatccccgtgatcaacaagctgcaggacgtgttcaacaccgtgggcgccgacatcatccagctgccccagatcgtggtggtgggcacccagagcagcggcaagagcagcgtgctggagagcctggtgggcagagacctgctgcccagaggcaccggcatcgtgaccagaagacccctgatcctgcagctggtgcacgtgagccaggaggacaagagaaagaccaccggcgaggagaacgaccccgccacctggaagaacagcagacacctgagcaagggcgtggaggccgaggagtggggcaagttcctgcacaccaagaacaagctgtacaccgacttcgacgagatcagacaggagatcgagaacgagaccgagagaatcagcggcaacaacaagggcgtgagccccgagcccatccacctgaagatcttcagccccaacgtggtgaacctgaccctggtggacctgcccggcatgaccaaggtgcccgtgggcgaccagcccaaggacatcgagctgcagatcagagagctgatcctgagattcatcagcaaccccaacagcatcatcctggccgtgaccgccgccaacaccgacatggccaccagcgaggccctgaagatcagcagagaggtggaccccgacggcagaagaaccctggccgtgatcaccaagctggacctgatggacgccggcaccgacgccatggacgtgctgatgggcagagtgatccccgtgaagctgggcatcatcggcgtggtgaacagaagccagctggacatcaacaacaagaagagcgtgaccgacagcatcagagacgagtacgccttcctgcagaagaagtaccccagcctggccaacagaaacggcaccaagtacctggccagaaccctgaacagactgctgatgcaccacatcagagactgcctgcccgagctgaagaccagaatcaacgtgctggccgcccagtaccagagcctgctgaacagctacggcgagcccgtggacgacaagagcgccaccctgctgcagctgatcaccaagttcgccaccgagtactgcaacaccatcgagggcaccgccaagtacatcgagaccagcgagctgtgcggcggcgccagaatctgctacatcttccacgagaccttcggcagaaccctggagagcgtggaccccctgggcggcctgaacaccatcgacatcctgaccgccatcagaaacgccaccggccccagacccgccctgttcgtgcccgaggtgagcttcgagctgctggtgaagagacagatcaagagactggaggagcccagcctgagatgcgtggagctggtgcacgaggagatgcagagaatcatccagcactgcagcaactacagcacccaggagctgctgagattccccaagctgcacgacgccatcgtggaggtggtgacctgcctgctgagaaagagactgcccgtgaccaacgagatggtgcacaacctggtggccatcgagctggcctacatcaacaccaagcaccccgacttcgccgacgcctgcggcctgatgaacaacaacatcgaggagcagagaagaaacagactggccagagagctgcccagcgccgtgagcagagacaagagcagcaaggtgcccagcgccctggcccccgccagccaggagcccagccccgccgccagcgccgaggccgacggcaaggtggccagcggcggcggcggcgtgggcgacggcgtgcaggagcccaccaccggcaactggagaggcatgctgaagaccagcaaggccgaggagctgctggccgaggagaagagcaagcccatccccatcatgcccgccagcccccagaagggccacgccgtgaacctgctggacgtgcccgtgcccgtggccagaaagctgagcgccagagagcagagagactgcgaggtgatcgagagactgatcaagagctacttcctgatcgtgagaaagaacatccaggacagcgtgcccaaggccgtgatgcacttcctggtgaaccacgtgaaggacaccctgcagagcgagctggtgggccagctgtacaagagcagcctgctggacgacctgctgaccgagagcgaggacatggcccagagaagaaaggaggccgccgacatgctgaaggccctgcagggcgccagccagatcatcgccgagatcagagagacccacctgtggtag

SEQ ID NO: 79812 - DNA, 1602 bp, Artificial Sequence
  Description of Artificial Sequence: Synthetic coding sequence
atgttccacaagaagatcaacggcaagcagcaggagaagaagatgaccctgctgcacggcaagacccaggacaccttcctgaagggctggaagcagaagaacggcgtgaacttcttcacccccaagatcagaagccagctggacatcaacaacaagaagagcgtgaccgacagcatcagagacgagtacgccttcctgcagaagaagtaccccagcctggccaacagaaacggcaccaagtacctggccagaaccctgaacagactgctgatgcaccacatcagagactgcctgcccgagctgaagaccagaatcaacgtgctggccgcccagtaccagagcctgctgaacagctacggcgagcccgtggacgacaagagcgccaccctgctgcagctgatcaccaagttcgccaccgagtactgcaacaccatcgagggcaccgccaagtacatcgagaccagcgagctgtgcggcggcgccagaatctgctacatcttccacgagaccttcggcagaaccctggagagcgtggaccccctgggcggcctgaacaccatcgacatcctgaccgccatcagaaacgccaccggccccagacccgccctgttcgtgcccgaggtgagcttcgagctgctggtgaagagacagatcaagagactggaggagcccagcctgagatgcgtggagctggtgcacgaggagatgcagagaatcatccagcactgcagcaactacagcacccaggagctgctgagattccccaagctgcacgacgccatcgtggaggtggtgacctgcctgctgagaaagagactgcccgtgaccaacgagatggtgcacaacctggtggccatcgagctggcctacatcaacaccaagcaccccgacttcgccgacgcctgcggcctgatgaacaacaacatcgaggagcagagaagaaacagactggccagagagctgcccagcgccgtgagcagagacaagagcagcaaggtgcccagcgccctggcccccgccagccaggagcccagccccgccgccagcgccgaggccgacggcaagctgatccaggacagcagaagagagaccaagaacgtggccagcggcggcggcggcgtgggcgacggcgtgcaggagcccaccaccggcaactggagaggcatgctgaagaccagcaaggccgaggagctgctggccgaggagaagagcaagcccatccccatcatgcccgccagcccccagaagggccacgccgtgaacctgctggacgtgcccgtgcccgtggccagaaagctgagcgccagagagcagagagactgcgaggtgatcgagagactgatcaagagctacttcctgatcgtgagaaagaacatccaggacagcgtgcccaaggccgtgatgcacttcctggtgaaccacgtgaaggacaccctgcagagcgagctggtgggccagctgtacaagagcagcctgctggacgacctgctgaccgagagcgaggacatggcccagagaagaaaggaggccgccgacatgctgaaggccctgcagggcgccagccagatcatcgccgagatcagagagacccacctgtggtag

SEQ ID NO: 79813 - DNA, 2133 bp, Artificial Sequence
  Description of Artificial Sequence: Synthetic coding sequence
atggaggccctgatccccgtgatcaacaagctgcaggacgtgttcaacaccgtgggcgccgacatcatccagctgccccagatcgtggtggtgggcacccagagcagcggcaagagcagcgtgctggagagcctggtgggcagagacctgctgcccagaggcaccggcatcgtgaccagaagacccctgatcctgcagctggtgcacgtgagccaggaggacaagagaaagaccaccggcgaggagaacggcgtggaggccgaggagtggggcaagttcctgcacaccaagaacaagctgtacaccgacttcgacgagatcagacaggagatcgagaacgagaccgagagaatcagcggcaacaacaagggcgtgagccccgagcccatccacctgaagatcttcagccccaacgtggtgaacctgaccctggtggacctgcccggcatgaccaaggtgcccgtgggcgaccagcccaaggacatcgagctgcagatcagagagctgatcctgagattcatcagcaaccccaacagcatcatcctggccgtgaccgccgccaacaccgacatggccaccagcgaggccctgaagatcagcagagaggtggaccccgacggcagaagaaccctggccgtgatcaccaagctggacctgatggacgccggcaccgacgccatggacgtgctgatgggcagagtgatccccgtgaagctgggcatcatcggcgtggtgaacagaagccagctggacatcaacaacaagaagagcgtgaccgacagcatcagagacgagtacgccttcctgcagaagaagtaccccagcctggccaacagaaacggcaccaagtacctggccagaaccctgaacagactgctgatgcaccacatcagagactgcctgcccgagctgaagaccagaatcaacgtgctggccgcccagtaccagagcctgctgaacagctacggcgagcccgtggacgacaagagcgccaccctgctgcagctgatcaccaagttcgccaccgagtactgcaacaccatcgagggcaccgccaagtacatcgagaccagcgagctgtgcggcggcgccagaatctgctacatcttccacgagaccttcggcagaaccctggagagcgtggaccccctgggcggcctgaacaccatcgacatcctgaccgccatcagaaacgccaccggccccagacccgccctgttcgtgcccgaggtgagcttcgagctgctggtgaagagacagatcaagagactggaggagcccagcctgagatgcgtggagctggtgcacgaggagatgcagagaatcatccagcactgcagcaactacagcacccaggagctgctgagattccccaagctgcacgacgccatcgtggaggtggtgacctgcctgctgagaaagagactgcccgtgaccaacgagatggtgcacaacctggtggccatcgagctggcctacatcaacaccaagcaccccgacttcgccgacgcctgcggcctgatgaacaacaacatcgaggagcagagaagaaacagactggccagagagctgcccagcgccgtgagcagagacaagctgatccaggacagcagaagagagaccaagaacgtggccagcggcggcggcggcgtgggcgacggcgtgcaggagcccaccaccggcaactggagaggcatgctgaagaccagcaaggccgaggagctgctggccgaggagaagagcaagcccatccccatcatgcccgccagcccccagaagggccacgccgtgaacctgctggacgtgcccgtgcccgtggccagaaagctgagcgccagagagcagagagactgcgaggtgatcgagagactgatcaagagctacttcctgatcgtgagaaagaacatccaggacagcgtgcccaaggccgtgatgcacttcctggtgaaccacgtgaaggacaccctgcagagcgagctggtgggccagctgtacaagagcagcctgctggacgacctgctgaccgagagcgaggacatggcccagagaagaaaggaggccgccgacatgctgaaggccctgcagggcgccagccagatcatcgccgagatcagagagacccacctgtggtag

SEQ ID NO: 79814 - DNA, 2178 bp, Artificial Sequence
  Description of Artificial Sequence: Synthetic coding sequence
atggaggccctgatccccgtgatcaacaagctgcaggacgtgttcaacaccgtgggcgccgacatcatccagctgccccagatcgtggtggtgggcacccagagcagcggcaagagcagcgtgctggagagcctggtgggcagagacctgctgcccagaggcaccggcatcgtgaccagaagacccctgatcctgcagctggtgcacgtgagccaggaggacaagagaaagaccaccggcgaggagaacggcgtggaggccgaggagtggggcaagttcctgcacaccaagaacaagctgtacaccgacttcgacgagatcagacaggagatcgagaacgagaccgagagaatcagcggcaacaacaagggcgtgagccccgagcccatccacctgaagatcttcagccccaacgtggtgaacctgaccctggtggacctgcccggcatgaccaaggtgcccgtgggcgaccagcccaaggacatcgagctgcagatcagagagctgatcctgagattcatcagcaaccccaacagcatcatcctggccgtgaccgccgccaacaccgacatggccaccagcgaggccctgaagatcagcagagaggtggaccccgacggcagaagaaccctggccgtgatcaccaagctggacctgatggacgccggcaccgacgccatggacgtgctgatgggcagagtgatccccgtgaagctgggcatcatcggcgtggtgaacagaagccagctggacatcaacaacaagaagagcgtgaccgacagcatcagagacgagtacgccttcctgcagaagaagtaccccagcctggccaacagaaacggcaccaagtacctggccagaaccctgaacagactgctgatgcaccacatcagagactgcctgcccgagctgaagaccagaatcaacgtgctggccgcccagtaccagagcctgctgaacagctacggcgagcccgtggacgacaagagcgccaccctgctgcagctgatcaccaagttcgccaccgagtactgcaacaccatcgagggcaccgccaagtacatcgagaccagcgagctgtgcggcggcgccagaatctgctacatcttccacgagaccttcggcagaaccctggagagcgtggaccccctgggcggcctgaacaccatcgacatcctgaccgccatcagaaacgccaccggccccagacccgccctgttcgtgcccgaggtgagcttcgagctgctggtgaagagacagatcaagagactggaggagcccagcctgagatgcgtggagctggtgcacgaggagatgcagagaatcatccagcactgcagcaactacagcacccaggagctgctgagattccccaagctgcacgacgccatcgtggaggtggtgacctgcctgctgagaaagagactgcccgtgaccaacgagatggtgcacaacctggtggccatcgagctggcctacatcaacaccaagcaccccgacttcgccgacgcctgcggcctgatgaacaacaacatcgaggagcagagaagaaacagactggccagagagctgcccagcgccgtgagcagagacaagagcagcaaggtgcccagcgccctggcccccgccagccaggagcccagccccgccgccagcgccgaggccgacggcaaggtggccagcggcggcggcggcgtgggcgacggcgtgcaggagcccaccaccggcaactggagaggcatgctgaagaccagcaaggccgaggagctgctggccgaggagaagagcaagcccatccccatcatgcccgccagcccccagaagggccacgccgtgaacctgctggacgtgcccgtgcccgtggccagaaagctgagcgccagagagcagagagactgcgaggtgatcgagagactgatcaagagctacttcctgatcgtgagaaagaacatccaggacagcgtgcccaaggccgtgatgcacttcctggtgaaccacgtgaaggacaccctgcagagcgagctggtgggccagctgtacaagagcagcctgctggacgacctgctgaccgagagcgaggacatggcccagagaagaaaggaggccgccgacatgctgaaggccctgcagggcgccagccagatcatcgccgagatcagagagacccacctgtggtag

SEQ ID NO: 79815 - DNA, 2211 bp, Artificial Sequence
  Description of Artificial Sequence: Synthetic coding sequence
atggaggccctgatccccgtgatcaacaagctgcaggacgtgttcaacaccgtgggcgccgacatcatccagctgccccagatcgtggtggtgggcacccagagcagcggcaagagcagcgtgctggagagcctggtgggcagagacctgctgcccagaggcaccggcatcgtgaccagaagacccctgatcctgcagctggtgcacgtgagccaggaggacaagagaaagaccaccggcgaggagaacggcgtggaggccgaggagtggggcaagttcctgcacaccaagaacaagctgtacaccgacttcgacgagatcagacaggagatcgagaacgagaccgagagaatcagcggcaacaacaagggcgtgagccccgagcccatccacctgaagatcttcagccccaacgtggtgaacctgaccctggtggacctgcccggcatgaccaaggtgcccgtgggcgaccagcccaaggacatcgagctgcagatcagagagctgatcctgagattcatcagcaaccccaacagcatcatcctggccgtgaccgccgccaacaccgacatggccaccagcgaggccctgaagatcagcagagaggtggaccccgacggcagaagaaccctggccgtgatcaccaagctggacctgatggacgccggcaccgacgccatggacgtgctgatgggcagagtgatccccgtgaagctgggcatcatcggcgtggtgaacagaagccagctggacatcaacaacaagaagagcgtgaccgacagcatcagagacgagtacgccttcctgcagaagaagtaccccagcctggccaacagaaacggcaccaagtacctggccagaaccctgaacagactgctgatgcaccacatcagagactgcctgcccgagctgaagaccagaatcaacgtgctggccgcccagtaccagagcctgctgaacagctacggcgagcccgtggacgacaagagcgccaccctgctgcagctgatcaccaagttcgccaccgagtactgcaacaccatcgagggcaccgccaagtacatcgagaccagcgagctgtgcggcggcgccagaatctgctacatcttccacgagaccttcggcagaaccctggagagcgtggaccccctgggcggcctgaacaccatcgacatcctgaccgccatcagaaacgccaccggccccagacccgccctgttcgtgcccgaggtgagcttcgagctgctggtgaagagacagatcaagagactggaggagcccagcctgagatgcgtggagctggtgcacgaggagatgcagagaatcatccagcactgcagcaactacagcacccaggagctgctgagattccccaagctgcacgacgccatcgtggaggtggtgacctgcctgctgagaaagagactgcccgtgaccaacgagatggtgcacaacctggtggccatcgagctggcctacatcaacaccaagcaccccgacttcgccgacgcctgcggcctgatgaacaacaacatcgaggagcagagaagaaacagactggccagagagctgcccagcgccgtgagcagagacaagagcagcaaggtgcccagcgccctggcccccgccagccaggagcccagccccgccgccagcgccgaggccgacggcaagctgatccaggacagcagaagagagaccaagaacgtggccagcggcggcggcggcgtgggcgacggcgtgcaggagcccaccaccggcaactggagaggcatgctgaagaccagcaaggccgaggagctgctggccgaggagaagagcaagcccatccccatcatgcccgccagcccccagaagggccacgccgtgaacctgctggacgtgcccgtgcccgtggccagaaagctgagcgccagagagcagagagactgcgaggtgatcgagagactgatcaagagctacttcctgatcgtgagaaagaacatccaggacagcgtgcccaaggccgtgatgcacttcctggtgaaccacgtgaaggacaccctgcagagcgagctggtgggccagctgtacaagagcagcctgctggacgacctgctgaccgagagcgaggacatggcccagagaagaaaggaggccgccgacatgctgaaggccctgcagggcgccagccagatcatcgccgagatcagagagacccacctgtggtag

SEQ ID NO: 79816 - DNA, 2250 bp, Artificial Sequence
  Description of Artificial Sequence: Synthetic coding sequence
atggaggccctgatccccgtgatcaacaagctgcaggacgtgttcaacaccgtgggcgccgacatcatccagctgccccagatcgtggtggtgggcacccagagcagcggcaagagcagcgtgctggagagcctggtgggcagagacctgctgcccagaggcaccggcatcgtgaccagaagacccctgatcctgcagctggtgcacgtgagccaggaggacaagagaaagaccaccggcgaggagaacgaccccgccacctggaagaacagcagacacctgagcaagggcgtggaggccgaggagtggggcaagttcctgcacaccaagaacaagctgtacaccgacttcgacgagatcagacaggagatcgagaacgagaccgagagaatcagcggcaacaacaagggcgtgagccccgagcccatccacctgaagatcttcagccccaacgtggtgaacctgaccctggtggacctgcccggcatgaccaaggtgcccgtgggcgaccagcccaaggacatcgagctgcagatcagagagctgatcctgagattcatcagcaaccccaacagcatcatcctggccgtgaccgccgccaacaccgacatggccaccagcgaggccctgaagatcagcagagaggtggaccccgacggcagaagaaccctggccgtgatcaccaagctggacctgatggacgccggcaccgacgccatggacgtgctgatgggcagagtgatccccgtgaagctgggcatcatcggcgtggtgaacagaagccagctggacatcaacaacaagaagagcgtgaccgacagcatcagagacgagtacgccttcctgcagaagaagtaccccagcctggccaacagaaacggcaccaagtacctggccagaaccctgaacagactgctgatgcaccacatcagagactgcctgcccgagctgaagaccagaatcaacgtgctggccgcccagtaccagagcctgctgaacagctacggcgagcccgtggacgacaagagcgccaccctgctgcagctgatcaccaagttcgccaccgagtactgcaacaccatcgagggcaccgccaagtacatcgagaccagcgagctgtgcggcggcgccagaatctgctacatcttccacgagaccttcggcagaaccctggagagcgtggaccccctgggcggcctgaacaccatcgacatcctgaccgccatcagaaacgccaccggccccagacccgccctgttcgtgcccgaggtgagcttcgagctgctggtgaagagacagatcaagagactggaggagcccagcctgagatgcgtggagctggtgcacgaggagatgcagagaatcatccagcactgcagcaactacagcacccaggagctgctgagattccccaagctgcacgacgccatcgtggaggtggtgacctgcctgctgagaaagagactgcccgtgaccaacgagatggtgcacaacctggtggccatcgagctggcctacatcaacaccaagcaccccgacttcgccgacgcctgcggcctgatgaacaacaacatcgaggagcagagaagaaacagactggccagagagctgcccagcgccgtgagcagagacaagagcagcaaggtgcccagcgccctggcccccgccagccaggagcccagccccgccgccagcgccgaggccgacggcaagctgatccaggacagcagaagagagaccaagaacgtggccagcggcggcggcggcgtgggcgacggcgtgcaggagcccaccaccggcaactggagaggcatgctgaagaccagcaaggccgaggagctgctggccgaggagaagagcaagcccatccccatcatgcccgccagcccccagaagggccacgccgtgaacctgctggacgtgcccgtgcccgtggccagaaagctgagcgccagagagcagagagactgcgaggtgatcgagagactgatcaagagctacttcctgatcgtgagaaagaacatccaggacagcgtgcccaaggccgtgatgcacttcctggtgaaccacgtgaaggacaccctgcagagcgagctggtgggccagctgtacaagagcagcctgctggacgacctgctgaccgagagcgaggacatggcccagagaagaaaggaggccgccgacatgctgaaggccctgcagggcgccagccagatcatcgccgagatcagagagacccacctgtggtag

SEQ ID NO: 79817 - DNA, 2613 bp, Artificial Sequence
  Description of Artificial Sequence: Synthetic coding sequence
atgggcaacagaggcatggaggagctgatccccctggtgaacaagctgcaggacgccttcagcagcatcggccagagctgccacctggacctgccccagatcgccgtggtgggcggccagagcgccggcaagagcagcgtgctggagaacttcgtgggcagagacttcctgcccagaggcagcggcatcgtgaccagaagacccctgatcctgcagctgatcttcagcaagaccgagcacgccgagttcctgcactgcaagagcaagaagttcaccgacttcgacgaggtgagacaggagatcgaggccgagaccgacagagtgaccggcaccaacaagggcatcagccccgtgcccatcaacctgagagtgtacagcccccacgtgctgaacctgaccctgatcgacctgcccggcatcaccaaggtgcccgtgggcgaccagccccccgacatcgagtaccagatcaaggacatgatcctgcagttcatcagcagagagagcagcctgatcctggccgtgacccccgccaacatggacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacatcggcgtggtgaacagaagccagaaggacatcgagggcaagaaggacatcagagccgccctggccgccgagagaaagttcttcctgagccaccccgcctacagacacatggccgacagaatgggcaccccccacctgcagaagaccctgaaccagcagctgaccaaccacatcagagagagcctgcccgccctgagaagcaagctgcagagccagctgctgagcctggagaaggaggtggaggagtacaagaacttcagacccgacgaccccaccagaaagaccaaggccctgctgcagatggtgcagcagttcggcgtggacttcgagaagagaatcgagggcagcggcgaccaggtggacaccctggagctgagcggcggcgccagaatcaacagaatcttccacgagagattccccttcgagctggtgaagatggagttcgacgagaaggacctgagaagagagatcagctacgccatcaagaacatccacggcgtgagaaccggcctgttcacccccgacatggccttcgaggccatcgtgaagaagcagatcgtgaagctgaaggagcccagcctgaagtgcgtggacctggtggtgagcgagctggccaccgtgatcaagaagtgcgccgagaagctgagcagctaccccagactgagagaggagaccgagagaatcgtgaccacctacatcagagagagagagggcagaaccaaggaccagatcctgctgctgatcgacatcgagcagagctacatcaacaccaaccacgaggacttcatcggcttcgccaacgcccagcagagaagcacccagctgaacaagaagagagccatccccaaccagcccgagaccctggtgatcagaagaggctggctgaccatcaacaacatcagcctgatgaagggcggcagcaaggagtactggttcgtgctgaccgccgagagcctgagctggtacaaggacgaggaggagaaggagaagaagtacatgctgcccctggacaacctgaagatcagagacgtggagaagggcttcatgagcaacaagcacgtgttcgccatcttcaacaccgagcagagaaacgtgtacaaggacctgagacagatcgagctggcctgcgacagccaggaggacgtggacagctggaaggccagcttcctgagagccggcgtgtaccccgagaaggaccaggccgagaacgaggacggcgcccaggagaacaccttcagcatggacccccagctggagagacaggtggagaccatcagaaacctggtggacagctacgtggccatcatcaacaagagcatcagagacctgatgcccaagaccatcatgcacctgatgatcaacaacaccaaggccttcatccaccacgagctgctggcctacctgtacagcagcgccgaccagagcagcctgatggaggagagcgccgaccaggcccagagaagagacgacatgctgagaatgtaccacgccctgaaggaggccctgaacatcatcggcgacatcagcaccagcaccgtgagcacccccgtgcccccccccgtggacgacacctggctgcagagcgccagcagccacagccccaccccccagagaagacccgtgagcagcatccacccccccggcagaccccccgccgtgagaggccccacccccggcccccccctgatccccgtgcccgtgggcgccgccgccagcttcagcgccccccccatccccagcagacccggcccccagagcgtgttcgccaacagcgacctgttccccgcccccccccagatccccagcagacccgtgagaatcccccccggcatcccccccggcgtgcccagcagaagaccccccgccgcccccagcagacccaccatcatcagacccgccgagcccagcctgctggactag

SEQ ID NO: 79818 - DNA, 2601 bp, Artificial Sequence
  Description of Artificial Sequence: Synthetic coding sequence
atgggcaacagaggcatggaggagctgatccccctggtgaacaagctgcaggacgccttcagcagcatcggccagagctgccacctggacctgccccagatcgccgtggtgggcggccagagcgccggcaagagcagcgtgctggagaacttcgtgggcagagacttcctgcccagaggcagcggcatcgtgaccagaagacccctgatcctgcagctgatcttcagcaagaccgagcacgccgagttcctgcactgcaagagcaagaagttcaccgacttcgacgaggtgagacaggagatcgaggccgagaccgacagagtgaccggcaccaacaagggcatcagccccgtgcccatcaacctgagagtgtacagcccccacgtgctgaacctgaccctgatcgacctgcccggcatcaccaaggtgcccgtgggcgaccagccccccgacatcgagtaccagatcaaggacatgatcctgcagttcatcagcagagagagcagcctgatcctggccgtgacccccgccaacatggacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacatcggcgtggtgaacagaagccagaaggacatcgagggcaagaaggacatcagagccgccctggccgccgagagaaagttcttcctgagccaccccgcctacagacacatggccgacagaatgggcaccccccacctgcagaagaccctgaaccagcagctgaccaaccacatcagagagagcctgcccgccctgagaagcaagctgcagagccagctgctgagcctggagaaggaggtggaggagtacaagaacttcagacccgacgaccccaccagaaagaccaaggccctgctgcagatggtgcagcagttcggcgtggacttcgagaagagaatcgagggcagcggcgaccaggtggacaccctggagctgagcggcggcgccagaatcaacagaatcttccacgagagattccccttcgagctggtgaagatggagttcgacgagaaggacctgagaagagagatcagctacgccatcaagaacatccacggcgtgagaaccggcctgttcacccccgacctggccttcgaggccatcgtgaagaagcaggtggtgaagctgaaggagccctgcctgaagtgcgtggacctggtgatccaggagctgatcaacaccgtgagacagtgcaccagcaagctgagcagctaccccagactgagagaggagaccgagagaatcgtgaccacctacatcagagagagagagggcagaaccaaggaccagatcctgctgctgatcgacatcgagcagagctacatcaacaccaaccacgaggacttcatcggcttcgccaacgcccagcagagaagcacccagctgaacaagaagagagccatccccaaccaggtgatcagaagaggctggctgaccatcaacaacatcagcctgatgaagggcggcagcaaggagtactggttcgtgctgaccgccgagagcctgagctggtacaaggacgaggaggagaaggagaagaagtacatgctgcccctggacaacctgaagatcagagacgtggagaagggcttcatgagcaacaagcacgtgttcgccatcttcaacaccgagcagagaaacgtgtacaaggacctgagacagatcgagctggcctgcgacagccaggaggacgtggacagctggaaggccagcttcctgagagccggcgtgtaccccgagaaggaccaggccgagaacgaggacggcgcccaggagaacaccttcagcatggacccccagctggagagacaggtggagaccatcagaaacctggtggacagctacgtggccatcatcaacaagagcatcagagacctgatgcccaagaccatcatgcacctgatgatcaacaacaccaaggccttcatccaccacgagctgctggcctacctgtacagcagcgccgaccagagcagcctgatggaggagagcgccgaccaggcccagagaagagacgacatgctgagaatgtaccacgccctgaaggaggccctgaacatcatcggcgacatcagcaccagcaccgtgagcacccccgtgcccccccccgtggacgacacctggctgcagagcgccagcagccacagccccaccccccagagaagacccgtgagcagcatccacccccccggcagaccccccgccgtgagaggccccacccccggcccccccctgatccccgtgcccgtgggcgccgccgccagcttcagcgccccccccatccccagcagacccggcccccagagcgtgttcgccaacagcgacctgttccccgcccccccccagatccccagcagacccgtgagaatcccccccggcatcccccccggcgtgcccagcagaagaccccccgccgcccccagcagacccaccatcatcagacccgccgagcccagcctgctggactag

SEQ ID NO: 79819 - DNA, 2613 bp, Artificial Sequence
  Description of Artificial Sequence: Synthetic coding sequence
atgggcaacagaggcatggaggagctgatccccctggtgaacaagctgcaggacgccttcagcagcatcggccagagctgccacctggacctgccccagatcgccgtggtgggcggccagagcgccggcaagagcagcgtgctggagaacttcgtgggcagagacttcctgcccagaggcagcggcatcgtgaccagaagacccctgatcctgcagctgatcttcagcaagaccgagcacgccgagttcctgcactgcaagagcaagaagttcaccgacttcgacgaggtgagacaggagatcgaggccgagaccgacagagtgaccggcaccaacaagggcatcagccccgtgcccatcaacctgagagtgtacagcccccacgtgctgaacctgaccctgatcgacctgcccggcatcaccaaggtgcccgtgggcgaccagccccccgacatcgagtaccagatcaaggacatgatcctgcagttcatcagcagagagagcagcctgatcctggccgtgacccccgccaacatggacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacatcggcgtggtgaacagaagccagaaggacatcgagggcaagaaggacatcagagccgccctggccgccgagagaaagttcttcctgagccaccccgcctacagacacatggccgacagaatgggcaccccccacctgcagaagaccctgaaccagcagctgaccaaccacatcagagagagcctgcccgccctgagaagcaagctgcagagccagctgctgagcctggagaaggaggtggaggagtacaagaacttcagacccgacgaccccaccagaaagaccaaggccctgctgcagatggtgcagcagttcggcgtggacttcgagaagagaatcgagggcagcggcgaccaggtggacaccctggagctgagcggcggcgccagaatcaacagaatcttccacgagagattccccttcgagctggtgaagatggagttcgacgagaaggacctgagaagagagatcagctacgccatcaagaacatccacggcgtgagaaccggcctgttcacccccgacctggccttcgaggccatcgtgaagaagcaggtggtgaagctgaaggagccctgcctgaagtgcgtggacctggtgatccaggagctgatcaacaccgtgagacagtgcaccagcaagctgagcagctaccccagactgagagaggagaccgagagaatcgtgaccacctacatcagagagagagagggcagaaccaaggaccagatcctgctgctgatcgacatcgagcagagctacatcaacaccaaccacgaggacttcatcggcttcgccaacgcccagcagagaagcacccagctgaacaagaagagagccatccccaaccagggcgagatcctggtgatcagaagaggctggctgaccatcaacaacatcagcctgatgaagggcggcagcaaggagtactggttcgtgctgaccgccgagagcctgagctggtacaaggacgaggaggagaaggagaagaagtacatgctgcccctggacaacctgaagatcagagacgtggagaagggcttcatgagcaacaagcacgtgttcgccatcttcaacaccgagcagagaaacgtgtacaaggacctgagacagatcgagctggcctgcgacagccaggaggacgtggacagctggaaggccagcttcctgagagccggcgtgtaccccgagaaggaccaggccgagaacgaggacggcgcccaggagaacaccttcagcatggacccccagctggagagacaggtggagaccatcagaaacctggtggacagctacgtggccatcatcaacaagagcatcagagacctgatgcccaagaccatcatgcacctgatgatcaacaacaccaaggccttcatccaccacgagctgctggcctacctgtacagcagcgccgaccagagcagcctgatggaggagagcgccgaccaggcccagagaagagacgacatgctgagaatgtaccacgccctgaaggaggccctgaacatcatcggcgacatcagcaccagcaccgtgagcacccccgtgcccccccccgtggacgacacctggctgcagagcgccagcagccacagccccaccccccagagaagacccgtgagcagcatccacccccccggcagaccccccgccgtgagaggccccacccccggcccccccctgatccccgtgcccgtgggcgccgccgccagcttcagcgccccccccatccccagcagacccggcccccagagcgtgttcgccaacagcgacctgttccccgcccccccccagatccccagcagacccgtgagaatcccccccggcatcccccccggcgtgcccagcagaagaccccccgccgcccccagcagacccaccatcatcagacccgccgagcccagcctgctggactag

SEQ ID NO: 79820 - DNA, 1461 bp, Artificial Sequence
  Description of Artificial Sequence: Synthetic coding sequence
cacgtgaccgtggccgccgccgacagctggaagccccccgccagcgcccagcacgtgggcagagcccccagagccggcgccgccacctgcttcctgggccccagaccccccagccacctgggcggcagagacttcctgcccagaggcagcggcatcgtgaccagaagacccctgatcctgcagctgatcttcagcaagaccgagcacgccgagttcctgcactgcaagagcaagaagttcaccgacttcgacgaggtgagacaggagatcgaggccgagaccgacagagtgaccggcaccaacaagggcatcagccccgtgcccatcaacctgagagtgtacagcccccacgtgctgaacctgaccctgatcgacctgcccggcatcaccaaggtgcccgtgggcgaccagccccccgacatcgagtaccagatcaaggacatgatcctgcagttcatcagcagagagagcagcctgatcctggccgtgacccccgccaacatggacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacatcggcgtggtgaacagaagccagaaggacatcgagggcaagaaggacatcagagccgccctggccgccgagagaaagttcttcctgagccaccccgcctacagacacatggccgacagaatgggcaccccccacctgcagaagaccctgaaccagcagctgaccaaccacatcagagagagcctgcccgccctgagaagcaagctgcagagccagctgctgagcctggagaaggaggtggaggagtacaagaacttcagacccgacgaccccaccagaaagaccaaggccctgctgcagatggtgcagcagttcggcgtggacttcgagaagagaatcgagggcagcggcgaccaggtggacaccctggagctgagcggcggcgccagaatcaacagaatcttccacgagagattccccttcgagctggtgaagatggagttcgacgagaaggacctgagaagagagatcagctacgccatcaagaacatccacggcgtgagaaccggcctgttcacccccgacatggccttcgaggccatcgtgaagaagcagatcgtgaagctgaaggagcccagcctgaagtgcgtggacctggtggtgagcgagctggccaccgtgatcaagaagtgcgccgagaagctgagcagctaccccagactgagagaggagaccgagagaatcgtgaccacctacatcagagagagagagggcagaaccaaggaccagatcctgctgctgatcgacatcgagcagagctacatcaacaccaaccacgaggacttcatcggcttcgcctag

SEQ ID NO: 79821 - DNA, 2613 bp, Artificial Sequence
  Description of Artificial Sequence: Synthetic coding sequence
atgggcaacagaggcatggaggagctgatccccctggtgaacaagctgcaggacgccttcagcagcatcggccagagctgccacctggacctgccccagatcgccgtggtgggcggccagagcgccggcaagagcagcgtgctggagaacttcgtgggcagagacttcctgcccagaggcagcggcatcgtgaccagaagacccctgatcctgcagctgatcttcagcaagaccgagcacgccgagttcctgcactgcaagagcaagaagttcaccgacttcgacgaggtgagacaggagatcgaggccgagaccgacagagtgaccggcaccaacaagggcatcagccccgtgcccatcaacctgagagtgtacagcccccacgtgctgaacctgaccctgatcgacctgcccggcatcaccaaggtgcccgtgggcgaccagccccccgacatcgagtaccagatcaaggacatgatcctgcagttcatcagcagagagagcagcctgatcctggccgtgacccccgccaacatggacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacatcggcgtggtgaacagaagccagaaggacatcgagggcaagaaggacatcagagccgccctggccgccgagagaaagttcttcctgagccaccccgcctacagacacatggccgacagaatgggcaccccccacctgcagaagaccctgaaccagcagctgaccaaccacatcagagagagcctgcccgccctgagaagcaagctgcagagccagctgctgagcctggagaaggaggtggaggagtacaagaacttcagacccgacgaccccaccagaaagaccaaggccctgctgcagatggtgcagcagttcggcgtggacttcgagaagagaatcgagggcagcggcgaccaggtggacaccctggagctgagcggcggcgccagaatcaacagaatcttccacgagagattccccttcgagctggtgaagatggagttcgacgagaaggacctgagaagagagatcagctacgccatcaagaacatccacggcgtgagaaccggcctgttcacccccgacatggccttcgaggccatcgtgaagaagcagatcgtgaagctgaaggagcccagcctgaagtgcgtggacctggtggtgagcgagctggccaccgtgatcaagaagtgcgccgagaagctgagcagctaccccagactgagagaggagaccgagagaatcgtgaccacctacatcagagagagagagggcagaaccaaggaccagatcctgctgctgatcgacatcgagcagagctacatcaacaccaaccacgaggacttcatcggcttcgccaacgcccagcagagaagcacccagctgaacaagaagagagccatccccaaccagggcgagatcctggtgatcagaagaggctggctgaccatcaacaacatcagcctgatgaagggcggcagcaaggagtactggttcgtgctgaccgccgagagcctgagctggtacaaggacgaggaggagaaggagaagaagtacatgctgcccctggacaacctgaagatcagagacgtggagaagggcttcatgagcaacaagcacgtgttcgccatcttcaacaccgagcagagaaacgtgtacaaggacctgagacagatcgagctggcctgcgacagccaggaggacgtggacagctggaaggccagcttcctgagagccggcgtgtaccccgagaaggaccaggccgagaacgaggacggcgcccaggagaacaccttcagcatggacccccagctggagagacaggtggagaccatcagaaacctggtggacagctacgtggccatcatcaacaagagcatcagagacctgatgcccaagaccatcatgcacctgatgatcaacaacaccaaggccttcatccaccacgagctgctggcctacctgtacagcagcgccgaccagagcagcctgatggaggagagcgccgaccaggcccagagaagagacgacatgctgagaatgtaccacgccctgaaggaggccctgaacatcatcggcgacatcagcaccagcaccgtgagcacccccgtgcccccccccgtggacgacacctggctgcagagcgccagcagccacagccccaccccccagagaagacccgtgagcagcatccacccccccggcagaccccccgccgtgagaggccccacccccggcccccccctgatccccgtgcccgtgggcgccgccgccagcttcagcgccccccccatccccagcagacccggcccccagagcgtgttcgccaacagcgacctgttccccgcccccccccagatccccagcagacccgtgagaatcccccccggcatcccccccggcgtgcccagcagaagaccccccgccgcccccagcagacccaccatcatcagacccgccgagcccagcctgctggactag

SEQ ID NO: 79822 - DNA, 2601 bp, Artificial Sequence
  Description of Artificial Sequence: Synthetic coding sequence
atgggcaacagaggcatggaggagctgatccccctggtgaacaagctgcaggacgccttcagcagcatcggccagagctgccacctggacctgccccagatcgccgtggtgggcggccagagcgccggcaagagcagcgtgctggagaacttcgtgggcagagacttcctgcccagaggcagcggcatcgtgaccagaagacccctgatcctgcagctgatcttcagcaagaccgagcacgccgagttcctgcactgcaagagcaagaagttcaccgacttcgacgaggtgagacaggagatcgaggccgagaccgacagagtgaccggcaccaacaagggcatcagccccgtgcccatcaacctgagagtgtacagcccccacgtgctgaacctgaccctgatcgacctgcccggcatcaccaaggtgcccgtgggcgaccagccccccgacatcgagtaccagatcaaggacatgatcctgcagttcatcagcagagagagcagcctgatcctggccgtgacccccgccaacatggacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacatcggcgtggtgaacagaagccagaaggacatcgagggcaagaaggacatcagagccgccctggccgccgagagaaagttcttcctgagccaccccgcctacagacacatggccgacagaatgggcaccccccacctgcagaagaccctgaaccagcagctgaccaaccacatcagagagagcctgcccgccctgagaagcaagctgcagagccagctgctgagcctggagaaggaggtggaggagtacaagaacttcagacccgacgaccccaccagaaagaccaaggccctgctgcagatggtgcagcagttcggcgtggacttcgagaagagaatcgagggcagcggcgaccaggtggacaccctggagctgagcggcggcgccagaatcaacagaatcttccacgagagattccccttcgagctggtgaagatggagttcgacgagaaggacctgagaagagagatcagctacgccatcaagaacatccacggcgtgagaaccggcctgttcacccccgacatggccttcgaggccatcgtgaagaagcagatcgtgaagctgaaggagcccagcctgaagtgcgtggacctggtggtgagcgagctggccaccgtgatcaagaagtgcgccgagaagctgagcagctaccccagactgagagaggagaccgagagaatcgtgaccacctacatcagagagagagagggcagaaccaaggaccagatcctgctgctgatcgacatcgagcagagctacatcaacaccaaccacgaggacttcatcggcttcgccaacgcccagcagagaagcacccagctgaacaagaagagagccatccccaaccaggtgatcagaagaggctggctgaccatcaacaacatcagcctgatgaagggcggcagcaaggagtactggttcgtgctgaccgccgagagcctgagctggtacaaggacgaggaggagaaggagaagaagtacatgctgcccctggacaacctgaagatcagagacgtggagaagggcttcatgagcaacaagcacgtgttcgccatcttcaacaccgagcagagaaacgtgtacaaggacctgagacagatcgagctggcctgcgacagccaggaggacgtggacagctggaaggccagcttcctgagagccggcgtgtaccccgagaaggaccaggccgagaacgaggacggcgcccaggagaacaccttcagcatggacccccagctggagagacaggtggagaccatcagaaacctggtggacagctacgtggccatcatcaacaagagcatcagagacctgatgcccaagaccatcatgcacctgatgatcaacaacaccaaggccttcatccaccacgagctgctggcctacctgtacagcagcgccgaccagagcagcctgatggaggagagcgccgaccaggcccagagaagagacgacatgctgagaatgtaccacgccctgaaggaggccctgaacatcatcggcgacatcagcaccagcaccgtgagcacccccgtgcccccccccgtggacgacacctggctgcagagcgccagcagccacagccccaccccccagagaagacccgtgagcagcatccacccccccggcagaccccccgccgtgagaggccccacccccggcccccccctgatccccgtgcccgtgggcgccgccgccagcttcagcgccccccccatccccagcagacccggcccccagagcgtgttcgccaacagcgacctgttccccgcccccccccagatccccagcagacccgtgagaatcccccccggcatcccccccggcgtgcccagcagaagaccccccgccgcccccagcagacccaccatcatcagacccgccgagcccagcctgctggactag

SEQ ID NO: 79823 - DNA, 1200 bp, Artificial Sequence
  Description of Artificial Sequence: Synthetic coding sequence
atgctgcccctggagccctacctgacccagaccagcgccgtgccccagatgagccacttcatgtgccacagccccacccacaagccccagggcctgctgccctgggcccccttccaccaggccagcgtgagcctgtaccccatcagcccctggcccagcgagagcgtgtgcccccccacctgccccggcggcgccagctgctggttccccgccggcaacgcctgggacagagtggagctgggcttcctgggcttcggcgccggcggcgtgagcatcgccgtgcccggcttccccctgagctgcggccagggctgctgcgccggcggctggctgggccacggcgccagattccccgccaagctgagagccttcccccaggtgatcagaagaggctggctgaccatcaacaacatcagcctgatgaagggcggcagcaaggagtactggttcgtgctgaccgccgagagcctgagctggtacaaggacgaggaggagaaggagaagaagtacatgctgcccctggacaacctgaagatcagagacgtggagaagggcttcatgagcaacaagcacgtgttcgccatcttcaacaccgagcagagaaacgtgtacaaggacctgagacagatcgagctggcctgcgacagccaggaggacgtggacagctggaaggccagcttcctgagagccggcgtgtaccccgagaaggaccaggccgagaacgaggacggcgcccaggagaacaccttcagcatggacccccagctggagagacaggtggagaccatcagaaacctggtggacagctacgtggccatcatcaacaagagcatcagagacctgatgcccaagaccatcatgcacctgatgatcaacaacaccaaggccttcatccaccacgagctgctggcctacctgtacagcagcgccgaccagagcagcctgatggaggagagcgccgaccaggcccagagaagagacgacatgctgagaatgtaccacgccctgaaggaggccctgaacatcatcggcgacatcagcaccagcaccgtgagcacccccgtgcccccccccgtggacgacacctggctgcagagcgccagcagccacagccccaccccccagagaagacccgtgagcagcatccacccccccggcagaccccccgccgtgagaggccccacccccggccccccctag

SEQ ID NO: 79824 - DNA, 13284 bp, Artificial Sequence
  Description of Artificial Sequence: Synthetic coding sequence
atgagcagcaaggccgagaagaagcagagactgagcggcagaggcagcagccaggccagctggagcggcagagccaccagagccgccgtggccacccaggagcagggcaacgcccccgccgtgagcgagcccgagctgcaggccgagctgcccaaggaggagcccgagcccagactggagggcccccaggcccagagcgaggagagcgtggagcccgaggccgacgtgaagcccctgttcctgagcagagccgccctgaccggcctggccgacgccgtgtggacccaggagcacgacgccatcctggagcacttcgcccaggaccccaccgagagcatcctgaccatcttcatcgacccctgcttcggcctgaagctggagctgggcatgcccgtgcagacccagaaccagctggtgtacttcatcagacaggcccccgtgcccatcacctgggagaacttcgaggccaccgtgcagttcggcaccgtgagaggcccctacatccccgccctgctgagactgctgggcggcgtgttcgccccccagatcttcgccaacaccggctggcccgagagcatcagaaaccacttcgccagccacctgcacaagttcctggcctgcctgaccgacaccagatacaagctggagggccacaccgtgctgtacatccccgccgaggccatgaacatgaagcccgagatggtgatcaaggacaaggagctggtgcagagactggagaccagcatgatccactggaccagacagatcaaggagatgctgagcgcccaggagaccgtggagaccggcgagaacctgggccccctggaggagatcgagttctggagaaacagatgcatggacctgagcggcatcagcaagcagctggtgaagaagggcgtgaagcacgtggagagcatcctgcacctggccaagagcagctacctggcccccttcatgaagctggcccagcagatccaggacggcagcagacaggcccagagcaacctgaccttcctgagcatcctgaaggagccctaccaggagctggccttcatgaagcccaaggacatcagcagcaagctgcccaagctgatcagcctgatcagaatcatctgggtgaacagcccccactacaacaccagagagagactgaccagcctgttcagaaaggtgtgcgactgccagtaccacttcgccagatgggaggacggcaagcagggccccctgccctgcttcttcggcgcccagggcccccagatcaccagaaacctgctggagatcgaggacatcttccacaagaacctgcacaccctgagagccgtgagaggcggcatcctggacgtgaagaacacctgctggcacgaggactacaacaagttcagagccggcatcaaggacctggaggtgatgacccagaacctgatcaccagcgccttcgagctggtgagagacgtgccccacggcgtgctgctgctggacaccttccacagactggccagcagagaggccatcaagagaacctacgacaagaaggccgtggacctgtacatgctgttcaacagcgagctggccctggtgaacagagagagaaacaagaagtggcccgacctggagccctacgtggcccagtacagcggcaaggccagatgggtgcacatcctgagaagaagaatcgacagagtgatgacctgcctggccggcgcccacttcctgcccagaatcggcaccggcaaggagagcgtgcacacctaccagcagatggtgcaggccatcgacgagctggtgagaaagaccttccaggagtggaccagcagcctggacaaggactgcatcagaagactggacacccccctgctgagaatcagccaggagaaggccggcatgctggacgtgaacttcgacaagagcctgctgatcctgttcgccgagatcgactactgggagagactgctgttcgagaccccccactacgtggtgaacgtggccgagagagccgaggacctgagaatcctgagagagaacctgctgctggtggccagagactacaacagaatcatcgccatgctgagccccgacgagcaggccctgttcaaggagagaatcagactgctggacaagaagatccaccccggcctgaagaagctgcactgggccctgaagggcgccagcgccttcttcatcaccgagtgcagaatccacgccagcaaggtgcagatgatcgtgaacgagttcaaggccagcaccctgaccatcggctggagagcccaggagatgagcgagaagctgctggtgagaatcagcggcaagagagtgtacagagacctggagttcgaggaggaccagagagagcacagagccgccgtgcagcagaagctgatgaacctgcaccaggacgtggtgaccatcatgaccaacagctacgaggtgttcaagaacgacggccccgagatccagcagcagtggatgctgtacatgatcagactggacagaatgatggaggacgccctgagactgaacgtgaagtggagcctgctggagctgagcaaggccatcaacggcgacggcaagaccagccccaaccccctgttccaggtgctggtgatcctgaagaacgacctgcagggcagcgtggcccaggtggagttcagccccaccctgcagaccctggccggcgtggtgaacgacatcggcaaccacctgttcagcaccatcagcgtgttctgccacctgcccgacatcctgaccaagagaaagctgcacagagagcccatccagaccgtggtggagcaggacgaggacatcaagaagatccagacccagatcagcagcggcatgaccaacaacgccagcctgctgcagaactacctgaagacctgggacatgtacagagagatctgggagatcaacaaggacagcttcatccacagataccagagactgaacccccccgtgagcagcttcgtggccgacatcgccagatacaccgaggtggccaacaacgtgcagaaggaggagaccgtgaccaacatccagttcgtgctgctggactgcagccacctgaagttcagcctggtgcagcactgcaacgagtggcagaacaagttcgccaccctgctgagagagatggccgccggcagactgctggagctgcacacctacctgaaggagaacgccgagaagatcagcagacccccccagaccctggaggagctgggcgtgagcctgcagctggtggacgccctgaagcacgacctggccaacgtggagacccagatcccccccatccacgagcagttcgccatcctggagaagtacgaggtgcccgtggaggacagcgtgctggagatgctggacagcctgaacggcgagtgggtggtgttccagcagaccctgctggacagcaagcagatgctgaagaagcacaaggagaagttcaagaccggcctgatccacagcgccgacgacttcaagaagaaggcccacaccctgctggaggacttcgagttcaagggccacttcaccagcaacgtgggctacatgagcgccctggaccagatcacccaggtgagagccatgctgatggccatgagagaggaggagaacagcctgagagccaacctgggcatcttcaagatcgagcagccccccagcaaggacctgcagaacctggagaaggagctggacgccctgcagcagatctgggagatcgccagagactgggaggagaactggaacgagtggaagaccggcagattcctgatcctgcagaccgagaccatggagaccaccgcccacggcctgttcagaagactgaccaagctggccaaggagtacaaggacagaaactgggagatcatcgagaccaccagaagcaagatcgagcagttcaagagaaccatgcccctgatcagcgacctgagaaaccccgccctgagagagagacactgggaccaggtgagagacgagatccagagagagttcgaccaggagagcgagagcttcaccctggagcagatcgtggagctgggcatggaccagcacgtggagaagatcggcgagatcagcgccagcgccaccaaggagctggccatcgaggtggccctgcagaacatcgccaagacctgggacgtgacccagctggacatcgtgccctacaaggacaagggccaccacagactgagaggcaccgaggaggtgttccaggccctggaggacaaccaggtggccctgagcaccatgaaggccagcagattcgtgaaggccttcgagaaggacgtggaccactgggagagatgcctgagcctgatcctggaggtgatcgagatgatcctgaccgtgcagagacagtggatgtacctggagaacatcttcctgggcgaggacatcagaaagcagctgcccaacgagagcaccctgttcgaccaggtgaacagcaactggaaggccatcatggacagaatgaacaaggacaacaacgccctgagaagcacccaccaccccggcctgctggacaccctgatcgagatgaacaccatcctggaggacatccagaagagcctggacatgtacctggagaccaagagacacatcttccccagattctacttcctgagcaacgacgacctgctggagatcctgggccagagcagaaaccccgaggccgtgcagccccacctgaagaagtgcttcgacaacatcaagctgctgagaatccagaaggtgggcggccccagcagcaagtgggaggccgtgggcatgttcagcggcgacggcgagtacatcgacttcctgcacagcgtgttcctggagggccccgtggagagctggctgggcgacgtggagcagaccatgagagtgaccctgagagacctgctgagaaactgccacctggccctgagaaagttcctgaacaagagagacaagtgggtgaaggagtgggccggccaggtggtgatcaccgccagccagatccagtggaccgccgacgtgaccaagtgcctgctgaccgccaaggagagagccgacaagaagatcctgaaggtgatgaagaagaaccaggtgagcatcctgaacaagtacagcgaggccatcagaggcaacctgaccaagatcatgagactgaagatcgtggccctggtgaccatcgagatccacgccagagacgtgctggagaagctgtacaagagcggcctgatggacgtgaacagcttcgactggctgagccagctgagattctactgggagaaggacctggacgactgcgtgatcagacagaccaacacccagttccagtacaactacgagtacctgggcaacagcggcagactggtgatcacccccctgaccgacagatgctacatgaccctgaccaccgccctgcacctgcacagaggcggcagccccaagggccccgccggcaccggcaagaccgagaccgtgaaggacctgggcaaggccctgggcatctacgtgatcgtggtgaactgcagcgagggcctggactacaagagcatgggcagaatgtacagcggcctggcccagaccggcgcctggggctgcttcgacgagttcaacagaatcaacatcgaggtgctgagcgtggtggcccaccagatcctgtgcatcctgagcgccctggccgccggcctgacccacttccacttcgacggcttcgagatcaacctggtgtggagctgcggcatcttcatcaccatgaaccccggctacgccggcagaaccgagctgcccgagaacctgaagagcatgttcagacccatcgccatggtggtgcccgacagcaccctgatcgccgagatcatcctgttcggcgagggcttcggcaactgcaagatcctggccaagaaggtgtacaccctgtacagcctggccgtgcagcagctgagcagacaggaccactacgacttcggcctgagagccctgaccagcctgctgagatacgccggcaagaagagaagactgcagcccgacctgaccgacgaggaggtgctgctgctgagcatgagagacatgaacatcgccaagctgaccagcgtggacgcccccctgttcaacgccatcgtgcaggacctgttccccaacatcgagctgcccgtgatcgactacggcaagctgagagagaccgtggagcaggagatcagagacatgggcctgcagagcacccccttcaccctgaccaaggtgttccagctgtacgagaccaagaacagcagacacagcaccatgatcgtgggctgcaccggcagcggcaagaccgccagctggagaatcctgcaggccagcctgagcagcctgtgcagagccggcgaccccaacttcaacatcgtgagagagttccccctgaaccccaaggccctgagcctgggcgagctgtacggcgagtacgacctgagcaccaacgagtggaccgacggcatcctgagcagcgtgatgagaaccgcctgcgccgacgagaagcccgacgagaagtggatcctgttcgacggccccgtggacaccctgtggatcgagaacatgaacagcgtgatggacgacaacaaggtgctgaccctgatcaacggcgagagaatcgccatgcccgagcaggtgagcctgctgttcgaggtggaggacctggccatggccagccccgccaccgtgagcagatgcggcatggtgtacaccgactacgccgacctgggctggaagccctacgtgcagagctggctggagaagagacccaaggccgaggtggagcccctgcagagaatgttcgagaagctgatcaacaagatgctggccttcaagaaggacaactgcaaggagctggtgcccctgcccgagtacagcggcatcaccagcctgtgcaagctgtacagcgccctggccacccccgagaacggcgtgaaccccgccgacggcgagaactacgtgaccatggtggagatgaccttcgtgttcagcatgatctggagcgtgtgcgccagcgtggacgaggagggcagaaagagaatcgacagctacctgagagagatcgagggcagcttccccaacaaggacaccgtgtacgagtacttcgtggaccccaagatcagaagctggaccagcttcgaggacaagctgcccaagagctggagatacccccccaacgcccccttctacaagatcatggtgcccaccgtggacaccgtgagatacaactacctggtgagcagcctggtggccaaccagaaccccatcctgctggtgggccccgtgggcaccggcaagaccagcatcgcccagagcgtgctgcagagcctgcccagcagccagtggagcgtgctggtggtgaacatgagcgcccagaccaccagcaacaacgtgcagagcatcatcgagagcagagtggagaagagaaccaagggcgtgtacgtgcccttcggcggcaagagcatgatcaccttcatggacgacctgaacatgcccgccaaggacatgttcggcagccagccccccctggagctgatcagactgtggatcgactacggcttctggtacgacagaaccaagcagaccatcaagtacatcagagagatgttcctgatggccgccatgggcccccccggcggcggcagaaccgtgatcagccccagactgagaagcagattcaacatcatcaacatgaccttccccaccaagagccagatcatcagaatcttcggcaccatgatcaaccagaagctgcaggacttcgaggaggaggtgaagcccatcggcaacgtggtgaccgaggccaccctggacatgtacaacaccgtggtgcagagattcctgcccacccccaccaagatgcactacctgttcaacctgagagacatcagcaaggtgttccagggcatgctgagagccaacaaggacttccacgacaccaagagcagcatcaccagactgtggatccacgagtgcttcagagtgttcagcgacagactggtggacgccgccgacaccgaggccttcatgggcatcatcagcgacaagctgggcagcttcttcgacctgaccttccaccacctgtgccccagcaagagaccccccatcttcggcgacttcctgaaggagcccaaggtgtacgaggacctgaccgacctgaccgtgctgaagaccgtgatggagaccgccctgaacgagtacaacctgagccccagcgtggtgcccatgcagctggtgctgttcagagaggccatcgagcacatcaccagaatcgtgagagtgatcggccagcccagaggcaacatgctgctggtgggcatcggcggcagcggcagacagagcctggccagactggccagcagcatctgcgactacaccaccttccagatcgaggtgaccaagcactacagaaagcaggagttcagagacgacatcaagagactgtacagacaggccggcgtggagctgaagaccaccagcttcatcttcgtggacacccagatcgccgacgagagcttcctggaggacatcaacaacatcctgagcagcggcgaggtgcccaacctgtacaagcccgacgagttcgaggagatccagagccacatcatcgaccaggccagagtggagcaggtgcccgagagcagcgacagcctgttcgcctacctgatcgagagagtgcagaacaacctgcacatcgtgctgtgcctgagccccatgggcgaccccttcagaaactggatcagacagtaccccgccctggtgaactgcaccaccatcaactggttcagcgagtggccccaggaggccctgctggaggtggccgagaagtgcctgatcggcgtggacctgggcacccaggagaacatccacagaaaggtggcccagatcttcgtgaccatgcactggagcgtggcccagtacagccagaagatgctgctggagctgagaagacacaactacgtgacccccaccaagtacctggagctgctgagcggctacaagaagctgctgggcgagaagagacaggagctgctggcccaggccaacaagctgagaaccggcctgttcaagatcgacgagaccagagagaaggtgcaggtgatgagcctggagctggaggacgccaagaagaaggtggccgagttccagaagcagtgcgaggagtacctggtgatcatcgtgcagcagaagagagaggccgacgagcagcagaaggccgtgaccgccaacagcgagaagatcgccgtggaggagatcaagtgccaggccctggccgacaacgcccagaaggacctggaggaggccctgcccgccctggaggaggccatgagagccctggagagcctgaacaagaaggacatcggcgagatcaagagctacggcagaccccccgcccaggtggagatcgtgatgcaggccgtgatgatcctgagaggcaacgagcccacctgggccgaggccaagagacagctgggcgagcagaacttcatcaagagcctgatcaacttcgacaaggacaacatcagcgacaaggtgctgaagaagatcggcgcctactgcgcccagcccgacttccagcccgacatcatcggcagagtgagcctggccgccaagagcctgtgcatgtgggtgagagccatggagctgtacggcagactgtacagagtggtggagcccaagagaatcagaatgaacgccgccctggcccagctgagagagaagcaggccgccctggccgaggcccaggagaagctgagagaggtggccgagaagctggagatgctgaagaagcagtacgacgagaagctggcccagaaggaggagctgagaaagaagagcgaggagatggagctgaagctggagagagccggcatgctggtgagcggcctggccggcgagaaggccagatgggaggagaccgtgcagggcctggaggaggacctgggctacctggtgggcgactgcctgctggccgccgccttcctgagctacatgggccccttcctgaccaactacagagacgagatcgtgaaccagatctggatcggcaagatctgggagctgcaggtgccctgcagccccagcttcgccatcgacaacttcctgtgcaaccccaccaaggtgagagactggaacatccagggcctgcccagcgacgccttcagcaccgagaacggcatcatcgtgaccagaggcaacagatgggccctgatgatcgacccccaggcccaggccctgaagtggatcaagaacatggagggcggccagggcctgaagatcatcgacctgcagatgagcgactacctgagaatcctggagcacgccatccacttcggctaccccgtgctgctgcagaacgtgcaggagtacctggaccccaccctgaaccccatgctgaacaagagcgtggccagaatcggcggcagactgctgatgagaatcggcgacaaggaggtggagtacaacaccaacttcagattctacatcaccaccaagctgagcaacccccactacagccccgagaccagcgccaagaccaccatcgtgaacttcgccgtgaaggagcagggcctggaggcccagctgctgggcatcgtggtgagaaaggagagacccgagctggaggagcagaaggacagcctggtgatcaacatcgccgccggcaagagaaagctgaaggagctggaggacgagatcctgagactgctgaacgaggccaccggcagcctgctggacgacgtgcagctggtgaacaccctgcacaccagcaagatcaccgccaccgaggtgaccgagcagctggagaccagcgagaccaccgagatcaacaccgacctggccagagaggcctacagaccctgcgcccagagagccagcatcctgttcttcgtgctgaacgacatgggctgcatcgaccccatgtaccagttcagcctggacgcctacatcagcctgttcatcctgagcatcgacaagagccacagaagcaacaagctggaggacagaatcgactacctgaacgactaccacacctacgccgtgtacagatacacctgcagaaccctgttcgagagacacaagctgctgttcagcttccacatgtgcgccaagatcctggagaccagcggcaagctgaacatggacgagtacaacttcttcctgagaggcggcgtggtgctggacagagagggccagatggacaacccctgcagcagctggctggccgacgcctactgggacaacatcaccgagctggacaagctgaccaacttccacggcctgatgaacagcttcgagcagtaccccagagactggcacctgtggtacaccaacgccgcccccgagaaggccatgctgcccggcgagtgggagaacgcctgcaacgagatgcagagaatgctgatcgtgagaagcctgagacaggacagagtggccttctgcgtgaccagcttcatcatcaccaacctgggcagcagattcatcgagccccccgtgctgaacatgaagagcgtgctggaggacagcacccccagaagccccctggtgttcatcctgagccccggcgtggaccccaccagcgccctgctgcagctggccgagcacatgggcatggcccagagattccacgccctgagcctgggccagggccaggcccccatcgccgccagactgctgagagagggcgtgacccagggccactgggtgttcctggccaactgccacctgagcctgagctggatgcccaacctggacaagctggtggagcagctgcaggtggaggacccccaccccagcttcagactgtggctgagcagcatcccccaccccgacttccccatcagcatcctgcaggtgagcatcaagatgaccaccgagccccccaagggcctgaaggccaacatgaccagactgtaccagctgatgagcgagccccagttcagcagatgcagcaagcccgccaagtacaagaagctgctgttcagcctgtgcttcttccacagcgtgctgctggagagaaagaagttcctgcagctgggctggaacatcatctacggcttcaacgacagcgacttcgaggtgagcgagaacctgctgagcctgtacctggacgagtacgaggagaccccctgggacgccctgaagtacctgatcgccggcatcaactacggcggccacgtgaccgacgactgggacagaagactgctgaccacctacatcaacgactacttctgcgaccagagcctgagcacccccttccacagactgagcgccctggagacctacttcatccccaaggacggcagcctggccagctacaaggagtacatcagcctgctgcccggcatggacccccccgaggccttcggccagcaccccaacgccgacgtggccagccagatcaccgaggcccagaccctgttcgacaccctgctgagcctgcagccccagatcacccccaccagagccggcggccagaccagagaggagaaggtgctggagctggccgccgacgtgaagcagaagatccccgagatgatcgactacgagggcacccagaagctgctggccctggaccccagccccctgaacgtggtgctgctgcaggagatccagagatacaacaccctgatgcagaccatcctgttcagcctgaccgacctggagaagggcatccagggcctgatcgtgatgagcaccagcctggaggagatcttcaactgcatcttcgacgcccacgtgccccccctgtggggcaaggcctaccccagccagaagcccctggccgcctggaccagagacctggccatgagagtggagcagttcgagctgtgggccagcagagccagaccccccgtgatcttctggctgagcggcttcaccttccccaccggcttcctgaccgccgtgctgcagagcagcgccagacagaacaacgtgagcgtggacagcctgagctgggagttcatcgtgagcaccgtggacgacagcaacctggtgtacccccccaaggacggcgtgtgggtgagaggcctgtacctggagggcgccggctgggacagaaagaacagctgcctggtggaggccgagcccatgcagctggtgtgcctgatgcccaccatccacttcagacccgccgagagcagaaagaagagcgccaagggcatgtacagctgcccctgctactactaccccaacagagccggcagcagcgacagagccagcttcgtgatcggcatcgacctgagaagcggcgccatgacccccgaccactggatcaagagaggcaccgccctgctgatgagcctggacagctag

SEQ ID NO: 79825 - DNA, 1782 bp, Artificial Sequence
  Description of Artificial Sequence: Synthetic coding sequence
atggagatcgtgtacgtgtacgtgaagaagagaagcgagttcggcaagcagtgcaacttcagcgacagacaggccgagctgaacatcgacatcatgcccaaccccgagctggccgagcagttcgtggagagaaaccccgtggacaccggcatccagtgcagcatcagcatgagcgagcacgaggccaacagcgagagattcgagatggagaccagaggcgtgaaccacgtggagggcggctggcccaaggacgtgaaccccctggagctggagcagaccatcagattcagaaagaaggtggagaaggacgagaactacgtgaacgccatcatgcagctgggcagcatcatggagcactgcatcaagcagaacaacgccatcgacatctacgaggagtacttcaacgacgaggaggccatggaggtgatggaggaggaccccagcgccaagaccatcaacgtgttcagagacccccaggagatcaagagagccgccacccacctgagctggcaccccgacggcaacagaaagctggccgtggcctacagctgcctggacttccagagagcccccgtgggcatgagcagcgacagctacatctgggacctggagaaccccaacaagcccgagctggccctgaagcccagcagccccctggtgaccctggagttcaaccccaaggacagccacgtgctgctgggcggctgctacaacggccagatcgcctgctgggacaccagaaagggcagcctggtggccgagctgagcaccatcgagagcagccacagagaccccgtgtacggcaccatctggctgcagagcaagaccggcaccgagtgcttcagcgccagcaccgacggccaggtgatgtggtgggacatcagaaagatgagcgagcccaccgaggtggtgatcctggacatcaccaagaaggagcagctggagaacgccctgggcgccatcagcctggagttcgagagcaccctgcccaccaagttcatggtgggcaccgagcagggcatcgtgatcagctgcaacagaaaggccaagaccagcgccgagaagatcgtgtgcaccttccccggccaccacggccccatctacgccctgcagagaaaccccttctaccccaagaacttcctgaccgtgggcgactggaccgccagaatctggagcgaggacagcagagagagcagcatcatgtggaccaagtaccacatggcctacctgaccgacgccgcctggagccccgtgagacccaccgtgttcttcaccaccagaatggacggcaccctggacatctgggacttcatgttcgagcagtgcgaccccaccctgagcctgaaggacaacggctgcctgatcgcctgcggcagccagctgggcaccaccaccctgctggaggtgagccccggcctgagcaccctgcagagaaacgagaagaacgtggccagcagcatgttcgagagagagaccagaagagagaagatcctggaggccagacacagagagatgagactgaaggagaagggcaaggccgagggcagagacgaggagcagaccgacgaggagctggccgtggacctggaggccctggtgagcaaggccgaggaggagttcttcgacatcatcttcgccgagctgaagaagaaggaggccgacgccatcaagctgacccccgtgccccagcagcccagccccgaggaggaccaggtggtggaggagggcgaggaggccgccggcgaggagggcgacgaggaggtggaggaggacctggcctag

SEQ ID NO: 79826 - DNA, 2676 bp, Artificial Sequence
  Description of Artificial Sequence: Synthetic coding sequence
gagaaggacaacggcctggacgtgttcaagctgagcgacagagacttcctgagaagcatggagaacgccatcagattcggcaagccctgcctgctggagaacgtgggcgaggagctggaccccgccctggagcccgtgctgctgaagcagacctacaagcagcagggcaacaccgtgctgaagctgggcgacaccgtgatcccctaccacgaggacttcagaatgtacatcaccaccaagctgcccaacccccactacacccccgagatcagcaccaagctgaccctgatcaacttcaccctgagccccagcggcctggaggaccagctgctgggccaggtggtggccgaggagagacccgacctggaggaggccaagaaccagctgatcatcagcaacgccaagatgagacaggagctgaaggacatcgaggaccagatcctgtacagactgagcagcagcgagggcaaccccgtggacgacatggagctgatcaaggtgctggaggccagcaagatgaaggccgccgagatccaggccaaggtgagaatcgccgagcagaccgagaaggacatcgacctgaccagaatggagtacatccccgtggccatcagaacccagatcctgttcttctgcgtgagcgacctggccaacgtggaccccatgtaccagtacagcctggagtggttcctgaacatcttcctgagcggcatcgccaacagcgagagagccgacaacctgaagaagagaatcagcaacatcaacagatacctgacctacagcctgtacagcaacgtgtgcagaagcctgttcgagaagcacaagctgatgttcgccttcctgctgtgcgtgagaatcatgatgaacgagggcaagatcaaccagagcgagtggagatacctgctgagcggcggcagcatcagcatcatgaccgagaaccccgcccccgactggctgagcgacagagcctggagagacatcctggccctgagcaacctgcccaccttcagcagcttcagcagcgacttcgtgaagcacctgagcgagttcagagtgatcttcgacagcctggagccccacagagagcccctgcccggcatctgggaccagtacctggaccagttccagaagctgctggtgctgagatgcctgagaggcgacaaggtgaccaacgccatgcaggacttcgtggccaccaacctggagcccagattcatcgagccccagaccgccaacctgagcgtggtgttcaaggacagcaacagcaccacccccctgatcttcgtgctgagccccggcaccgaccccgccgccgacctgtacaagttcgccgaggagatgaagttcagcaagaagctgagcgccatcagcctgggccagggccagggccccagagccgaggccatgatgagaagcagcatcgagagaggcaagtgggtgttcttccagaactgccacctggcccccagctggatgcccgccctggagagactgatcgagcacatcaaccccgacaaggtgcacagagacttcagactgtggctgaccagcctgcccagcaacaagttccccgtgagcatcctgcagaacggcagcaagatgaccatcgagccccccagaggcgtgagagccaacctgctgaagagctacagcagcctgggcgaggacttcctgaacagctgccacaaggtgatggagttcaagagcctgctgctgagcctgtgcctgttccacggcaacgccctggagagacacaagttcggccccctgggcttcaacatcccctacgagttcaccgacggcgacctgagaatctgcatcagccagctgaagatgttcctggacgagtacgacgacatcccctacaaggtgctgaagtacaccgccggcgagatcaactacggcggcagagtgaccgacgactgggacagaagatgcatcatgaacatcctggaggacttctacaaccccgacgtgctgagccccgagcacagctacagcgccagcggcatctaccaccagatcccccccacctacgacctgcacggctacctgagctacatcaagagcctgcccctgaacgacatgcccgagatcttcggcctgcacgacaacgccaacatcaccttcgcccagaacgagaccttcgccctgctgggcaccatcatccagctgcagcccaagagcagcagcgccggcagccagggcagagaggagatcgtggaggacgtgacccagaacatcctgctgaaggtgcccgagcccatcaacctgcagtgggtgatggccaagtaccccgtgctgtacgaggagagcatgaacaccgtgctggtgcaggaggtgatcagatacaacagactgctgcaggtgatcacccagaccctgcaggacctgctgaaggccctgaagggcctggtggtgatgagcagccagctggagctgatggccgccagcctgtacaacaacaccgtgcccgagctgtggagcgccaaggcctaccccagcctgaagcccctgagcagctgggtgatggacctgctgcagagactggacttcctgcaggcctggatccaggacggcatccccgccgtgttctggatcagcggcttcttcttcccccaggccttcaacagacacagcgccgagttctgcccccagatctgccacctgcactag

SEQ ID NO: 79827 - DNA, 12798 bp, Artificial Sequence
  Description of Artificial Sequence: Synthetic coding sequence
atggagcagcccaacagcaagggctacagcctgggcagaaccccccagggccccgagtgcagcagcgcccccgccgtgcaggtgggcacccacagaggcctggagtacaaccccggcaagatcctgcccggcagcgactacggcctgggcaacccccccgccctggaccccaagctgccccacctgcccctgccccccgccccccccaccctgagcgacctgggccagcccagaaagagccccctgaccggcaccgacaagaagtaccccctgatgaagcagagaggcttctacagcgacatcctgagccccggcaccctggaccagctgggcgaggtgtgcagaggccccagaatgagccagaacctgctgagacaggccgacctggacaagttcacccccagagtgggcagcttcgaggtgcccgaggacttccaggagagaatggagcagcagtgcatcggcagcaccaccagactgctggcccagaccgacttccccctgcaggcctacgagcccaagatgcaggtgcccttccaggtgctgcccggccagcaccccagaaagatcgagatcgagagaagaaagcagcagtacctgagcctggacatcgagcagctgctgttcagccagggcatcgacagcaacaagctgatgcccagacacctggaccaccagcacccccagaccatcgagcagggccacgaccccatcttccccatctacctgcccctgaaggtgttcgacaacgaggacttcgactgcagaacccccagagagtggatcaacatgggcctggagcccggcagcctggacagaaagcccgtgcccggcaaggccctgctgcccaccgacgacttcctgggccacgaggaccccaagagccagaagctgaagtacaagtggtgcgaggtgggcgtgctggactacgacgaggagaagaagctgtacctggtgcacaagaccgacgagaagggcctggtgagagacgagatgggcagacccatcctgaacgccggcgtgaccaccgagggcagaccccccctgcaggtgtgccagtactgggtgcccagaatccagctgctgttctgcgccgaggacccctgcatgttcgcccagagagtggtgcaggccaacgccctgagaaagaacaccgaggccctgctgctgtacaacctgtacgtggactgcatgcccagcgacggccagcacgtgatcagcgagcagagcctgagcaagatcaagcagtgggccctgagcacccccagaatgagaaagggccccagcgtgctggagcacctgagcagcctggccagagaggtgagcctggactacgagagaagcatgaacaagatcaacttcgaccacgtggtgagcagcaagcccgagaccttcagctacgtgaccctgcccaagaaggaggaggagcaggtgcccgagagaggcctggtgagcgtgcccaagtaccacttctgggagcagaaggaggacttcaccttcgtgagcctgctgaccagacccgaggtgatcaccgccctgagcaaggtgagagccgagtgcaacaaggtgaccgccatgagcctgttccacagcagcctgagcaagtacagccacctggaggagttcgagcagatccagagccagaccttcagccaggtgcagatgttcctgaaggacagctggatcagcagcctgaaggtggccatgagaagcagcctgagagacatgagcaagggctggtacaacctgtacgagaccaactgggaggtgtacctgatgagcaagctgagaaagctgatggagctggtgaagtacatgctgcaggacaccctgagattcctggtgcaggacagcctggccagcttcagccagttcatcagcgacacctgctgcagcgtgctgaactgcaccgacgacatggtgtggggcgacgacctgatcaacagcccctacagacccagaaagaaccccctgttcatcatggacctggtgctggacagcagcggcgtgcactacagcacccccctggagcagttcgaggccagcctgctgaacctgttcgacaagggcatcctggccacccacgccgtgccccagctggagaagctggtgatggaggacatcttcatcagcggcgaccccctgctggagagcgtgggcctgcacgagcccctggtggaggagctgagagccaccatcgccagcgccgtgagcaaggccatgatccccctgcaggcctacgccaaggagtacagaaagtacctggagctgaacaacaacgacatcgccagcttcctgaagacctaccagacccagggcctgctggcccaggaggtgagagaggtggtgctgacccacctgagagagaaggagatcctggacagcagcctgcccagcagcatcatcatcggccccttctacatcaacaccgacaacgtgaagcagagcctgagcaagaagagaaaggccctggccaccagcgtgctggacatcctggccaagaacctgcacaaggaggtggacagcatctgcgaggagttcagaagcatcagcagaaagatctacgagaagcccaacagcatcgaggagctggccgagctgagagagtggatgaagggcatccccgagagactggtgggcctggaggagagaatcgtgaaggtgatggacgactaccaggtgatggacgagttcctgtacaacctgagcagcgacgacttcaacgacaagtggatcgccagcaactggcccagcaagatcctgggccagatcgagctggtgcagcagcagcacgtggaggacgaggagaagttcagaaagatccagatcatggaccagaacaacttccaggagaagctggagggcctgcagctggtggtggccggcttcagcatccacgtggagatcagcagagcccacgagatcgccaacgaggtgagaagagtgaagaagcagctgaaggactgccagcagctggccatgctgtacaacaacagagagagaatcttcagcctgcccatcaccaactacgacaagctgagcagaatggtgaaggagttccagccctacctggacctgtggaccaccgccagcgactggctgagatggagcgagagctggatgaacgaccccctgagcgccatcgacgccgagcagctggagaagaacgtggtggaggccttcaagaccatgcacaagtgcgtgaagcagttcaaggacatgcccgcctgccaggaggtggccctggacatcagagccagaatcgaggagttcaagccctacatccccctgatccagggcctgagaaaccccggcatgagaatcagacactgggagaccctgagcaaccagatcaacatcaacgtgagacccaaggccaacctgaccttcgccagatgcctggagatgaacctgcaggaccacatcgagagcatcagcaaggtggccgaggtggccggcaaggagtacgccatcgagcaggccctggacaagatggagaaggagtggagcaccatcctgttcaacgtgctgccctacaaggccaccgacacctacatcctgaagagccccgacgaggccagccagctgctggacgaccacatcgtgatgacccagaacatgagcttcagcccctacaagaagcccttcgagcagagaatcaacagctgggagaacaagctgaagctgacccaggaggtgctggaggagtggctgaactgccagagaagctggctgtacctggagcccatcttcagcagcgaggacatcaaccagcagctgcccgtggagagcaagagataccagaccatggagagaatctggaagaagatcatgaagaacgcctacgagaacagagaggtgatcaacgtgtgcagcgacctgagaatgctggacagcctgagagactgcaacaagatcctggacctggtgcagaagggcctgagcgagtacctggagaccaagagaagcgccttccccagattctacttcctgagcgacgacgagctgctggagatcctgagccagaccaaggaccccaccgccgtgcagccccacctgagaaagtgcttcgagaacatcgccagactgctgttccaggaggacctggagatcacccacatgtacagcgccgagggcgaggaggtgcagctgtgcttcagcatctaccccagcagcaacgtggaggactggctgagagaggtggagagaagcatgaaggccagcgtgcacgacatcatcgagaaggccatcagagcctaccccaccatgcccagaacccagtgggtgctgaactggcccggccaggtgaccatcgccggctgccagacctactggaccatggaggtggccgaggccctggaggccggcaacctgagaagccagctgttcccccagctgtgccagcagctgagcgacctggtggccctggtgagaggcaagctgagcagaatgcagagagccgtgctgagcgccctgatcgtgatcgaggtgcacgccaaggacgtggtgagcaagctgatccaggagaacgtggtgagcgtgaacgacttccagtggatcagccagctgagatactactggaccaacaacgacctgtacatcagagccgtgaacgccgagttcatctacggctacgagtacctgggcaacagcggcagactggtgatcacccccctgaccgacagatgctacctgaccctgaccggcgccctgcacctgaagttcggcggcgcccccgccggccccgccggcaccggcaagaccgagaccaccaaggacctgggcaaggccctggccatccagaccgtggtgttcaactgcagcgaccagctggacttcatggccatgggcaagttcttcaagggcctggccagcgccggcgcctgggcctgcttcgacgagttcaacagaatcgacatcgaggtgctgagcgtggtggcccagcagatcaccaccatccagaaggcccagcagcagagagtggagagattcatgttcgagggcgtggagatccccctggtgcccagctgcgccgtgttcatcaccatgaaccccggctacgccggcagaaccgagctgcccgacaacctgaaggccctgttcagacccgtggccatgatggtgcccgactacgccatgatcaccgagatcagcctgtacagcttcggcttcaacgaggccagcgtgctggccaagaagatcaccaccaccttcaagctgagcagcgagcagctgagcagccaggaccactacgacttcggcatgagagccgtgaagaccgtgatcagcgccgccggcaacctgaagagagagaaccccagcatgaacgaggagctgatctgcctgagagccatcagagacgtgaacgtgcccaagttcctgcaggaggacctgaagctgttcagcggcatcgtgagcgacctgttccccaccatcaaggaggaggacaccgactacggcatcctggacgaggccatcagagaggcctgcagaaacagcaacctgaaggacgtggagggcttcctgaccaagtgcatccagctgtacgagaccaccgtggtgagacacggcctgatgctggtgggccccaccggcagcggcaagagcacctgctacagagtgctggccgccgccatgaccagcctgaagggccagcccagcatcagcggcggcatgtacgaggccgtgaactactacgtgctgaaccccaagagcatcaccatgggccagctgtacggcgagttcgacctgctgacccacgagtggaccgacggcatcttcagcagcttcatcagagccggcgccatcaccagcgacaccaacaagaagtggtacatgttcgacggccccgtggacgccatctggatcgagaacatgaacaccgtgctggacgacaacaagaagctgtgcctgagcagcggcgagatcatcaagctgaccgaggccatgaccatgatgttcgaggtgcaggacctggccgtggccagccccgccaccgtgagcagatgcggcatggtgtacctggagcccagcatcctgggcctgatgcccttcatcgagtgctggctgagaaagctgccccccctgctgaagccctacgaggagcacttcaaggccctgttcgtgagcttcctggaggagagcatcagcttcgtgagaagcagcgtgaaggaggtgatcgccagcaccaactgcaacctgaccatgagcctgctgaagctgctggactgcttcttcaagcccttcctgcccagagagggcctgaagaagatccccagcgagaagctgagcagaatcgtggagctgatcgagccctggttcatcttcagcctgatctggagcgtgggcgccaccggcgacagcagcggcagaaccagcttcagccactggctgagactgaagatggagaacgagcagctgaccctgctgttccccgaggagggcctggtgttcgactacagactggaggacgccggcatcagcggcaccaacgacagcgaggacgaggaggaggagtacaagcaggtggcctgggtgaagtggatggacagcagcgcccccttcaccatggtgcccgacaccaactactgcaacatcatcgtgcccaccatggacaccgtgcagatgagccacctgctggacatgctgctgaccaacaagaagcccgtgctgtgcatcggccccaccggcaccggcaagaccctgaccatcagcgacaagctgctgaagaacctggccctggactacatcagccacttcctgaccttcagcgccagaaccagcgccaaccagacccaggacttcatcgacagcaagctggacaagagaagaaagggcgtgttcggcccccccctgggcagaaacttcatcttcttcatcgacgacctgaacatgcccgccctggagacctacggcgcccagccccccatcgagctgctgagacagtggatggaccacggcggctggtacgacagaaagatcatcggcgccttcaagaacctggtggacatcaacttcgtgtgcgccatgggcccccccggcggcggcagaaacaccgtgacccccagactgatgagacacttcaactacctgagcttcgccgagatggacgaggtgagcaagaagagaatcttcagcaccatcctgggcaactggctggacggcctgctgggcgagaagagctacagagagagagtgcccggcgccccccacatcgcccacttcaccgagcccctggtggaggccaccatcatggtgtacgccaccatcaccagccagctgctgcccacccccgccaagagccactacaccttcaacctgagagacctgagcaaggtgttccagggcatgctgatggccgaccccgccaaggtggaggaccaggtgcagctgctgagactgtggtaccacgagaactgcagagtgttcagagacagactggtgaacgaggaggacagaagctggttcgaccagctgctgaagagatgcatggagcagtgggaggtgaccttcaacaaggtgtgccccttccagcccatcctgtacggcgacttcatgagccccggcagcgacgtgaagagctacgagctgatcaccagcgagagcaagatgatgcaggtgatcgaggagtacatcgaggactacaaccagatcaacaccgccaagctgaagctggtgctgttcatggacgccatgagccacatctgcagaatcagcagaaccctgagacaggccctgggcaacgccctgctgctgggcgtgggcggcagcggcagaagcagcctgaccagactggccagccacatggccgagtacgagtgcttccagatcgagctgagcaagaactacggcatgagcgagtggagagacgacgtgaagaaggtgctgctgaaggccggcctgcagaacctgcccatcaccttcctgttcagcgacacccagatcaagaacgagagcttcctggaggacatcaacaacgtgctgaacagcggcgacatccccaacctgtacaccgccgacgagcaggaccagatcgtgagcaccatgagaccctacatccaggagcagggcctgcagcccaccaaggccaacctgatggccgcctacaccggcagagtgagaagcaacatccacatggtgctgtgcatgagccccatcggcgaggtgttcagagccagactgagacagttccccagcctggtgaactgctgcaccatcgactggttcaacgagtggcccgccgaggccctgaagagcgtggccaccgtgttcctgaacgagatccccgagctggagagcagccaggaggagatccagggcctgatccaggtgtgcgtgtacatccaccagagcgtgagcaagaagtgcatcgagtacctggccgagctgaccagacacaactacgtgacccccaagagctacctggagctgctgcacatcttcagcatcctgatcggccagaagaagctggagctgaagaccgccaagaacagaatgaagagcggcctggacaagctgctgagaaccagcgaggacgtggccaagatgcaggaggacctggagagcatgcaccccctgctggaggaggccgccaaggacaccatgctgaccatggagcagatcaaggtggacaccgccatcgccgaggagaccagaaacagcgtgcagaccgaggagatcaaggccaacgagaaggccaagaaggcccaggccatcgccgacgacgcccagaaggacctggacgaggccctgcccgccctggacgccgccctggccagcctgagaaacctgaacaagaacgacgtgaccgaggtgagagccatgcagagacccccccccggcgtgaagctggtgatcgaggccgtgtgcatcatgaagggcatcaagcccaagaaggtgcccggcgagaagcccggcaccaaggtggacgactactgggagcccggcaagggcctgctgcaggaccccggccacttcctggagagcctgttcaagttcgacaaggacaacatcggcgacgtggtgatcaaggccatccagccctacatcgacaacgaggagttccagcccgccaccatcgccaaggtgagcaaggcctgcaccagcatctgccagtgggtgagagccatgcacaagtaccacttcgtggccaaggccgtggagcccaagagacaggccctgctggaggcccaggacgacctgggcgtgacccagagaatcctggacgaggccaagcagagactgagagaggtggaggacggcatcgccaccatgcaggccaagtacagagagtgcatcaccaagaaggaggagctggagctgaagtgcgagcagtgcgagcagagactgggcagagccggcaagctgatcaacggcctgagcgacgagaaggtgagatggcaggagaccgtggagaacctgcagtacatgctgaacaacatcagcggcgacgtgctggtggccgccggcttcgtggcctacctgggccccttcaccggccagtacagaaccgtgctgtacgacagctgggtgaagcagctgagaagccacaacgtgccccacaccagcgagcccaccctgatcggcaccctgggcaaccccgtgaagatcagaagctggcagatcgccggcctgcccaacgacaccctgagcgtggagaacggcgtgatcaaccagttcagccagagatggacccacttcatcgacccccagagccaggccaacaagtggatcaagaacatggagaaggacaacggcctggacgtgttcaagctgagcgacagagacttcctgagaagcatggagaacgccatcagattcggcaagccctgcctgctggagaacgtgggcgaggagctggaccccgccctggagcccgtgctgctgaagcagacctacaagcagcagggcaacaccgtgctgaagctgggcgacaccgtgatcccctaccacgaggacttcagaatgtacatcaccaccaagctgcccaacccccactacacccccgagatcagcaccaagctgaccctgatcaacttcaccctgagccccagcggcctggaggaccagctgctgggccaggtggtggccgaggagagacccgacctggaggaggccaagaaccagctgatcatcagcaacgccaagatgagacaggagctgaaggacatcgaggaccagatcctgtacagactgagcagcagcgagggcaaccccgtggacgacatggagctgatcaaggtgctggaggccagcaagatgaaggccgccgagatccaggccaaggtgagaatcgccgagcagaccgagaaggacatcgacctgaccagaatggagtacatccccgtggccatcagaacccagatcctgttcttctgcgtgagcgacctggccaacgtggaccccatgtaccagtacagcctggagtggttcctgaacatcttcctgagcggcatcgccaacagcgagagagccgacaacctgaagaagagaatcagcaacatcaacagatacctgacctacagcctgtacagcaacgtgtgcagaagcctgttcgagaagcacaagctgatgttcgccttcctgctgtgcgtgagaatcatgatgaacgagggcaagatcaaccagagcgagtggagatacctgctgagcggcggcagcatcagcatcatgaccgagaaccccgcccccgactggctgagcgacagagcctggagagacatcctggccctgagcaacctgcccaccttcagcagcttcagcagcgacttcgtgaagcacctgagcgagttcagagtgatcttcgacagcctggagccccacagagagcccctgcccggcatctgggaccagtacctggaccagttccagaagctgctggtgctgagatgcctgagaggcgacaaggtgaccaacgccatgcaggacttcgtggccaccaacctggagcccagattcatcgagccccagaccgccaacctgagcgtggtgttcaaggacagcaacagcaccacccccctgatcttcgtgctgagccccggcaccgaccccgccgccgacctgtacaagttcgccgaggagatgaagttcagcaagaagctgagcgccatcagcctgggccagggccagggccccagagccgaggccatgatgagaagcagcatcgagagaggcaagtgggtgttcttccagaactgccacctggcccccagctggatgcccgccctggagagactgatcgagcacatcaaccccgacaaggtgcacagagacttcagactgtggctgaccagcctgcccagcaacaagttccccgtgagcatcctgcagaacggcagcaagatgaccatcgagccccccagaggcgtgagagccaacctgctgaagagctacagcagcctgggcgaggacttcctgaacagctgccacaaggtgatggagttcaagagcctgctgctgagcctgtgcctgttccacggcaacgccctggagagacacaagttcggccccctgggcttcaacatcccctacgagttcaccgacggcgacctgagaatctgcatcagccagctgaagatgttcctggacgagtacgacgacatcccctacaaggtgctgaagtacaccgccggcgagatcaactacggcggcagagtgaccgacgactgggacagaagatgcatcatgaacatcctggaggacttctacaaccccgacgtgctgagccccgagcacagctacagcgccagcggcatctaccaccagatcccccccacctacgacctgcacggctacctgagctacatcaagagcctgcccctgaacgacatgcccgagatcttcggcctgcacgacaacgccaacatcaccttcgcccagaacgagaccttcgccctgctgggcaccatcatccagctgcagcccaagagcagcagcgccggcagccagggcagagaggagatcgtggaggacgtgacccagaacatcctgctgaaggtgcccgagcccatcaacctgcagtgggtgatggccaagtaccccgtgctgtacgaggagagcatgaacaccgtgctggtgcaggaggtgatcagatacaacagactgctgcaggtgatcacccagaccctgcaggacctgctgaaggccctgaagggcctggtggtgatgagcagccagctggagctgatggccgccagcctgtacaacaacaccgtgcccgagctgtggagcgccaaggcctaccccagcctgaagcccctgagcagctgggtgatggacctgctgcagagactggacttcctgcaggcctggatccaggacggcatccccgccgtgttctggatcagcggcttcttcttcccccaggccttcctgaccggcaccctgcagaacttcgccagaaagttcgtgatcagcatcgacaccatcagcttcgacttcaaggtgatgttcgaggcccccagcgagctgacccagagaccccaggtgggctgctacatccacggcctgttcctggagggcgccagatgggaccccgaggccttccagctggccgagagccagcccaaggagctgtacaccgagatggccgtgatctggctgctgcccacccccaacagaaaggcccaggaccaggacttctacctgtgccccatctacaagaccctgaccagagccggcaccctgagcaccaccggccacagcaccaactacgtgatcgccgtggagatccccacccaccagccccagagacactggatcaagagaggcgtggccctgatctgcgccctggactactag

SEQ ID NO: 79828 - DNA, 13416 bp, Artificial Sequence
  Description of Artificial Sequence: Synthetic coding sequence
atggtgcccgaggaggtggaggtggagatcgacgagatccccgtgctgagcgaggagggcgaggaggaggaggagacctacagccagaaggtggagagcgtggacaaggtgagagccaagagagtgagcctgagaaccgagagcctgggccagcccctgaacagagaggacgaggagatggacaaggagatcagcgagaagctgcccagcaagagaaccgccaagcacatcatggagaagatgcacctgcacatgctgtgcacccccctgcccgaggagttcctggaccagaacgtggtgttcttcctgagaaacaccaaggaggccatcagcgaggccaccgacatgaaggaggccatggagatcatgcccgagaccctggagtacggcatcatcaacgccaacgtgctgcacttcctgaagaacatcatctgccaggtgttcctgcccgccctgagcttcaaccagcacagaaccagcaccaccgtgggcgtgaccagcggcgaggtgagcaacagcagcgagcacgagagcgacctgccccccatgcccggcgaggccgtggagtaccacagcatccagctgatcagagacgagttcctgatgaacgtgcagaagttcgccagcaacatccagagaaccatgcagcagctggagggcgagatcaagctggagatgcccatcatcagcgtggagggcgaggtgagcgacctggccgccgaccccgagaccgtggacatcctggagcagtgcgtgatcaactggctgaaccagatcagcaccgccgtggaggcccagctgaagaagaccccccagggcaagggccccctggccgagatcgagttctggagagagagaaacgccaccctgagcgccctgcacgagcagaccaagctgcccatcgtgagaaaggtgctggacgtgatcaaggagagcgacagcatgctggtggccaacctgcagcccgtgttcaccgagctgttcaagttccacaccgaggccagcgacaacgtgagattcctgagcaccgtggagagatacttcaagaacatcacccacggcagcggcttccacgtggtgctggacaccatccccgccatgatgagcgccctgagaatggtgtggatcatcagcagacactacaacaaggacgagagaatgatccccctgatggagagaatcgcctgggagatcgccgagagagtgtgcagagtggtgaacctgagaaccctgttcaaggagaacagagccagcgcccagagcaagaccctggaggccagaaacaccctgagactgtggaagaaggcctacttcgacaccagagccaagatcgaggccagcggcagagaggacagatgggagttcgacagaaagagactgttcgagagaaccgactacatggccaccatctgccaggacctgagcgacgtgctgcagatcctggaggagttctacaacatcttcggccccgagctgaaggccgtgaccggcgaccccaagagaatcgacgacgtgctgtgcagagtggacggcctggtgacccccatggagaacctgaccttcgaccccttcagcatcaagagcagccagttctggaagtacgtgatggacgagttcaagatcgaggtgctgatcgacatcatcaacaagatcttcgtgcagaacctggagaacccccccctgtacaagaaccacccccccgtggccggcgccatctactgggagagaagcctgttcttcagaatcaagcacaccatcctgagattccaggaggtgcaggagatcctggacagcgacagaggccaggaggtgaagcagaagtacctggaggtgggcagaaccatgaaggagtacgaggacagaaagtacgagcagtggatggaggtgaccgagcaggtgctgcccgccctgatgaagaagagcctgctgaccaagagcagcatcgccaccgaggagcccagcaccctggagagaggcgccgtgttcgccatcaacttcagccccgccctgagagagatcatcaacgagaccaagtacctggagcagctgggcttcaccgtgcccgagctggccagaaacgtggccctgcaggaggacaagttcctgagatacaccgccggcatccagagaatgctggaccactaccacatgctgatcggcaccctgaacgacgccgagagcgtgctgctgaaggaccacagccaggagctgctgagagtgttcagaagcggctacaagagactgaactggaacagcctgggcatcggcgactacatcaccggctgcaagcaggccatcggcaagttcgagagcctggtgcaccagatccacaagaacgccgacgacatcagcagcagactgaccctgatcgaggccatcaacctgttcaagtaccccgccgccaagagcgaggaggagctgcccggcgtgaaggagttcttcgagcacatcgagagagagagagccagcgacgtggaccacatggtgagatggtacctggccatcggccccctgctgaccaaggtggagggcctggtggtgcacaccaacaccggcaaggcccccaagctggccagctactacaagtactgggagaagaagatctacgaggtgctgaccaagctgatcctgaagaacctgcagagcttcaacagcctgatcctgggcaacgtgcccctgttccacaccgagaccatcctgaccgcccccgagatcatcctgcaccccaacaccaacgagatcgacaagatgtgcttccactgcgtgagaaactgcgtggagatcaccaagcacttcgtgagatggatgaacggcagctgcatcgagtgccccccccagaagggcgaggaggaggaggtggtgatcatcaacttctacaacgacatcagcctgaacccccagatcatcgagcaggccgtgatgatcccccagaacgtgcacagaatcctgatcaacctgatgaagtacctgcagaagtggaagagatacagacccctgtggaagctggacaaggccatcgtgatggagaagttcgccgccaagaagcccccctgcgtggcctacgacgagaagctgcagttctacagcaagatcgcctacgaggtgatgagacaccccctgatcaaggacgagcactgcatcagactgcagctgagacacctggccaacaccgtgcaggagaacgccaagagctgggtgatcagcctgggcaagctgctgaacgagagcgccaaggaggagctgtacaacctgcacgaggagatggagcacctggccaagaacctgagaaagatccccaacaccctggaggacctgaagttcgtgctggccaccatcgccgagatcagaagcaagagcctggtgatggagctgagatacagagacgtgcaggagagatacagaaccatggccatgtacaacctgttcccccccgacgccgagaaggagctggtggacaagatcgagagcatctggagcaacctgttcaacgacagcgtgaacgtggagcacgccctgggcgacatcaagagaaccttcaccgagctgaccagaggcgagatcatgaactacagagtgcagatcgaggagttcgccaagagattctacagcgagggccccggcagcgtgggcgacgacctggacaagggcgtggagctgctgggcgtgtacgagagagagctggccagacacgagaagagcagacaggagctggccaacgccgagaagctgttcgacctgcccatcaccatgtaccccgagctgctgaaggtgcagaaggagatgagcggcctgagaatgatctacgagctgtacgagggcctgaaggtggccaaggaggagtggagccagaccctgtggatcaacctgaacgtgcagatcctgcaggagggcatcgagggcttcctgagagccctgagaaagctgcccagacccgtgagaggcctgagcgtgacctactacctggaggccaagatgaaggccttcaaggacagcatccccctgctgctggacctgaagaacgaggccctgagagacagacactggaaggagctgatggagaagaccagcgtgttcttcgagatgaccgagaccttcaccctggagaacatgttcgccatggagctgcacaagcacaccgacgtgctgaacgagatcgtgaccgccgccatcaaggaggtggccatcgagaaggccgtgaaggagatcctggacacctgggagaacatgaagttcaccgtggtgaagtactgcaagggcacccaggagagaggctacatcctgggcagcgtggacgagatcatccagagcctggacgacaacaccttcaacctgcagagcatcagcggcagcagattcgtgggccccttcctgcagaccgtgcacaagtgggagaagaccctgagcctgatcggcgaggtgatcgagatctggatgctggtgcagagaaagtggatgtacctggagagcatcttcatcggcggcgacatcagaagccagctgcccgaggaggccaagaagttcgacaacatcgacaaggtgttcaagagaatcatgggcgagaccctgaaggaccccgtgatcaagagatgctgcgaggcccccaacagactgagcgacctgcagaacgtgagcgagggcctggagaagtgccagaagagcctgaacgactacctggacagcaagagaaacgccttccccagattcttcttcatcagcgacgacgagctgctgagcatcctgggcagcagcgaccccctgtgcgtgcaggagcacatgatcaagatgtacgacaacatcgccagcctgagattcaacgacggcgacagcggcgagaagctggtgagcgccatgatcagcgccgagggcgaggtgatggagttcagaaagatcctgagagccgagggcagagtggaggactggatgaccgccgtgctgaacgagatgagaagaaccaacagactgatcaccaaggaggccatcttcagatactgcgaggacagaagcagagtggactggatgctgctgtaccagggcatggtggtgctggccgccagccaggtgtggtggacctgggaggtggaggacgtgttccacaaggcccagaagggcgagaagcaggccatgaagaactacggcagaaagatgcacagacagatcgacgagctggtgaccagaatcaccatgcccctgagcaagaacgacagaaagaagtacaacaccgtgctgatcatcgacgtgcacgccagagacatcgtggacagcttcatcagaggcagcatcctggaggccagagagttcgactgggagagccagctgagattctactgggacagagagcccgacgagctgaacatcagacagtgcaccggcaccttcggctacggctacgagtacatgggcctgaacggcagactggtgatcacccccctgaccgacagaatctacctgaccctgacccaggccctgagcatgtacctgggcggcgcccccgccggccccgccggcaccggcaagaccgagaccaccaaggacctggccaaggccctgggcctgctgtgcgtggtgaccaactgcggcgagggcatggactacagagccgtgggcaagatcttcagcggcctggcccagtgcggcgcctggggctgcttcgacgagttcaacagaatcgacgccagcgtgctgagcgtgatcagcagccagatccagaccatcagaaacgccctgatccaccagctgaccaccttccagttcgagggccaggagatcagcctggacagcagaatgggcatcttcatcaccatgaaccccggctacgccggcagaaccgagctgcccgagagcgtgaaggccctgttcagacccgtggtggtgatcgtgcccgacctgcagcagatctgcgagatcatgctgttcagcgagggcttcctggaggccaagaccctggccaagaagatgaccgtgctgtacaagctggccagagagcagctgagcaagcagtaccactacgacttcggcctgagagccctgaagagcgtgctggtgatggccggcgagctgaagagaggcagcagcgacctgagagaggacgtggtgctgatgagagccctgagagacatgaacctgcccaagttcgtgttcgaggacgtgcccctgttcctgggcctgatcagcgacctgttccccggcctggactgccccagagtgagataccccgacttcaacgacgccgtggagcaggtgctggaggagaacggctacgccgtgctgcccatccaggtggacaaggtggtgcagatgttcgagaccatgctgaccagacacaccaccatggtggtgggccccaccagaggcggcaagagcgtggtgatcaacaccctgtgccaggcccagaccaagctgggcctgaccaccaagctgtacatcctgaaccccaaggccgtgagcgtgatcgagctgtacggcatcctggaccccaccaccagagactggaccgacggcgtgctgagcaacatcttcagagagatcaacaagcccaccgacaagaaggagagaaagtacatcctgttcgacggcgacgtggacgccctgtgggtggagaacatgaacagcgtgatggacgacaacagactgctgaccctggccaacggcgagagaatcagactgcaggcccactgcgccctgctgttcgaggtgggcgacctgcagtacgccagccccgccaccgtgagcagatgcggcatggtgtacgtggaccccaagaacctgaagtacagaccctactggaagaagtgggtgaaccagatccccaacaaggtggagcagtacaacctgaacagcctgttcgagaagtacgtgccctacctgatggacgtgatcgtggagggcatcgtggacggcagacaggccgagaagctgaagaccatcgtgccccagaccgacctgaacatggtgacccagctggccaagatgctggacgccctgctggagggcgagatcgaggacctggacctgctggagtgctacttcctggaggccctgtactgcagcctgggcgccagcctgctggaggacggcagaatgaagttcgacgagtacatcaagagactggccagcctgagcaccgtggacaccgagggcgtgtgggccaaccccggcgagctgcccggccagctgcccaccctgtacgacttccacttcgacaacaagagaaaccagtgggtgccctggagcaagctggtgcccgagtacatccacgcccccgagagaaagttcatcaacatcctggtgcacaccgtggacaccaccagaaccacctggatcctggagcagatggtgaagatcaagcagcccgtgatcttcgtgggcgagagcggcaccagcaagaccgccaccacccagaacttcctgaagaacctgagcgaggagaccaacatcgtgctgatggtgaacttcagcagcagaaccaccagcatggacatccagagaaacctggaggccaacgtggagaagagaaccaaggacacctacggcccccccatgggcaagagactgctggtgttcatggacgacatgaacatgcccagagtggacgagtacggcacccagcagcccatcgccctgctgaagctgctgctggagaagggctacctgtacgacagaggcaaggagctgaactgcaagagcatcagagacctgggcttcatcgccgccatgggcaaggccggcggcggcagaaacgaggtggaccccagattcatcagcctgttcagcgtgttcaacgtgcccttccccagcgaggagagcctgcacctgatctacagcagcatcctgaagggccacaccagcaccttccacgagagcatcgtggccgtgagcggcaagctgaccttctgcaccctggccctgtacaagaacatcgtgcaggacctgccccccacccccagcaagttccactacatcttcaacctgagagacctgagcagagtgttcaacggcctggtgctgaccaaccccgagagattccagaccgtggcccagatggtgagagtgtggagaaacgagtgcctgagagtgttccacgacagactgatcagcgagaccgacaagcagctggtgcagcagcacatcggcagcctggtggtggagcacttcaaggacgacgtggaggtggtgatgagagaccccatcctgttcggcgacttccagatggccctgcacgagggcgagcccagaatctacgaggacatccaggactacgaggccgccaaggccctgttccaggagatcctggaggagtacaacgagagcaacaccaagatgaacctggtgctgttcgacgacgccctggagcacctgaccagagtgcacagaatcatcagaatggacagaggccacgccctgctggtgggcgtgggcggcagcggcaagcagagcctgagcagactggccgccttcaccgccagctgcgaggtgttcgagatcctgctgagcagaggctacagcgagaacagcttcagagaggacctgaagagcctgtacctgaagctgggcatcgagaacaaggccatgatcttcctgttcaccgacgcccacgtggccgaggagggcttcctggagctgatcaacaacatgctgaccagcggcatcgtgcccgccctgttcagcgaggaggagaaggagagcatcctgagccagatcggccaggaggccctgaagcagggcatgggccccgccaaggagagcgtgtggcagtacttcgtgaacaagagcgccaacaacctgcacatcgtgctgggcatgagccccgtgggcgacaccctgagaacctggtgcagaaacttccccggcatggtgaacaacaccggcatcgactggttcatgccctggcccccccaggccctgcacgccgtggccaagagcttcctgggctacaaccccatgatccccgccgagaacatcgagaacgtggtgaagcacgtggtgctggtgcaccagagcgtggaccactacagccagcagttcctgcagaagctgagaagaagcaactacgtgacccccaagaactacctggacttcatcaacacctacagcaagctgctggacgagaagacccagtgcaacatcgcccagtgcaagagactggacggcggcctggacaagctgaaggaggccaccatccagctggacgagctgaaccagaagctggccgagcagaagatcgtgctggccgagaagagcgccgcctgcgaggccctgctggaggagatcgccgtgaacaccgccgtggccgaggagaagaagaagctggccgaggagaaggccatggagatcgaggagcagaacaaggtgatcgccatggagaaggccgaggccgagaccaccctggccgaggtgatgcccatcctggaggccgccaagctggagctgcagaagctggacaagagcgacgtgaccgagatcagaagcttcgccaagccccccaagcaggtgcagaccgtgtgcgagtgcatcctgatcatgaagggctacaaggagctgaactggaagaccgccaagggcgtgatgagcgaccccaacttcctgagaagcctgatggagatcgacttcgacagcatcacccagagccaggtgaagaacatcaagggcctgctgaagaccctgaacaccaccaccgaggagatggaggccgtgagcaaggccggcctgggcatgctgaagttcgtggaggccgtgatgggctactgcgacgtgttcagagagatcaagcccaagagagagaaggtggccagactggagagaaacttctacctgaccaagagagagctggagagaatccagaacgagctggccgccatccagaaggagctggagaccctgggcgccaagtacgaggccgccatcctggagaagcagaagctgcaggaggaggccgagatcatggagagaagactgatcgccgccgacaagctgatcagcggcctgggcagcgagaacatcagatggctgaacgacctggacgagctgatgcacagaagagtgaagctgctgggcgactgcctgctgtgcgccgccttcctgagctacgagggcgccttcacctgggagttcagagacgagatggtgaacagaatctggcagaacgacatcctggagagagagatccccctgagccagcccttcagactggagagcctgctgaccgacgacgtggagatcagcagatggggcagccagggcctgccccccgacgagctgagcgtgcagaacggcatcctgaccaccagagccagcagattccccctgtgcatcgacccccagcagcaggccctgaactggatcaagagaaaggaggagaagaacaacctgagagtggccagcttcaacgaccccgacttcctgaagcagctggagatgagcatcaagtacggcacccccttcctgttcagagacgtggacgagtacatcgaccccgtgatcgacaacgtgctggagaagaacatcaaggtgagccagggcagacagttcatcatcctgggcgacaaggaggtggactacgacagcaacttcagactgtacctgaacaccaagctggccaaccccagatacagccccagcgtgttcggcaaggccatggtgatcaactacaccgtgaccctgaagggcctggaggaccagctgctgagcgtgctggtggcctacgagagaagagagctggaggagcagagagagcacctgatccaggagaccagcgagaacaagaacctgctgaaggacctggaggacagcctgctgagagagctggccaccagcaccggcaacatgctggacaacgtggacctggtgcacaccctggaggagaccaagagcaaggccaccgaggtgagcgagaagctgaagctggccgagaagaccgccctggacatcgacagactgagagacggctacagacccgccgccagaagaggcgccatcctgttcttcgtgctgagcgagatggccctggtgaacagcatgtaccagtacagcctgatcgccttcctggaggtgttcagactgagcctgaagaagagcctgcccgacagcatcctgatgaagagactgagaaacatcatggacaccctgaccttcagcatctacaaccacggctgcaccggcctgttcgagagacacaagctgctgttcagcttcaacatgaccatcaagatcgagcaggccgagggcagagtgccccaggaggagctggacttcttcctgaagggcaacatcagcctggagaagagcaagagaaagaagccctgcgcctggctgagcgaccagggctgggaggacatcatcctgctgagcgagatgttcagcgacaacttcggccagctgcccgacgacgtggagaacaaccagaccgtgtggcaggagtggtacgacctggacagcctggagcagttccccgtgcccctgggctacgacaacaacatcacccccttccagaagctgctgatcctgagatgcttcagagtggacagagtgtacagagccgtgaccgactacgtgaccgtgaccatgggcgagaagtacgtgcagccccccatgatcagcttcgaggccatcttcgagcagagcaccccccacagccccatcgtgttcatcctgagccccggcagcgaccccgccaccgacctgatgaagctggccgagagaagcggcttcggcggcaacagactgaagttcctggccatgggccagggccaggagaaggtggccctgcagctgctggagaccgccgtggccagaggccagtggctgatgctgcagaactgccacctgctggtgaagtggctgaaggacctggagaagagcctggagagaatcaccaagccccaccccgacttcagactgtggctgaccaccgaccccaccaagggcttccccatcggcatcctgcagaagagcctgaaggtggtgaccgagccccccaacggcctgaagctgaacatgagagccacctacttcaagatcagccacgagatgctggaccagtgcccccaccccgccttcaagcccctggtgtacgtgctggccttcttccacgccgtggtgcaggagagaagaaagttcggcaagatcggctggaacgtgtactacgacttcaacgagagcgacttccaggtgtgcatggagatcctgaacacctacctgaccaaggccttccagcagagagaccccagaatcccctggggcagcctgaagtacctgatcggcgaggtgatgtacggcggcagagccatcgacagcttcgacagaagaatcctgaccatctacatggacgagtacctgggcgacttcatcttcgacaccttccagcccttccacttcttcagaaacaaggaggtggactacaagatccccgtgggcgacgagaaggagaagttcgtggaggccatcgaggccctgcccctggccaacacccccgaggtgttcggcctgcaccccaacgccgagatcggctactacacccaggccgccagagacatgtgggcccacctgctggagctgcagccccagaccggcgagagcagcagcggcatcagcagagacgactacatcggccaggtggccaaggagatcgagaacaagatgcccaaggtgttcgacctggaccaggtgagaaagagactgggcaccggcctgagccccaccagcgtggtgctgctgcaggagctggagagattcaacaagctggtggtgagaatgaccaagagcctggccgagctgcagagagccctggccggcgaggtgggcatgagcaacgagctggacgacgtggccagaagcctgttcatcggccacatccccaacatctggagaagactggcccccgacaccctgaagagcctgggcaactggatggtgtacttcctgagaagattcagccagtacatgctgtgggtgaccgagagcgagcccagcgtgatgtggctgagcggcctgcacatccccgagagctacctgaccgccctggtgcaggccacctgcagaaagaacggctggcccctggacagaagcaccctgttcacccaggtgaccaagttccaggacgccgacgaggtgaacgagagagccggccagggctgcttcgtgagcggcctgtacctggagggcgccgactgggacatcgagaagggctgcctgatcaagagcaagcccaaggtgctggtggtggacctgcccatcctgaagatcatccccatcgaggcccacagactgaagctgcagaacaccttcagaacccccgtgtacaccaccagcatgagaagaaacgccatgggcgtgggcctggtgttcgaggccgacctgttcaccaccagacacatcagccactgggtgctgcagggcgtgtgcctgaccctgaacagcgactag

SEQ ID NO: 79829 - DNA, 13572 bp, Artificial Sequence
  Description of Artificial Sequence: Synthetic coding sequence
atggccgcccaggtggccgccagagaggccagagacttcagagaggcccccaccctgagactgaccagcggcgccggcctggaggccgtgggcgccgtggagctggaggaggaggaggagaacgaggaggaggccgccgccagaagagccagaagcttcgcccaggacgccagagtgagattcctgggcggcagactggccatgatgctgggcttcaccgaggagaagtggagccagtacctggagagcgaggacaacagacaggtgctgggcgagttcctggagagcaccagccccgcctgcctggtgttcagcttcgccgccagcggcagactggccgccagccaggagatccccagagacgccaaccacaagctggtgttcatcagcaagaagatcaccgagagcatcggcgtgaacgacttcagccaggtggtgctgttcggcgagctgcccgccctgagcctgggccacgtgagcgccttcctggacgagatcctggtgcccgtgctgagcaacaagaacaaccacaagagctggagctgcttcaccagccaggacatggagtaccacatcgaggtgatgaagaagaagatgtacatcttcagaggcaagatgagcagaagaaccctgctgcccatccccaccgtggccggcaagatggacctggaccagaactgcagcgagaacaagccccccagcaacgagagaatcatcctgcacgccatcgagagcgtggtgatcgagtggagccaccagatccaggagatcatcgagagagacagcgtgcagagactgctgaacggcctgcacctgagcccccaggccgagctggacttctggatgatgagaagagagaacctgagctgcatctacgaccagctgcaggcccccgtggtgctgaagatggtgaagatcctgaccaccaagcagagcagctacttccccaccctgaaggacatcttcctggccgtggagaacgccctgctggaggcccaggacgtggagctgtacctgagacccctgagaagacacatccagtgcctgcaggagaccgagttcccccagaccagaatcctgatcgcccccctgttccacaccatctgcctgatctggagccacagcaagttctacaacacccccgccagagtgatcgtgctgctgcaggagttctgcaacctgttcatcaaccaggccaccgcctacctgagccccgaggacctgctgagaggcgagatcgaggagagcctggagaaggtgcaggtggccgtgaacatcctgaagaccttcaagaacagcttcttcaactacagaaagaagctggccagctacttcatgggcagaaagctgagaccctgggacttccagagccacctggtgttctgcagattcgacaagttcctggacagactgatcaagatcgaggacatcttcgccaccaccctggagttcgagaagctggagagactggagttcggcggcaccaagggcgccatcctgaacggccaggtgcacgagatgagcgaggagctgatggagctgtgcaagctgttcaagcagagcacctacgaccccagcgactgcaccaacatggagttcgagagcgactacgtggccttcaagagcaagaccctggagttcgacagaagactgggcaccatcatctgcgaggccttcttcaactgcaacggcctggaggccgccttcaagctgctgaccatcttcggcaacttcctggagaagcccgtggtgatggagatcttcagcctgcactacagcaccctggtgcacatgttcaacaccgagctggacgtgtgcaagcagctgtacaacgagcacatgaagcagatcgagtgcggccacgtggtgctgaacaagaacatgcccttcaccagcggcaacatgaagtgggcccagcaggtgctgcagagactgcagatgttctggagcaacttcgccagcctgagatacctgttcctgggcaaccccgaccacgccctggtgtaccagaagtacgtggagatgaccaccctgctggaccagttcgagagcagaatctacaacgagtggaagagcaacgtggacgagatctgcgagttcaacctgaaccagcccctggtgaagttcagcgccatcaacggcctgctgtgcgtgaacttcgaccccaagctggtggccgtgctgagagaggtgaagtacctgctgatgctgaagaagcaggacatccccgacagcgccctggccatcttcaagaagagaaacaccatcctgaagtacatcggcaacctggacctgctggtgcagggctacaacaagctgaagcagaccctgctggaggtggagtaccccctgatcgaggacgagctgagagccatcgacgagcagctgaccgccgccaccacctggctgacctggcaggacgactgctggggctacatcgagagagtgagagccgccaccagcgagctggagcacagagtggagagaacccagaagaacgtgaaggtgatccagcagaccatgagaggctgggccagatgcgtgctgccccccagaagagagcacagaagagaggccgccttcaccctggaggacaagggcgacctgttcaccaagaagtacaagctgatccagggcgacggctgcaagatccacaacctggtggaggagaacagaaagctgttcaaggccaaccccagcctggacacctggaagatctacgtggagttcatcgacgacatcgtggtggagggcttcttccaggccatcatgcacgacctggacttcttcctgaagaacaccgagaagcagctgaagcccgcccccttcttccaggcccagatgatcctgctgccccccgagatcgtgttcaagcccagcctggacagagaggccggcgacggcttctacgacctggtggaggagatgctgtgcaacagcttcagaatgagcgcccagatgaacagaatcgccacccacctggagatcaagaactaccagaacgacatggacaacatgctgggcctggccgaggtgagacaggagatcatgaacagagtggtgaacgtgatcaacaaggtgctggacttcagaaacaccctggagacccacacctacctgtgggtggacgacagagccgagttcatgaagcacttcctgctgtacggccacgccgtgagcagcgacgagatggacgcccacgccaacgaggagatccccgagcagccccccaccctggagcagttcaaggagcagatcgacatctacgaggccctgtacgtgcagatgagcaagttcgaggacttcagagtgttcgacagctggttcaaggtggacatgaagcccttcaaggtgagcctgctgaccatcatcaagaagtggagctggatgttccaggagcacctgctgagattcgtgatcgacagcctgaacgagctgcaggagttcatcaaggagaccgacagcggcctgcagagagagctgaacgagggcgaccacgacggcctggtggacatcatggtgcacctgctggccgtgagaagcagacagagagccaccgacgagctgttcgagcccctgaaggagaccatcaccctgctggagagctacggccagaagatgcccgagcaggtgtacatccagctggaggagctgcccgagagatgggagaccaccaagaagatcgccgccaccgtgagacacgaggtgagccccctgcacaacgccgaggtgaccctgatcagaaagaagtgcatcctgttcgacgccaagcaggccgagttcagagagagattcagacactacgcccccctgggcttcaacgccgagaacccctacaccgccctggacaaggccaacgaggagctggaggccctggaggaggagatgctgcagatgcaggagagcaccagactgttcgaggtggccctgcccgagtacaagcagatgaagcagtgcagaaaggagatcaagctgctgaagggcctgtgggacgtgatcatctacgtgagaagaagcatcgacaactggaccaagacccagtggagacagatccacgtggagcagatggacgtggagctgagaagattcgccaaggccagcagcatcaccgagatctggagcctgaacaaggaggtgagagtgtgggacgcctacaccggcctggagggcaccgtgaaggacatgaccgccagcctgagagccatcaccgagctgcagagccccgccctgagagacagacactggcaccagctgatgaaggccatcggcgtgaagttcctgatcaacgaggccaccaccctggccgacctgctggccctgagactgcacagagtggaggacgacgtgagaagaatcgtggacaaggccgtgaaggagctgggcaccgagaaggtgatcaccgagatcagccagacctgggccaccatgaagttcagctacgaggtgcactacagaaccggcatccccctgctgaagagcgacgagcagctgttcgagaccctggagcacaaccaggtgcagctgcagaccctgctgcagagcaagtacgtggagtacttcatcgagcaggtgctgagctggcagaacaagctgaacatcgccgacctggtgatcttcacctggatggaggtgcagagaacctggagccacctggagagcatcttcgtgtgcagcgaggacatcagaatccagctggtgaaggacgccagaagattcgacggcgtggacgccgagttcaaggagctgatgttcaagaccgccaaggtggagaacgtgctggaggccacctgcagacccaacctgtacgagaagctgaaggacctgcagagcagactgagcctgtgcgagaaggccctggccgagtacctggagaccaagagaatcgccttccccagattctacttcgtgagcagcgccgacctgctggacatcctgagcaagggcgcccagcccaagcaggtgacctgccacctggccaagctgttcgacagcatcgccgacctgcagttcgaggacaaccaggacgtgagcgcccacagagccgtgggcatgtacagcaaggagaaggagtacgtgcccttccaggccgagtgcgagtgcgtgggccacgtggagacctggctgctgcagctggagcagaccatgcaggagaccgtgagacacagcatcaccgaggccatcgtggcctacgaggagaagcccagagagctgtggatcttcgacttccccgcccaggtggccctgaccagcagccagatctggtggaccaccgacgtgggcatcgccttcagcagactggaggagggctacgagaccgccctgaaggacttccacaagaagcagatcagccagctgaacaccctgatcaccctgctgctgggcgagctgccccccggcgacagacagaagatcatgaccatctgcaccatcgacgtgcacgccagagacgtggtggccaagctgatcagccagaagcaggtggtggtgagcccccaggccttcacctggctgagccagctgagacacagatgggaggacacccagaagcactgcttcgtgaacatctgcgacgcccagttccagtacttctacgagtacctgggcaacagccccagactggtgatcacccccctgaccgacagatgctacatcaccctgacccagagcctgcacctgaccatgagcggcgcccccgccggccccgccggcaccggcaagaccgagaccaccaaggacctgggcagagccctgggcatgatggtgtacgtgttcaactgcagcgagcagatggactacaagagcatcggcaacatctacaagggcctggtgcagaccggcgcctggggctgcttcgacgagttcaacagaatcagcgtggaggtgctgagcgtggtggccgtgcaggtgaagatgatccacgacgccatcagaaacagaaagaagagattcgtgttcctgggcgaggccatcaccctgaagcccagcgtgggcatcttcatcaccatgaaccccggctacgccggcagaaccgagctgcccgagaacctgaaggccctgttcagaccctgcgccatggtggcccccgacatcgagctgatctgcgagatcctgctggtggccgagggcttcgtggacgccagagccctggccagaaagttcatcaccctgtacaccctgtgcaaggagctgctgagcaagcaggaccactacgactggggcctgagagccatcaagagcgtgctggtggtggccggcagcctgaagagaggcgacaagaacagacccgaggaccaggtgctgatgagagccctgagagacttcaacatgcccaagatcgtgaccgacgacatccccgtgttcctgggcctggtgggcgacctgttccccgccctggacgtgcccagaagaagaaagctgcacttcgagcagatggtgagacagagcaccctggagctgagactgcagcccgaggagagcttcatcctgaaggtggtgcagctggaggagctgctggccgtgagacacagcgtgttcgtggtgggcaacgccggcaccggcaagagcaagatcctgagaaccctgaacagaacctacgtgaacatgaagcagaagcccgtgtggaacgacctgaaccccaaggccgtgaccaccgacgagctgttcggcttcatccaccacgccaccagagagtggaaggacggcaagatcgtgtacagctacttcatcggcctgttcagcagcatcctgagagagcaggccaacctgaagcacgacggccccaagtggatcgtgctggacggcgacatcgaccccatgtggatcgagagcctgaacaccgtgatggacgacaacaaggtgctgaccctggccagcaacgagagaatcgccctgacccccttcatgagactgctgttcgagatccaccacctgagaagcgccacccccgccaccgtgagcagagccggcatcctgtacgtgaacccccaggacctgggctggaacccctacgtggccagctggatcgacagaagaagacaccagagcgagaaggccaacctgaccatcctgttcgacaagtacgtgcccgcctgcctggacaagctgagaaccagcttcaagaccatcaccagcatccccgagagcagcctggtgcagaccctgtgcgtgctgctggagtgcctgctgacccccgagaacgtgcccagcgacagccccaaggaggtgtacgaggtgtacttcgtgttcgcctgcatctgggccttcggcggcaccctgctgcaggaccagatcagcgactaccaggccgacttcagcagatggtggcagaaggagatgaaggccgtgaagttccccagccagggcaccatcttcgactactacgtggaccacaagaccaagaagctgctgccctgggccgacaagatcgcccagttcaccatggaccccgacgtgcccctgcagaccgtgctggtgcacaccaccgagaccgccagactgagatacttcatggagctgctgctggagaagggcaagcccctgatgctggtgggcaacgccggcgtgggcaagaccgtgttcgtgggcgacaccctggccagcctgagcgaggactacatcgtgagcagagtgcccttcaactactacaccaccagcaccgccctgcagaagatcctggagaagcccctggagaagaaggccggccacaactacggccccggcggcaacaagaagctgatctacttcatcgacgacatgaacatgcccgaggtggacctgtacggcaccgtgcagccccacaccctgatcagacagcacatcgactacggccactggtacgacagacagaaggtgatgctgaaggagatccacaactgccagtacgtggcctgcatgaaccccatggtgggcagcttcaccatcaaccccagactgcagagacacttcaccgtgttcgccttcaacttccccagcctggacgccctgaacaccatctacggccagatcttcagcttccacttccagcagcaggccttcgcccccagcatcctgagaagcggccccaccctgatccaggccaccatcgccttccaccagaccatgatgtgcaacttcctgcccaccgccatcaagttccactacatcttcaacctgagagacctgagcaacgtgttccagggcatcctgttcgccagccccgagtgcctgaagggccccctggacctgatccacctgtggctgcacgagagcgccagagtgtacggcgacaagctgatcgacaagaaggactgcgacctgttccagagaagaatgctggagaccgcctacaagtacttcgagggcatcgacagccacatgctgctgcagcagcccctgatctactgccacttcgccgacagaggcaaggacccccactacatgcccgtgaaggactgggaggtgctgaagaccatcctgaccgagaccctggacaactacaacgagctgaacgccgccatgcacctggtgctgttcgaggacgccatgcagcacgtgtgcagaatcagcagaatcctgagaaccccccagggctgcgccctgctggtgggcgtgggcggcagcggcaagcagagcctgagcagactggccgcctacctgagaggcctggaggtgttccagatcaccctgaccgagggctacggcatccaggagctgagagtggacctggccaacctgtacatcagaaccggcgccaagaacatgcccaccgtgttcctgctgaccgacgcccaggtgctggacgagagcttcctggtgctgatcaacgacctgctggccagcggcgagatccccgacctgttcagcgacgaggacgtggacaagatcatcagcggcatccacaacgaggtgcacgccctgggcatggtggacagcagagagaactgctggaagttcttcatggccagagtgagactgcagctgaagatcatcctgtgcttcagccccgtgggcagaaccctgagagtgagagccagaaagttccccgccatcgtgaactgcaccgccatcgactggttccacgcctggccccaggaggccctggtgagcgtgagcagaagattcatcgaggagaccaagggcatcgagcccgtgcacaaggacagcatcagcctgttcatggcccacgtgcacaccaccgtgaacgagatgagcaccagatactaccagaacgagagaagacacaactacaccacccccaagagcttcctggagcagatcagcctgttcaagaacctgctgaagaagaagcagaacgaggtgagcgagaagaaggagagactggtgaacggcatccagaagctgaagaccaccgccagccaggtgggcgacctgaaggccagactggccagccaggaggccgagctgcagctgagaaaccacgacgccgaggccctgatcaccaagatcggcctgcagaccgagaaggtgagcagagagaagaccatcgccgacgccgaggagagaaaggtgaccgccatccagaccgaggtgttccagaagcagagagagtgcgaggccgacctgctgaaggccgagcccgccctggtggccgccaccgccgccctgaacaccctgaacagagtgaacctgagcgagctgaaggccttccccaacccccccatcgccgtgaccaacgtgaccgccgccgtgatggtgctgctggcccccagaggcagagtgcccaaggacagaagctggaaggccgccaaggtgttcatgggcaaggtggacgacttcctgcaggccctgatcaactacgacaaggagcacatccccgagaactgcctgaaggtggtgaacgagcactacctgaaggaccccgagttcaaccccaacctgatcagaaccaagagcttcgccgccgccggcctgtgcgcctgggtgatcaacatcatcaagttctacgaggtgtactgcgacgtggagcccaagagacaggccctggcccaggccaacctggagctggccgccgccaccgagaagctggaggccatcagaaagaagctggtggacctggacagaaacctgagcagactgaccgccagcttcgagaaggccaccgccgagaaggtgagatgccaggaggaggtgaaccagaccaacaagaccatcaagctggccaacagactggtgaaggagctggaggccaagaagatcagatggggccagagcatcaagagcttcgaggcccaggagaagaccctgtgcggcgacgtgctgctgaccgccgccttcgtgagctacgtgggccccttcaccagacagtacagacaggagctggtgcactgcaagtgggtgcccttcctgcagcagaaggtgagcatccccctgaccgagggcctggacctgatcagcatgctgaccgacgacgccaccatcgccgcctggaacaacgagggcctgcccagcgacagaatgagcaccgagaacgccgccatcctgacccactgcgagagatggcccctggtgatcgacccccagcagcagggcatcaagtggatcaagaacaagtacggcatggacctgaaggtgacccacctgggccagaagggcttcctgaacgccatcgagaccgccctggccttcggcgacgtgatcctgatcgagaacctggaggagaccatcgaccccgtgctggaccccctgctgggcagaaacaccatcaagaagggcaagtacatcagaatcggcgacaaggagtgcgagttcaacaagaacttcagactgatcctgcacaccaagctggccaacccccactacaagcccgagctgcaggcccagaccaccctgctgaacttcaccgtgaccgaggacggcctggaggcccagctgctggccgaggtggtgagcatcgagagacccgacctggagaagctgaagctggtgctgaccaagcaccagaacgacttcaagatcgagctgaagtacctggaggacgacctgctgctgagactgagcgccgccgagggcagcttcctggacgacaccaagctggtggagagactggaggccaccaagaccaccgtggccgagatcgagcacaaggtgatcgaggccaaggagaacgagagaaagatcaacgaggccagagagtgctacagacccgtggccgccagagccagcctgctgtacttcgtgatcaacgacctgcagaagatcaaccccctgtaccagttcagcctgaaggccttcaacgtgctgttccacagagccatcgagcaggccgacaaggtggaggacatgcagggcagaatcagcatcctgatggagagcatcacccacgccgtgttcctgtacaccagccaggccctgttcgagaaggacaagctgaccttcctgagccagatggccttccagatcctgctgagaaagaaggagatcgaccccctggagctggacttcctgctgagattcaccgtggagcacacccacctgagccccgtggacttcctgaccagccagagctggagcgccatcaaggccatcgccgtgatggaggagttcagaggcatcgacagagacgtggagggcagcgccaagcagtggagaaagtgggtggagagcgagtgccccgagaaggagaagctgccccaggagtggaagaagaagagcctgatccagaagctgatcctgctgagagccatgagacccgacagaatgacctacgccctgagaaacttcgtggaggagaagctgggcgccaagtacgtggagagaaccagactggacctggtgaaggccttcgaggagagcagccccgccacccccatcttcttcatcctgagccccggcgtggacgccctgaaggacctggagatcctgggcaagagactgggcttcaccatcgacagcggcaagttccacaacgtgagcctgggccagggccaggagaccgtggccgaggtggccctggagaaggccagcaagggcggccactgggtgatcctgcagaacgtgcacctggtggccaagtggctgggcaccctggagaagctgctggagagattcagccagggcagccacagagactacagagtgttcatgagcgccgagagcgcccccacccccgacgagcacatcatcccccagggcctgctggagaacagcatcaagatcaccaacgagccccccaccggcatgctggccaacctgcacgccgccctgtacaacttcgaccaggacaccctggagatctgcagcaaggagcaggagttcaagagcatcctgttcagcctgtgctacttccacgcctgcgtggccggcagactgagattcggcccccagggctggagcagaagctaccccttcaaccccggcgacctgaccatctgcgccagcgtgctgtacaactacctggaggccaacagcaaggtgccctgggaggacctgagatacctgttcggcgagatcatgtacggcggccacatcaccgacgactgggacagaaagctgtgcagagtgtacctggaggagttcatgaaccccagcctgaccgaggacgagctgatgctggcccccggcttcgccgcccccccctacctggactacgccggctaccaccagtacatcgaggagatgctgccccccgagagccccgccctgtacggcctgcaccccaacgccgagatcgagttcctgaccgtgaccagcaacaccctgttcagaaccctgctggagatgcagcccagaaacgccctgagcggcgacgagctgggccagagcaccgaggagaaggtgaagaacgtgctggacgacatcctggagaagctgcccgaggagttcaacatggccgagatcatgcagaagaacagcaacagaagcccctacgtgctggtgtgcttccaggagtgcgagagaatgaacatcctgatcagagagatcagaatcagcctggagcagctggacctgagcctgaagggcgagctggccctgagccccgccgtggaggcccagcagttcgccctgagctacgacaccgtgcccgacacctggagcaagctggcctaccccagcacctacggcctggcccagtggttcaacgacctgctgctgagatgcagagagctggacacctggacccaggacctgaccctgcccgccgtggtgtggctgagcggcttcttcaacccccagagcttcctgaccgccatcatgcagaccatggccagaaagaacgagtggcccctggacaagaccagactgaccgccgacgtgaccaagaagaccaaggaggactacggccacccccccagagagggcgcctacctgcacggcctgttcatggagggcgccagatgggacacccaggccggcaccatcgtggaggccagactgaaggagctggcctgccccatgcccgtgatcttcgccaaggccacccccgtggacagacaggagaccaagcagacctacgagtgccccgtgtacagaaccaagctgagaggccccagctacatctggaccttcagactgaagagcgaggagaagaccgccaagtgggtgctggccggcgtggccctgctgctggaggcctag

SEQ ID NO: 79830 - DNA, 1374 bp, Artificial Sequence
  Description of Artificial Sequence: Synthetic coding sequence
atgagcgacgccaacaaggccgccatcgccgccgagaaggaggccctgaacctgaagctgccccccatcgtgcacctgcccgagaacatcggcgtggacacccccacccagagcaagctgctgaagtacagaagaagcaaggagcagcagcagaagatcaaccagctggtgatcgacggcgccaagagaaacctggacagaaccctgggcaagagaacccccctgctgcccccccccgactacccccagaccatgaccagcgagatgaagaagaagggcttcaactacatctacatgaagcagtgcgtggagagcagccccctggtgcccatccagcaggagtggctggaccacatgctgagactgatccccgagagcctgaaggagggcaaggagagagaggagctgctggagagcctgatcaacgaggtgagcagcgacttcgagaacagcatgaagagatacctggtgcagagcgtgctggtgaagccccccgtgaagagcctggaggacgagggcggccccctgcccgagagccccgtgggcctggactacagcaacccctggcacagcagctacgtgcaggccagaaaccagatcttcagcaacctgcacatcatccaccccaccatgaagatgctgctggacctgggctacaccaccttcgccgacaccgtgctgctggacttcaccggcatcagagccaagggccccatcgactgcgagagcctgaagaccgacctgagcatccagaccagaaacgccgaggagaagatcatgaacacctggtaccccaaggtgatcaacctgttcaccaagaaggaggccctggagggcgtgaagcccgagaagctggacgccttctacagctgcgtgagcaccctgatgagcaaccagctgaaggacctgctgagaagaaccgtggagggcttcgtgaagctgttcgaccccaaggaccagcagagactgcccatcttcaagatcgagctgaccttcgacgacgacaagatggagttctaccccaccttccaggacctggaggacaacgtgctgagcctggtggagagaatcgccgaggccctgcagaacgtgcagaccatccccagctggctgagcggcaccagcacccccgtgaacctggacaccgagctgcccgagcacgtgctgcactgggccgtggacaccctgaaggccgccgtgcacagaaacctggagggcgccagaaagcactacgagacctacgtggagaagtacaactggctgctggacggcaccgccgtggagaacatcgagaccttccagaccgaggaccacaccttcgacgagtacaccgaggagctggactgctgggtggtgtgggaggtgtacttctag

SEQ ID NO: 79831 - DNA, 2040 bp, Artificial Sequence
  Description of Artificial Sequence: Synthetic coding sequence
atgttcctgctgaccggcggcgtgagcctgaagagcgccgagaagaaccccgaccccacctggctgcaggacaagagctgggaggagatctgcagagccagcgagttccccgccttcagaggcctgagacagcacttctgcgagcacatctacgagtggagagagatctacgacagcaaggagccccacaacgccaagttccccgcccccatggacaagaacctgaacgagctgcagaagatcatcatcctgagatgcctgagacccgacaagatcacccccgccatcaccaactacgtgaccgacaagctgggcaagaagttcgtggagcccccccccttcgacctgaccaagagctacctggacagcaactgcaccatccccctgatcttcgtgctgagccccggcgccgaccccatggccagcctgctgaagttcgccaacgacaagagcatgagcggcaacaagttccaggccatcagcctgggccagggccagggccccatcgccgccaagatgatcaaggccgccatcgaggagggcacctgggtgtgcctgcagaactgccacctggccgtgagctggatgcccatgctggagaagatctgcgaggacttcaccagcgagacctgcaacagcagcttcagactgtggctgaccagctaccccagcagcaagttccccgtgaccatcctgcagaacggcgtgaagatgaccaacgagccccccaccggcctgagactgaacctgctgcagagctacctgaccgaccccgtgagcgaccccgagttcttcaagggctgcagaggcaaggagctgctgttcatcaacgagtacgacaccatccccttcgaggccatcagctacctgaccggcgagtgcaactacggcggcagagtgaccgacgactgggacagaagactgctgctgaccatgctggccgacttctacaacctgtacatcgtggagaacccccactacaagttcagccccagcggcaactacttcgccccccccaagggcacctacgaggactacatcgagttcatcaagaagctgcccttcacccagcaccccgagatcttcggcctgcacgagaacgtggacatcagcaaggacctgcagcagaccaagaccctgttcgagagcctgctgctgacccagggcggcagcaagcagaccggcgccagcggcagcaccgaccagatcctgctggagatcaccaaggacatcctgaacaagctgcccagcgacttcgacatcgagatggccctgagaaagtaccccgtgagatacgaggagagcatgaacaccgtgctggtgcaggagatggagagattcaacaacctgatcatcaccatcagaaacaccctgagagacctggagaaggccatcaagggcgtggtggtgatggacagcgccctggaggccctgagcggcagcctgctggtgggcaaggtgcccgagatctgggccaagagaagctaccccagcctgaagcccctgggcagctacatcaccgacttcctggccagactgaacttcctgcaggactggtacaacagcggcaagccctgcgtgttctggctgagcggcttcttcttcacccaggccttcctgaccggcgccatgcagaactacgccagaaagtacaccacccccatcgacctgctgggctacgagttcgaggtgatccccagcgacaccagcgacaccagccccgaggacggcgtgtacatccacggcctgtacctggacggcgccagatgggacagagagagcggcctgctggccgagcagtaccccaagctgctgttcgacctgatgcccatcatctggatcaagcccacccagaagagcagaatcatcaagagcgacgcctacgtgtgccccctgtacaagaccagcgagagaaagggcaccctgagcaccaccggccacagcaccaacttcgtgatcgccatgctgctgaagaccgaccagcccaccagacactggatcaagagaggcgtggccctgctgtgccagctggacgactag

SEQ ID NO: 79832 - DNA, 9279 bp, Artificial Sequence
  Description of Artificial Sequence: Synthetic coding sequence
atgagcgacgccaacaaggccgccatcgccgccgagaaggaggccctgaacctgaagctgccccccatcgtgcacctgcccgagaacatcggcgtggacacccccacccagagcaagctgctgaagtacagaagaagcaaggagcagcagcagaagatcaaccagctggtgatcgacggcgccaagagaaacctggacagaaccctgggcaagagaacccccctgctgcccccccccgactacccccagaccatgaccagcgagatgaagaagaagggcttcaactacatctacatgaagcagtgcgtggagagcagccccctggtgcccatccagcaggagtggctggaccacatgctgagactgatccccgagagcctgaaggagggcaaggagagagaggagctgctggagagcctgatcaacgaggtgagcagcgacttcgagaacagcatgaagagatacctggtgcagagcgtgctggtgaagccccccgtgaagagcctggaggacgagggcggccccctgcccgagagccccgtgggcctggactacagcaacccctggcacagcagctacgtgcaggccagaaaccagatcttcagcaacctgcacatcatccaccccaccatgaagatgctgctggacctgggctacaccaccttcgccgacaccgtgctgctggacttcaccggcatcagagccaagggccccatcgactgcgagagcctgaagaccgacctgagcatccagaccagaaacgccgaggagaagatcatgaacacctggtaccccaaggtgatcaacctgttcaccaagaaggaggccctggagggcgtgaagcccgagaagctggacgccttctacagctgcgtgagcaccctgatgagcaaccagctgaaggacctgctgagaagaaccgtggagggcttcgtgaagctgttcgaccccaaggaccagcagagactgcccatcttcaagatcgagctgaccttcgacgacgacaagatggagttctaccccaccttccaggacctggaggacaacgtgctgagcctggtggagagaatcgccgaggccctgcagaacgtgcagaccatccccagctggctgagcggcaccagcacccccgtgaacctggacaccgagctgcccgagcacgtgctgcactgggccgtggacaccctgaaggccgccgtgcacagaaacctggagggcgccagaaagcactacgagacctacgtggagaagtacaactggctgctggacggcaccgccgtggagaacatcgagaccttccagaccgaggaccacaccttcgacgagtacaccgagttcatcgagaagttcctgagcctggccagcgagatcatgctgctgccccagtggatccactacaccatggtgagactggactgcgaggacctgaagaccggcctgaccaacaaggccaaggccttcgccaacatcctgctgaacgacatcgccagcaagtacagaaaggagaacgagtgcatctgcagcgagttcgaggccatcaaggagcacgccctgaaggtgcccgagaccaccgaggagatgatggacctgatcagctacgtggagaaggccagaaccgtgggcatcgaggagctgatcctgagaatccaggagagcaagagacagatgagctacttcctggacgtgttcctgttcccccaggaggacctggccctgaacgccaccgtgctgatgtggcccagaaagatcaaccccatcttcgacgagaacgacgagctgatcgagaacgccaagcacaagaaggagaacgagctgatggccaagagagagaagctgatcctggagatcgagaaggagagcagaagaatggaggagttcaccgagttcgccgagctggagagaatgcagcagtacgtgaccgacgtgagacagctgcagaagagaatccaggagagcgaggaggccgtgcagttcatcaacaaggaggaggagctgttcaagtgggagctgaccaagtaccccgagctggacaagctgaaggtgaacatcgagccctaccagaagttcttcaacttcgtgctgaagtggcagagaagcgagaagagatggatggacggcggcttcctggacctgaacggcgagagcatggaggccgacgtggaggagttcagcagagagatcttcaagaccctgaagttcttccagaccaagctgaagaaggagctgcaggagaagagaaaggccgccagaaagagaagcctggaggaggagaagatcgaggaggagcccaaggacaacgccaccatcaccatgtgcagaatgagagccagacactggaagcagatcagcgagatcgtgggctacgacctgacccccgacagcggcaccaccctgagaaaggtgctgaagctgaacctgaccccctacctggagcagttcgaggtgatcagcgccggcgccagcaaggagttcagcctggagaaggccatgaacaccatgatcggcacctgggaggacatcgccttccacatcagcctgtacagagacaccggcgtgtgcatcctgagcagcgtggacgagatccaggccatcctggacgaccagatcatcaagacccagaccatgagaggcagccccttcatcaagcccttcgagcacgagatcaaggcctgggaggacagactgatcagaatccaggagaccatcgacgagtggctgaaggtgcaggcccagtggctgtacctggagcccatcttctgcagcgaggacatcatgcagcagatgcccgaggagggcagacagttccagaccgtggacagacactggagagacatcatgaagttctgcgccaaggaccccaaggtgctggccgccaccagcctgaccggcctgctggagaagctgcagaactgcaacgagctgctggagaagatcatgaagggcctgaacgcctacctggagaagaagagactgttcttccccagattcttcttcctgagcaacgacgagatgctggagatcctgagcgagaccaaggaccccctgagagtgcagccccacctgaagaagtgcttcgagggcatcgccaagctggagttcctgcccaacctggacatcaaggccatgtacagcagcgagggcgagagagtggagctgatcgccctgatcagcaccagcgccgccagaggcgccgtggagaagtggctgatccaggtggaggacctgatgctgagaagcgtgcacgacgtgatcgccgccgccagactggcctaccccgagagcgccagaagagactgggtgagagagtggcccggccaggtggtgctgtgcatcagccagatgttctggaccagcgagacccaggaggtgatcagcggcggcaccgagggcctgaagaagtactacaaggagctgcagaaccagctgaacgagatcgtggagctggtgagaggcaagctgagcaagcagaccagaaccaccctgggcgccctggtgaccatcgacgtgcacgccagagacgtggtgatggacatgatcaagatgggcgtgagccacgacaccgacttcctgtggctggcccagctgagatactactgggagaacgagaacgccagagtgagaatcatcaactgcaacgtgaagtacgcctacgagtacctgggcaacagccccagactggtgatcacccccctgaccgacagatgctacagaaccctgatcggcgccttctacctgaacctgggcggcgcccccgagggccccgccggcaccggcaagaccgagaccaccaaggacctggccaaggccctggccgtgcagtgcgtggtgttcaactgcagcgacggcctggactacctggccatgggcaagttcttcaagggcctggccagcagcggcgcctgggcctgcttcgacgagttcaacagaatcgagctggaggtgctgagcgtggtggcccagcagatcctgtgcatccagagagccatccagcagaagctggtggtgttcgtgttcgagggcaccgagctgaagctgaaccccaactgcttcgtggccatcaccatgaaccccggctacgccggcagaagcgagctgcccgacaacctgaaggtgctgttcagaaccgtggccatgatggtgcccaactacgccctgatcgccgagatcagcctgtacagctacggcttcctgaacgccagacccctgagcgtgaagatcgtgatgacctacagactgtgcagcgagcagctgagcagccagttccactacgactacggcatgagagccgtgaaggccgtgctggtggccgccggcaacctgaagctgaagtaccccaacgagaacgaggacatcctgctgctgagaagcatcaaggacgtgaacgagcccaagttcctgagccacgacatccccctgttcaacggcatcaccagcgacctgttccccggcatcaagctgcccgaggccgactaccacgagttcctggagtgcgcccacgaggcctgcaacgtgcacaacctgcagcccgtgaagttcttcctggagaagatcatccagacctacgagatgatgatcgtgagacacggcttcatgctggtgggcgagcccttcgccgccaagaccaaggtgctgcacgtgctggccgacaccctgaccctgatgaacgagcacggctacggcgaggaggagaaggtgatctacagaaccgtgaaccccaagagcatcaccatgggccagctgttcggccagttcgaccccgtgagccacgagtggaccgacggcatcgtggccaacaccttcagagagttcgccctgagcgagacccccgacagaaagtgggtggtgttcgacggccccatcgacaccctgtggatcgagagcatgaacaccgtgctggacgacaacaagaagctgtgcctgatgagcggcgagatcatccagatgagcccccagatgagcctgatcttcgagaccatggacctgagccaggccagccccgccaccgtgagcagatgcggcatgatctacctggagcccagccagctgggctgggagcccctggtgagcagctggctgaacagcctgaagggccccctgtgcgagcccgagtaccaggccctgctgagaggcctgttcgcctggctgatcccccccagcctgaaccagagagtggagctgttccagctgaactacctgtacaccaccatcgtgagcaagatcctgaagatcctgatcaccttcagaatcagcaactacttcaagtacgtgcccctgaagacccagtgcaccttcatcaagttcttcctgcaccagcaggcctgcttcatcttcagcctgatctggagcatcggcggcagctgcgacaccgacggcagaagagtgttcgacaccttcatcagactgatcatcctgggcaaggacgacgagaaccccgtgcccgacagcgtgggcaagtgggagtgccccttcgacgagaagggcctggtgtacgactacatgtacgagctgaagaacaagggcagatgggtgcactggaacgagctgatcaagaacaccaacctgggcgacaagcagatcaagatccaggacatcatcgtgcccaccatggacaccatcagatacaccttcctgatggacctgagcatcacctacgccaagcccctgctgttcgtgggccccaccggcaccggcaagagcgtgtacgtgaaggacaagctgatgaaccacctggagaaggaccagtacttccccttctacatcaacctgagcgccagaaccagcgccaaccaggtgcagaacatcatcatggccagactggacaagagaagaaagggcgtgttcggcccccccatgggcaagaagtgcatcatcttcatcgacgacatgaacatgcccgccctggagaagtacggcgcccagccccccatcgagctgctgagacagttcttcgactgcggccactggtacgacctgaaggacaccagcaagatcaccctggtggacatcgagctgatcgccgccatgggcccccccggcggcggcagaaaccccgtgacccccagatgcatcagacacttcaacatctgcagcatcaacagcttcagcgacgagaccatggtgagaatcttcagcagcatcgtggccttctacctgagaacccacgagttcccccccgagtacttcgtgatcggcaaccagatcgtgaacggcaccatggagatctacaagcagagcgtggagaacctgctgcccacccccaccaagagccactacaccttcaacctgagagacttcagcagagtgatcagaggctgcctgctgatcgagagagacgccgtggccaacaagcacaccatgatcagactgttcgtgcacgaggtgctgagagtgttctacgacagactgatcaacgacgacgacagaagatggctgttccagctgaccaagaccgtgatcaaggaccacttcaaggagagcttccacagcatcttcagccacctgagaaagcagaacgcccccgtgaccgaggaggacctgagaaacctgatgttcggcgactacatgaaccccgacctggagggcgacgacagagtgtacatcgagatccccaacatccaccacttcagcgacgtggtggaccagtgcctggacgagtacaaccagacccacaagaccagaatgaacctggtgatcttcagatacgtgctggagcacctgagcagaatctgcagagtgctgaagcagagcggcggcaacgccctgctggtgggcctgggcggcagcggcagacagagcctgaccagactggccaccagcatggccaagatgcacatcttccagcccgagatcagcaagagctacggcatgaacgagtggagagaggacatgaagagcttcatcgccgtgcccgtgaccaacagaatcgtggacaacaagagcaagatcctggagaagagactgagatacctgaacgaccacttcacctacaacctgtactgcaacatctgcagaagcctgttcgagaaggacaagctgctgttcagcttcctgctgtgcgccaacctgctgctggccagaaaggagatcgagtaccaggagctgatgttcctgctgaccggcggcgtgagcctgaagagcgccgagaagaaccccgaccccacctggctgcaggacaagagctgggaggagatctgcagagccagcgagttccccgccttcagaggcctgagacagcacttctgcgagcacatctacgagtggagagagatctacgacagcaaggagccccacaacgccaagttccccgcccccatggacaagaacctgaacgagctgcagaagatcatcatcctgagatgcctgagacccgacaagatcacccccgccatcaccaactacgtgaccgacaagctgggcaagaagttcgtggagcccccccccttcgacctgaccaagagctacctggacagcaactgcaccatccccctgatcttcgtgctgagccccggcgccgaccccatggccagcctgctgaagttcgccaacgacaagagcatgagcggcaacaagttccaggccatcagcctgggccagggccagggccccatcgccgccaagatgatcaaggccgccatcgaggagggcacctgggtgtgcctgcagaactgccacctggccgtgagctggatgcccatgctggagaagatctgcgaggacttcaccagcgagacctgcaacagcagcttcagactgtggctgaccagctaccccagcagcaagttccccgtgaccatcctgcagaacggcgtgaagatgaccaacgagccccccaccggcctgagactgaacctgctgcagagctacctgaccgaccccgtgagcgaccccgagttcttcaagggctgcagaggcaaggagctggcctgggagaagctgctgttcggcgtgtgcttcttccacgccctggtgcaggagagaaagaagttcggccccctgggctggaacatcccctacggcttcaacgagagcgacctgagaatcagcatcagacagctgcagctgttcatcaacgagtacgacaccatccccttcgaggccatcagctacctgaccggcgagtgcaactacggcggcagagtgaccgacgactgggacagaagactgctgctgaccatgctggccgacttctacaacctgtacatcgtggagaacccccactacaagttcagccccagcggcaactacttcgccccccccaagggcacctacgaggactacatcgagttcatcaagaagctgcccttcacccagcaccccgagatcttcggcctgcacgagaacgtggacatcagcaaggacctgcagcagaccaagaccctgttcgagagcctgctgctgacccagggcggcagcaagcagaccggcgccagcggcagcaccgaccagatcctgctggagatcaccaaggacatcctgaacaagctgcccagcgacttcgacatcgagatggccctgagaaagtaccccgtgagatacgaggagagcatgaacaccgtgctggtgcaggagatggagagattcaacaacctgatcatcaccatcagaaacaccctgagagacctggagaaggccatcaagggcgtggtggtgatggacagcgccctggaggccctgagcggcagcctgctggtgggcaaggtgcccgagatctgggccaagagaagctaccccagcctgaagcccctgggcagctacatcaccgacttcctggccagactgaacttcctgcaggactggtacaacagcggcaagccctgcgtgttctggctgagcggcttcttcttcacccaggccttcctgaccggcgccatgcagaactacgccagaaagtacaccacccccatcgacctgctgggctacgagttcgaggtgatccccagcgacaccagcgacaccagccccgaggacggcgtgtacatccacggcctgtacctggacggcgccagatgggacagagagagcggcctgctggccgagcagtaccccaagctgctgttcgacctgatgcccatcatctggatcaagcccacccagaagagcagaatcatcaagagcgacgcctacgtgtgccccctgtacaagaccagcgagagaaagggcaccctgagcaccaccggccacagcaccaacttcgtgatcgccatgctgctgaagaccgaccagcccaccagacactggatcaagagaggcgtggccctgctgtgccagctggacgactag

SEQ ID NO: 79833 - DNA, 2355 bp, Artificial Sequence
  Description of Artificial Sequence: Synthetic coding sequence
atgagcgacgccaacaaggccgccatcgccgccgagaaggaggccctgaacctgaagctgccccccatcgtgcacctgcccgagaacatcggcgtggacacccccacccagagcaagctgctgaagtacagaagaagcaaggagcagcagcagaagatcaaccagctggtgatcgacggcgccaagagaaacctggacagaaccctgggcaagagaacccccctgctgcccccccccgactacccccagaccatgaccagcgagatgaagaagaagggcttcaactacatctacatgaagcagtgcgtggagagcagccccctggtgcccatccagcaggagtggctggaccacatgctgagactgatccccgagagcctgaaggagggcaaggagagagaggagctgctggagagcctgatcaacgaggtgagcagcgacttcgagaacagcatgaagagatacctggtgcagagcgtgctggtgaagccccccgtgaagagcctggaggacgagggcggccccctgcccgagagccccgtgggcctggactacagcaacccctggcacagcagctacgtgcaggccagaaaccagatcttcagcaacctgcacatcatccaccccaccatgaagatgctgctggacctgggctacaccaccttcgccgacaccgtgctgctggacttcaccggcatcagagccaagggccccatcgactgcgagagcctgaagaccgacctgagcatccagaccagaaacgccgaggagaagatcatgaacacctggtaccccaaggtgatcaacctgttcaccaagaaggaggccctggagggcgtgaagcccgagaagctggacgccttctacagctgcgtgagcaccctgatgagcaaccagctgaaggacctgctgagaagaaccgtggagggcttcgtgaagctgttcgaccccaaggaccagcagagactgcccatcttcaagatcgagctgaccttcgacgacgacaagatggagttctaccccaccttccaggacctggaggacaacgtgctgagcctggtggagagaatcgccgaggccctgcagaacgtgcagaccatccccagctggctgagcggcaccagcacccccgtgaacctggacaccgagctgcccgagcacgtgctgcactgggccgtggacaccctgaaggccgccgtgcacagaaacctggagggcgccagaaagcactacgagacctacgtggagaagtacaactggctgctggacggcaccgccgtggagaacatcgagaccttccagaccgaggaccacaccttcgacgagtacaccgagttcatcgagaagttcctgagcctggccagcgagatcatgctgctgccccagtggatccactacaccatggtgagactggactgcgaggacctgaagaccggcctgaccaacaaggccaaggccttcgccaacatcctgctgaacgacatcgccagcaagtacagaaaggagaacgagtgcatctgcagcgagttcgaggccatcaaggagcacgccctgaaggtgcccgagaccaccgaggagatgatggacctgatcagctacgtggagaaggccagaaccgtgggcatcgaggagctgatcctgagaatccaggagagcaagagacagatgagctacttcctggacgtgttcctgttcccccaggaggacctggccctgaacgccaccgtgctgatgtggcccagaaagatcaaccccatcttcgacgagaacgacgagctgatcgagaacgccaagcacaagaaggagaacgagctgatggccaagagagagaagctgatcctggagatcgagaaggagagcagaagaatggaggagttcaccgagttcgccgagctggagagaatgcagcagtacgtgaccgacgtgagacagctgcagaagagaatccaggagagcgaggaggccgtgcagttcatcaacaaggaggaggagctgttcaagtgggagctgaccaagtaccccgagctggacaagctgaaggtgaacatcgagccctaccagaagttcttcaacttcgtgctgaagtggcagagaagcgagaagagatggatggacggcggcttcctggacctgaacggcgagagcatggaggccgacgtggaggagttcagcagagagatcttcaagaccctgaagttcttccagaccaagctgaagaaggagctgcaggagaagagaaaggccgccagaaagagaagcctggaggaggagaagatcgaggaggagcccaaggacaacgccaccatcaccatgtgcagcaccgtgatggagcagatcaaggccttcaaggtgtag

SEQ ID NO: 79834 - DNA, 687 bp, Artificial Sequence
  Description of Artificial Sequence: Synthetic coding sequence
atggagaccttcatccccatcgacctgaccaccgagaaccaggagatggacaaggaggagaccaagaccaagcccagactgctgagatacgaggagaagaagtacgaggacgtgaagcccctggagacccagcccgccgagatcgccgagaaggagaccctggagtacaagaccgtgagaaccttcagcgagagcctgaagagcgagaagaccgaggactacctgagagagagcatcatccagcagcacatggtgagccccgagcccgccagcctgaaggagaagggcaagagcagaagaaagaaggaccagacccacgcctgccccaacgtgagaaaggccagacccgtgagctacgacagaaccgagcccaaggacgacgacgtgatcagaaacatcatcagactgagagagaagctgggctggcagaccatcctgccccagcacagcctgaagtacggcagcagcaagatcgccatccagaagatcaccctgaagaagcccctggaggacgacggcgagttcgtgtactgcctgcccagaaagagccccaagagcctgtacaacccctacgacctgcaggtggtgagcgcccacaccgccaagcactgcaaggagttctgggtgatcaccgccagcttcatcagcaagagatacctggtgatctgcggcgccgtgtacatctag

SEQ ID NO: 79835 - DNA, 687 bp, Artificial Sequence; identical to SEQ ID NO: 79834
  Description of Artificial Sequence: Synthetic coding sequence

SEQ ID NO: 79836 - DNA, 1362 bp, Artificial Sequence
  Description of Artificial Sequence: Synthetic coding sequence
atggagaccttcatccccatcgacctgaccaccgagaaccaggagatggacaaggaggagaccaagaccaagcccagactgctgagatacgaggagaagaagtacgaggacgtgaagcccctggagacccagcccgccgagatcgccgagaaggagaccctggagtacaagaccgtgagaaccttcagcgagagcctgaagagcgagaagaccgaggactacctgagagagagcatcatccagcagcacatggtgagccccgagcccgccagcctgaaggagaagggcaagagcagaagaaagaaggaccagacccacgcctgccccaacgtgagaaaggccagacccgtgagctacgacagaaccgagcccaaggacgacgacgtgatcagaaacatcatcagactgagagagaagctgggctggcagaccatcctgccccagcacagcctgaagtacggcagcagcaagatcgccatccagaagatcaccctgaagaagcccctggaggacgacggcgagttcgtgtactgcctgcccagaaagagccccaagagcctgtacaacccctacgacctgcaggtggtgagcgcccacaccgccaagcactgcaaggagttctgggtgatcaccgccagcttcatcagcaaggtgatcaacatcgtgggcagcgtgaaggaggtggagctgatccccaccctggagtggctgagcgagagaagacactactacctgctgagacagttcaagatcttcagcgacttcagaatgaacaaggccttcgtgacctggaagctgaacgtgaagagaatcaagaccgagaagagcagaagcttcctgtaccaccacctgttcctggccgacgacctgttccagacctgcctggtgtacatcagaggcctgtgcgaggacgccatcaacctgaagaactacaacgaccacgagaacaacctgagcgccatctgcctggtgaagctggacagcagcagaacctacagcctggacgagttctgcgaggagcagctgcagcaggccacccaggccctgaagcagctggaggacatcagaaacaaggccatcagcgagatgaagagcaccttcctgaaggtggccgagaagaacgagatcaaggagtacttcgagagcaagctgagcgaggacgacaccacccacttcaagctgcccaagtacagaagactgctggagaccttcttcaagttcgtgatgctggtggactacatcttccaggagctgatcagacagctgatgaacaccgccgtgaccctgctgctggagctgttcaacggcagcgccggcatgcccttcagcgtggagaagaagaacgagaacctgatcagatag

SEQ ID NO: 79837 - DNA, 13548 bp, Artificial Sequence
  Description of Artificial Sequence: Synthetic coding sequence
atggagaccttcatccccatcgacctgaccaccgagaaccaggagatggacaaggaggagaccaagaccaagcccagactgctgagatacgaggagaagaagtacgaggacgtgaagcccctggagacccagcccgccgagatcgccgagaaggagaccctggagtacaagaccgtgagaaccttcagcgagagcctgaagagcgagaagaccgaggactacctgagagagagcatcatccagcagcacatggtgagccccgagcccgccagcctgaaggagaagggcaagagcagaagaaagaaggaccagacccacgcctgccccaacgtgagaaaggccagacccgtgagctacgacagaaccgagcccaaggacgacgacgtgatcagaaacatcatcagactgagagagaagctgggctggcagaccatcctgccccagcacagcctgaagtacggcagcagcaagatcgccatccagaagatcaccctgaagaagcccctggaggacgacggcgagttcgtgtactgcctgcccagaaagagccccaagagcctgtacaacccctacgacctgcaggtggtgagcgcccacaccgccaagcactgcaaggagttctgggtgatcaccgccagcttcatcagcaaggtgatcaacatcgtgggcagcgtgaaggaggtggagctgatccccaccctggagtggctgagcgagagaagacactactacctgctgagacagttcaagatcttcagcgacttcagaatgaacaaggccttcgtgacctggaagctgaacgtgaagagaatcaagaccgagaagagcagaagcttcctgtaccaccacctgttcctggccgacgacctgttccagacctgcctggtgtacatcagaggcctgtgcgaggacgccatcaacctgaagaactacaacgaccacgagaacaacctgagcgccatctgcctggtgaagctggacagcagcagaacctacagcctggacgagttctgcgaggagcagctgcagcaggccacccaggccctgaagcagctggaggacatcagaaacaaggccatcagcgagatgaagagcaccttcctgaaggtggccgagaagaacgagatcaaggagtacttcgagagcaagctgagcgaggacgacaccacccacttcaagctgcccaagtacagaagactgctggagaccttcttcaagttcgtgatgctggtggactacatcttccaggagctgatcagacagctgatgaacaccgccgtgaccctgctgctggagctgttcaacggcagcgccggcatgcccttcagcgtggagaagaagaacgagaacctgatcagaaccttcaaggacaacagcttccccaccggcaagaccaccaacgactgcgaggagctggtggacaacagcaagctgcacgccatcagcgtgcagaagagcgaggtgaagaccgacaccgacatcaacgagatcctgaacagcgtggaggtgggcaaggacctgagaaagacctacgcccccatcttcgaggtgaacctgtgcctgagaatccccgccgagagcgacagcagcgagaacagcaaggagaacttccacgagagcgaccagtgccccgaggagtgcgtgatgttcgaggacgagatgagcgagaacaaggacaactgcgtgaagaagcacagcagcgaggagctgctgcccaaggccaagaagagcaaggagatcagctacaacctggaggacatcatcagcgacaccgagatcgagaccgagttcgagaacaagtacatgtactacgagttccccgagttccccaccaacctgttcatcgaccccaacagactggagttcagcgtgaagatccagaacatgctgaccaacatggagaagtgcatcaccaccatcacccccctgtgccaggacccccagctgagcatcttcatcgacctggtgagcatcatggacctgcccaacaagaccggcagcatcatccactacaaggagcagaccagatggcccgactgccacatcctgttcgagaccgaccccgcctaccagaacatcatcgtgaacctgctgaccatcatcggcaacagcatgggcctggtgaacgcctacagccacaagttcatcaagtactgcaccatgaccgagaaggccaagatcatgagcatgaagatcagcagcatgggcgagctgaccagcaaggagttcgaggccatcctgaacagattcagaaactacttcagacacatcgtgaacatggccatcgagaagagaatcggcatcttcaacgtggtgagcctggactaccagagcgagtgcctgctgtacatcgacaacgtgatccacatgagccacaccctgatccagagcgtgatcgagaagaagaacaagaacctgctggaggtggtggagagcagcctgcagcagctggagtgcgaccccaccgagatcgaggagttcctggagcacttcatcttcctgaacgccatcagcagcaagatcagcaagctggagaaggagttcctgaccatgagccagctgtacagcgtggccaagcaccaccagatccacatcagcgaggagcagatcgccatcttccaggtgctgctgctgaagttcagccagctgaagagcagcatgaagctgagcaagatcaacaaggacaccgccatcaccaagttcagagacaacctggaggcctgcatcagcggcctgcacgtggacgtgggcaacctgaaggccaagatcagaacccccctgctgctgtgcgccggcacccaggtgagcaccgccatggagatgatccagaccctgagcggcgaggccgccagcctgaccaacaaggccaaggcctacagccactaccaggactgcttcagcgacagccagagccacatgcacagcgtgaacgtggaggagatcacccagatcgtgctgagcgagatcagcgacatcgagggcgacctgaccctgagaaagaagctgtgggaggcccaggaggagtggaagagagccagctgggagtggagaaacagcagcctgcagagcatcgacgtggagagcgtgcagagaaacgtgagcaagctgatgcacatcatcagcgtgctggagaagggcctgcccaagagcgacatggtgacccacctgaagcaggtggtgaccgagttcaagcaggagctgcccatcatcatcgccctgggcaacccctgcctgaagcccagacactgggaggccctgcaggagatcatcggcaagagcgtgcccctggacaagaactgcaaggtggagaacctgctggccctgaagatgttccagtacgagaacgagatcaacgacatgagcaccagcgccaccaacgaggccgccctggagaagatgctgttcaagatcatcgacttctggaacaccacccccctgcccctgatcctgcaccacaccgagatctacagcatcttcatcatccccagcatcgacgacatcagcgcccagctggaggagagccaggtgatcctggccaccatcaagggcagcccccacatcggccccatcaaggacctggtgaacgagtgggaccagaacctgaccctgttcagctacaccctggaggagtggatgaactgccagagaaactggctgtacctggagcccgtgttccacagcagcgagatcagaagacagctgcccgccgagaccgagctgttcagccaggtgatcagcatgtggaagaagatcatgagcaagatccagaacaagcagaacgccctgcagatcaccaccagcgccggcgtgctggagatcctgcagaactgcaacatccacctggagcacatcaagaagagcctggaggactacctggaggtgaagagactgatcttccccagattctacttcctgagcaacgccgagctgctggacatcctggccgacagcagaaaccccgagagcgtgcagccccacctggtgaagtgcttcgagaacatcaagcagctgctgatctggaagcaggacatcggcccccccgccgtgaagatgctgatcagcgccgagggcgagggcctggtgctgcccaagaagatcagagtgagaagcgccgtggagcagtggctggtgaacgtggagaagagcatgttcgacgtgctgaagaaggagagatacatctacaacatcatcctgctgttccagagccagatcatgttctacaacgactgcgtgaagagcttcgtgagcagctacagcagagagaagctggagaaggtgcacgccggcctgatgtgccacctggaggaggtggccgacctggtggtgctggacaccagcaacagcagaaccaaggccatcctgggcgccctgctgatcctgtacgtgcactgcagagacatcgtgatcaacctgctgctgaagaacatcttcaacgccgaggacttcgagtggaccagacacctgcagtacaagtggaacgagaagcagaagctgtgctacgtgagccagggcaacgccagcttcacctacggctacgagtacctgggctgcaccagcagactggtgatcacccccctgaccgacagatgctggctgaccctgatggaggccctgcacctgaacctgggcggctgccccgccggccccgccggcaccggcaagaccgagaccgtgaaggacctggccaagagcctgggcaagcactgcgtggtgttcaactgcttcgaggacctggactacaagatcgtgagaaagttcttcttcggcctggtgcagagcggcgcctggagctgcttcgacgagttcaacctgatcgacctggaggtgctgagcgtgatcgccagccagatcctgaccatcaaggccgccaaggacaactacagcgccagattcgtgctggagggcaaggagatcagaatcaacatgagctgcgccgtgttcatcaccatgaaccccagatacggcggcggcgtggagctgcccgacaacctgaagagcctgttcagacccgtggccatgatggtgccccactaccagatgatcgccgagatcatcctgttcagcttcggcttcaagagcgccaacagcctgagcggcaagctgaccaacctgtacgagctggccagaaagcagctgagccagcaggaccactacaacttcggcctgagaagcctgaagatcgtgctgatcatggccggcaccaagaagagagagttcaagtgcctgagcgaggccgacgagaccctgatcgtgatcgaggccatcagagaggccagcctgcccaagtgcccccccgaggacgtgcccctgttcgagaacatcatcggcgacatcttccccgaggtgaccgtgctgaaggtgaaccagctggccctggagaaggtgatctacaccgccacccagcagctgggcctgcagaactggagcagccagaaggagaagatcatccagttctacaaccagctgcaggtgtgcgtgggcgtgatgctggtgggccccaccggcggcggcaagaccaccgtgagaagaatcctggagaaggccctgaccctgctgcccatcgccgacttcctgagcgtggccgagagaaagagcgccagcaagatcagcgagagaaagggcaaggtggacatctgcgtgctgaaccccaagtgcgtgaccctgagcgagctgtacggccagctggaccccaacaccatggagtggaccgacggcctgctgagcgccaccatcagaagctacgtgtacttcaacacccccaagaacaccaagaaggacatcgacctgagactgaagagcagaatcagcgacctgagcaacgtgttcaagctggacagcagcgacaccaccgagaccgacgacaacatcttcgaggagatcgagaaggtggtgaagatccccgagaaccacaacttcgactggcagtggatcatcctggacggccccgtggacaccttctgggtggagaacctgaacagcgtgctggacgacaccagaaccctgtgcctggccaacagcgagagaatcgccctgaccaacaagatcagagtgatcttcgaggtggacaacctgagccaggccagccccgccaccgtgagcagatgcgccatggtgtacatggaccccgtggacctgggctgggagccctacgtgaagagctggctgctgaagaccagcaagatcatcagccagagcggcgtggactgcctggagttcatgatcaagaacagcgtgaccgacggcctgcagttcatcagaaacagacagaagttccagccctaccccatggaggacatcaccgtggtgatcaccctgtgcagaatcctggacgccttcttcgacttcatgggcaagaacggcggcttcgagcagagcgacgacctgaacgacaccagcagcaaggaggccaacagccagagagagagcgtgaccttcaaggacatcgagaagagagacgagaacacctggtaccccgagaagaaccccgacaagctgaccaagatcatccagaagctgttcgtgttcgccttcacctgggccttcggcggcgccctgaacagagaggacgagcacagagagaacatccccttctgccccagcctggagcccgacagcctggccaaggtgacctacgacttcgacaagctggtgcacgagctgttcggcaacagcagccaggtgggctggaagcactggggccagagccagggcagaagaagaaagggcaactgcatcaacctgcccaccggcgagtgcagcatcttcggctacttcgtggacatcgagcagtgcgagttcatcccctggagcgacctggtgcccaacgaccagaccctgatccagagaggcaccagcctgctgaccaacctgcagagaagcggcggcaacttcctgaagatcaccgagtgcggcgagtgcatcaactacaccgccaccagagacaccacctgcctgagcttcctgatgagcctgctgctgaagaacagctgccccgtgctgctgaccggcgagagcggcgtgggcaagaccgccgccatcaaccagatgctggagaagctggagggccccggcgccttcgacatcaagcacggcagcatcctgggcgacaccctgctgtacagcgagatcaagaagagcagcagcctgaagcagaacatcaccatcctgatccccgagacccacaagaccgccaccggcagcagcgacaaccccaccaagaagcccgaggtgagaaccaacaagaagctgctgaagaacaacgaccacaagggcgtggtggtgagcaccatcaacttcagcaccaacgtgaccgccgccaagaccaaggagatgatcctgaagaagctgatcagaagaaccaaggacaccctgggcgcccccaagaacaacagaatcctgatcttcatcgacgacatgaacatgcccgtgagcgacatgtacggcgcccagccccccctggagctgatcagacagctgctggacctgggcggcgtgtacgacaccgagaagaacacctggaagaacatccaggacctgagcatcgtggccgcctgcgtgcccgtggtgaacgacatcagccccagactgctgaagcacttcagcatgctggtgctgccccaccccagccaggacatcctgtgcaccatcttccaggcccacctgggcatctacttcagcatcaacaacttcacccccgaggtgcagaagagcaaggaccagatcatcagctgcagcctggccatctaccaccaggtgagacagaacatgctgcccacccccaccaagtgccactacatgttcaacctgagagacatgttcaagctgctgctgggcctgctgcaggccgacagaaccgtggtgaacagcaaggagatggccgccctgctgttcgtgcacgaggccaccagagtgttccacgacagactgatcgacttcaccgacaagagcctgttctacagactgctgagcagagagctggagaactgcttccagatcggcatcgacggctgcggcaagaagacctgcgccaccctggcctgctacctgaccgacaacaagctgtacagagtgcccatcagccacaagtgcgcctacatcgagttcaaggaggtgttcaagaaggtgttcatccacgccggcctgaagggcaagcccaccgtgctgatggtgcccaacctgaacatcgagcaggacagcttcctggaggacctgaactacatcatcagcagcggcagaatccccgacctgttcgagaacgtggagctggacagcatcgccatgaagatcagatacctgaccgagcagagcggccacatggacaacagacagagcctgctgagcttcttccagaagagaatctacaagaacctgcacatcttcgtgatcatgagccccgagggccccagcttcagacagaactgcagagtgtaccccagcatgatcagcagctgcaccatcgactggtacgagagatggcccgaggaggccctgctgatcgtggccaacagcttcctgaaggagaaggtgaacttcgagaacagagagaacctgaaggagaagctggcccccacctgcgtgcagatccacaagagcatgaaggacctgaacagaaagtacttcgaggagaccggcagattctactacaccacccccaacagctacctgcagttcatggagaccttcgcccacatcctgagagccagagaggaggagatgcagaccaagagagacagattccacatgggcctgagcaccatcctggaggccaccaccctggtgaccgagatgcaggaggagctgctgatcctgggcccccaggtggagcagaagaccaaggagaccgagaccctgatggagaagctgagaaaggacagccaggtggtggagaaggtgcagatgctggtgaagcaggacgaggagatcgtggccgaggaggtgagaatcgtggaggactacgcccagaagaccgccaacgagctgaagagcgtgctgcccgccttcgacaaggccatcgtggccctgaacgccctggacaaggccgacgtggccgagctgagagtgtacaccagaccccccttcctggtgctgaccgtgatgaacgccgtgtgcatcctgctgcagaagaagcccaactgggccaccgccaagctgctgctgagcgagaccggcttcctgaagaagctgatcaacctggacaaggacagcatccccgacaaggtgttcgtgaagctgaagaagatcgtgaccctgcccgacttcaacccccacaagatcagcctggtgagcgtggcctgctgcagcctgtgccagtgggtgatcgccctgaacaactaccacgaggtgcagaaggtggtgggccccaagcagatccaggtggccgaggcccagaacgtgctgaagatcgccagacagagactggccgagaagcagagaggcctgcagctggtggaggagcacctgctgttcctgcaggccgcctacaaggacaccgtggccgagaagcagctgctggccaacagaaagaccatggccagcagaagattccagtgcgccagcgtgctgctgaccgtgctggaggacgagaagaccagatggcaggagaccatcaaccagatcgacaacaagctggagggcatcctgggcgacatcctgctgagcgccgcctgcatcgtgtacagcggcatcctgacccccgagttcagacagctgatcgtgaacaagtgggagaccttctgcatcgagaacggcatcagcctgagcagcaagttcagcctgatcaaggtgatggcccagaagtacgagatcagcagatggcacaaccagggcctgccccacggccagtacagcgtggagaacgccatcctgatcaagaacggccagcagtggcccctgctgatcgacccccacagacaggcccacaagtggatcagacagatggagggcagcagactgcagaagctgagcatcgaggacagcaactacaccaagaagatcgagaacgccatgaagaccggcggcagcgtgctgctgcagaacctgctggagaccctggcccccggcctgaaggccatcctgaagaaggacatctaccagaagaagggccactacttcatcagagtgggcgacgccgagttcgagtacaacagcaacttcagactgtacctgagcaccgagatcgacaacccccacttcctgcccagcgtgtacaacttcgtgaccatgatcaacttcaccgtgaccttccagggcctgcaggaccagctgctgagcaccgtggtgacccacgaggtgccccacctggaggaccagagaagcaagctgctggagagcatcagcctggacgccatcaccctggaggagctggaggagaagaccctgaacctgctgcagaaggccctgggcagcatcctggacgacgacaagatcgtggacaccctgagaaagagcaagatgaccagcaacgagatcagcaagagaatcgaggccaccaagaaggccgagagcgagatccaggccatcagaaagaactacctgcccatcgccaccagaggcgccctgctgtacttcctggtggccgacctgacccagatcaactacatgtaccagttcagcctggactggttccaccaggtgttcgtgagcagcgtggtgagcaagagcaaggagcaggagcacagcttcaagagagagaaggtgagccccaaggaggtgcacgagttcatcagcatcagcaaggagcccaacctggagaacgagaagaacctgctggacaagcacatcaagagcgccatcgacatgctgaccaagagcatcttcaaggtggtgagcagcgccctgttcaacgaggacaagctgtgcttcagcttcagactgtgcaccgtgatcatgcagaacaacgccaacggcaacctgatccaggacgacatcggcttcctgcccgaggaggagtggaacatcttcctgtacagcggcatcctgatcaacatcaagagcgccctgagccagagcagactgaccagcaccttcgagatcggcgagagccagcacctgcagtggctgagcgacagcagatggagacagtgccagtacgtgagcacccacctggagcccttcagcctgctgtgcaagagcctgctgagcaacgtgagccagtgggacaccttcaagaacagcaaggccgtgtacagcctgatcagcacccccttcagcagcgagaacgccagcctggaggagaacaccaagccccccgaggagaccgagctgctgaacgagaacaaggagacctgcaaccccatcaacttcccctgggagaagctgaccagcttccagagactgatcctggtgaaggtgctgagacccgagagcctgaacaacagcgtgagaaagttcatcaccgagaagatgggcaacaagtacctgcagagaaccggcgtgaacctgaaggacgcctacaagggcagcaacgccagaacccccctgatcctgatccagacccacggcatcgacctgaccaacatcctgctgagattcgcccaggagctgaagggcaccacccaccacgtgaccatcatcagcctgggcagagaccaggccgccaaggccgaggacctgatcctgaaggccctgaccaagacccagcagtgggtgttcctgcagaactgccacctggccaccagcttcatgcccagactgtgcaccatcgtggagagcttcaacagccccaacgtgaccatcgaccccgagttcagactgtggctgagcagcaagagctacagcagcttccccatccccgtgctgaagaagggcctgaagatcgccgtggagagcccccagggcctgaagagcaacctgctgcagaccttcggctgcaccggcagcggcgaggtgaccgaggagatcttcgagaaccccgactgcggccagtggtggaagaagctgctgttcagcctgtgcttcttcaacgccgtgatcaacgagagaaagaactacggcatcctgggctggaacatcgcctacaagttcaacagcagcgacctgggcgtggccatcaaggtgctggagaacagcctgagaggccagcccagcatcagctggcaggccctgagatacctgatcggcgaggtgatctacggcggcagagtgatcgacaactgggacaagagatgcctgaagaccctgctgtacaagttctgcaaccccgaggtgctgaaggacgacttcagcttcagcagaagcgccagcatcaaggactacatccacatcatccagagcctgcccgacgacgacctgcccgaggtgctgggcatccaccccgaggccatcagaagctgctgggagacccagggcgagaagttcatcgagaacctgatcgccatgcagcccaagaccaccaccgccaacctgatgatcagacccgagcagagcaaggacgagctggtgatggagatcctgagcgacctgctgaagagactgcccctgaccgtggagaaggaggagatcgccgtgggcacccccagcaccctgaagagcatgatgagcagcagcatctgggagagcctgagcaagaacctgaaggaccacgaccccctgatccactgcgtgctgctgaccttcctgaagcaggagatcaagagattcgacaagctgctgttcgtgatccacaagagcctgaaggacctgcagctggccatcaagggcgagatcatcctgacccaggagctggaggagatcttcaacagcttcctgaacatgagagtgcccaccctgtggcagaagcacgcctacagaagctgcaagcccctgagcagctggatcgacgacctgatccagagactgaacttcttcaacacctgggccaaggtggcctacaccgccatccagagaagatacatgagattcgtgaccgtgtggaagcagagcatccccagcaccagccagaagtgcaagcaccccgaggacagcgagaacaacttcttcgagggcttccccagcagatactggctgcccgccttcttcttcccccaggccttcctggccgccgtgctgcaggactacggcagaagcagaggcatcgccgtggacgccctgaccttcacccaccacgtgatcagcaacaccaccgacaaggacgagaagttcagcgtgttcatgcccaagaagctgaacatcgtgagaagagccttcaagggcagcgccagcagccacaccggcgtgtacatcttcggcctgttcatcgagggcgccagatggaacagagagcagaagatcctggaggacagcctgcccctggagatgtgctgcgacttccccgacatctacttcctgcccaccaagatcagcaccaagacccccaacgccagcaaccagaccgacagcgagctgtacgccttcgagtgccccgtgtaccagacccccgagagaagcagaatcctggccaccaccggcctgcccaccaacttcctgaccagcgtgtacctgagcaccaagaagccccccagccactggatcaccatgagagtggccctgctgtgcgagaagaacgagaagtag

SEQ ID NO: 79838 - DNA, 13548 bp, Artificial Sequence; identical to SEQ ID NO: 79837
  Description of Artificial Sequence: Synthetic coding sequence

SEQ ID NO: 79839 - DNA, 10524 bp, Artificial Sequence
  Description of Artificial Sequence: Synthetic coding sequence
atgggcagaagaagccagtggatctgggccatgagatgccagatgctggtgcccgtgctgagcctgcacatcggcctggccagagccctgggctgcggctgcatcgccagcaagatcgagtgcctgatcagatgcaacgcccccttccccctgctggacgccgtgggcagcgtggccagccaggagctgcagagcctgaccggcaccgtgggcgtgaccagcggcgccgccgcctaccccagatggaacctggccagagccagagcccccccccacctgcccggcacccaggaccccctgagaagagtgagagaccccacccccatcgtggccagcagccccggcagaagaagaggcagctggagcggcggctacggccaggaggccagcgagcccggcgtggtgggcctgtgctgcgccgtgctgcccatccaccccagcctggccctggccggcgtgggcggccccgacctgagaagattccaggagggcccccagagacccagcgaccacggcgccgccgagaagcacatggagaccttcatccccatcgacctgaccaccgagaaccaggagatggacaaggaggagaccaagaccaagcccagactgctgagatacgaggagaagaagtacgaggacgtgaagcccctggagacccagcccgccgagatcgccgagaaggagaccctggagtacaagaccgtgagaaccttcagcgagagcctgaagagcgagaagaccgaggagcccaaggacgacgacgtgatcagaaacatcatcagactgagagagaagctgggctggcagaccatcctgccccagcacagcctgaagtacggcagcagcaagatcgccatccagaagatcaccctgaagaagcccctggaggacgacggcgagttcgtgtactgcctgcccagaaagagccccaagagcctgtacaacccctacgacctgcaggtggtgagcgcccacaccgccaagcactgcaaggagttctgggtgatcaccgccagcttcatcagcaagctggacagcagcagaacctacagcctggacgagttctgcgaggagcagctgcagcaggccacccaggccctgaagcagctggaggacatcagaaacaaggccatcagcgagatgaagagcaccttcctgaaggtggccgagaagaacgagatcaaggagtacttcgagagcaagctgagcgaggacgacaccacccacttcaagctgcccaagtacagaagactgctggagaccttcttcaagttcgtgatgctggtggactacatcttccaggagctgatcagacagctgatgaacaccgccgtgaccctgctgctggagctgttcaacggcagcgccggcatgcccttcagcgtggagaagaagaacgagaacctgatcagaaccttcaaggacaacagcttccccaccggcaagaccaccaacgactgcgaggagctggtggacaacagcaagctgcacgccatcagcgtgcagaagagcgaggtgaagaccgacaccgacatcaacgagatcctgaacagcgtggaggtgggcaaggacctgagaaagacctacgcccccatcttcgaggtgaacctgtgcctgagaatccccgccgagagcgacagcagcgagaacagcaaggagaacttccacgagagcgaccagtgccccgaggagtgcgtgatgttcgaggacgagatgagcgagaacaaggacaactgcgtgaagaagcacagcagcgaggagctgctgcccaaggccaagaagagcaaggagatcagctacaacctggaggacatcatcagcgccaccatcacccccctgtgccaggacccccagctgagcatcttcatcgacctggtgagcatcatggacctgcccaacaagaccggcagcatcatccactacaaggagcagaccagatggcccgactgccacatcctgttcgagaccgaccccgcctaccagaacatcatcgtgaacctgctgaccatcatcggcaacagcatgggcctggtgaacgcctacagccacaagttcatcaagtactgcaccatgaccgagaaggccaagatcatgagcatgaagatcagcagcatgggcgagctgaccagcaaggagttcgaggccatcctgaacagattcagaaactacttcagacacatcgtgaacatggccatcgagaagagaatcggcatcttcaacgtggtggtggagagcagcctgcagcagctggagtgcgaccccaccgagatcgaggagttcctggagcacttcatcttcctgaacgccatcagcagcaagatcagcaagctggagaaggagttcctgaccatgagccagctgtacagcgtggccaagcaccaccagatccacatcagcgaggagcagatcgccatcttccaggtgctgctgctgaagttcagccagctgaagagcagcatgaagctgagcaagatcaacaaggacaccgccatcaccaagttcagagacaacctggaggcctgcatcagcggcctgcacgtggacgtgggcaacctgaaggccaagatcagaacccccctgctgctgtgcgccggcacccaggtgagcaccgccatggagatgatccagaccctgagcggcgaggccgccagcctgaccaacaaggccaaggcctacagccactaccaggactgcttcagcgacagccagagccacatgcacagcgtgaacgtggaggagatcacccagatcgtgctgagcgagatcagcgacatcgagggcgacctgaccctgagaaagaagctgtgggaggcccaggaggagtggaagagagccagctgggagtggagaaacagcagcctgcagagcatcgacgtggagagcgtgcagagaaacgtgagcaagctgatgcacatcatcagcgtgctggagaaggagatctacagcatcttcatcatccccagcatcgacgacatcagcgcccagctggaggagagccaggtgatcctggccaccatcaagggcagcccccacatcggccccatcaagagccagatcatgttctacaacgactgcgtgaagagcttcgtgagcagctacagcagagagaagctggagaaggtgcacgccggcctgatgtgccacctggaggaggtggccgacctggtggtgctggacaccagcaacagcagaaccaaggccatcctgggcgccctgctgatcctgtacgtgcactgcagagacatcgtgatcaacctgctgctgaagaacatcttcaacgccgaggacttcgagtggaccagacacctgcagtacaagtggaacgagaagcagaagctgtgctacgtgagccagggcaacgccagcttcacctacggctacgagtacctgggctgcaccagcagactggtgatcacccccctgaccgacagatgctggctgaccctgatggaggccctgcacctgaacctgggcggctgccccgccggccccgccggcaccggcaagaccgagaccgtgaaggacctggccaagtgcgccctgttcgccttcaagtgcaacaccgccctgatcaagctgcccaacagcctgatcgtgctgacctgcttcggcctggagaagaccgtgctggtgatgaacaccgtgatgagcttcagattcgtgctggagggcaaggagatcagaatcaacatgagctgcgccgtgttcatcaccatgaaccccagatacggcggcggcgtggagctgcccgacaacctgaagagcctgttcagacccgtggccatgatggtgccccactaccagatgatcgccgagatcatcctgttcagcttcggcttcaagagcgccaacagcctgagcggcaagctgaccaacctgtacgagctggccagaaagcagctgagccagcaggaccactacaacttcggcctgagaagcctgaagatcgtgctgatcatggccggcaccaagaagagagagttcaagtgcgacaccagcgacagcctgagcgaggccgacgagaccctgatcgtgatcgaggccatcagagaggccagcctgcccaagtgcccccccgaggacgtgcccctgttcgagaacatcatcggcgacatcttccccgaggtgaccgtgctgaaggtgaaccagctggccctggagaaggtgatctacaccgccacccagcagctgggcctgcagaactggagcagccagaaggagaagatcatccagttctacaaccagctgcaggtgtgcgtgggcgtgatgctggtgggccccaccggcggcggcaagaccaccgtgagaagaatcctggagaaggccctgaccctgctgcccatcgccgacttcctgagcgtggccgagagaaagagcgccagcaagatcagcgagagaaagggcaaggtggacatctgcgtgctgaaccccaagtgcgtgaccctgagcgagctgtacggccagctggaccccaacaccatggagtggaccgacggcctgctgagcgccaccatcagaagctacgtgtacttcaacacccccaagaacaccaagaaggacatcgacctgagactgaagagcagaatcagcgacctgagcaacgtgttcaagctggacagcagcgacaccaccgagaccgacgacaacatcttcgaggagatcgagaaggtggtgaagatccccgagaaccacaacttcgactggcagtggatcatcctggacggccccgtggacaccttctgggtggagaacctgaacagcgtgctggacgacaccagaaccctgtgcctggccaacagcgagagaatcgccctgaccaacaagatcagagtgatcttcgaggtggacaacctgagccaggccagccccgccaccgtgagcagatgcgccatggtgtacatggaccccgtggacctgggctgggagccctacgtgaagagctggctgctgaagaccagcaagatcatcagccagagcggcgtggactgcctggagttcatgatcaagaacagcgtgaccgacggcctgcagttcatcagaaacagacagaagttccagccctaccccatggaggacatcaccgtggtgatcaccctgtgcagaatcctggacgccttcttcgacttcatgggcaagaacggcggcttcgagcagagcgacgacctgaacgacaccagcagcaaggaggccaacagccagagagagagcgtgaccttcaaggacatcgagaagagagacgagaacacctggtaccccgagaagaaccccgacaagctgaccaagatcatccagaagctgttcgtgttcgccttcacctgggccttcggcggcgccctgaacagagaggacgagcacagagagaacatccccttctgccccagcctggagcccgacagcctggccaaggtgacctacgacttcgacaagctggtgcacgagctgttcggcaacagcagccaggtgggcatcaacctgcccaccggcgagtgcagcatcttcggctacttcgtggacatcgagcagtgcgagttcatcccctggagcgacctggtgcccaacgaccagaccctgatccagagagacaaccccaccaagaagcccgaggtgagaaccaacaagaagctgctgaagaacaacgaccacaagggcgtggtggtgagcaccatcaacttcagcaccaacgtgaccgccgccaagaccaaggagatgatcctgaagaagctgatcagaagaaccaaggacaccctgggcgcccccaagaacaacagaatcctgatcttcatcgacgacatgaacatgcccgtgagcgacatgtacggcgcccagccccccctggagctgatcagacagctgctggacctgggcggcgtgtacgacaccgagaagaacacctggaagaacatccaggacctgagcatcgtggccgcctgcgtgcccgtggtgaacgacatcagccccagactgctgaagcacttcagcatgctggtgctgccccaccccagccaggacatcctgtgcaccatcttccagatcggcatcgacggctgcggcaagaagacctgcgccaccctggcctgctacctgaccgacaacaagctgtacagagtgcccatcagccacaagtgcgcctacatcgagttcaaggaggtgttcaagaaggtgttcatccacgccggcctgaagggcaagcccaccgtgctgatggtgcccaacctgaacatcgagcaggacagcttcctggaggacctgaactacatcatcagcagcggcagaatccccgacctgttcgagaacgtggagctggacagcatcgccatgaagatcagatacctgaccgagcagagcggccacatggacaacagacagagcctgctgagcttcttccagaagagaatctacaagaacctgcacatcttcgtgatcatgagccccgagggccccagcttcagacagaactgcagagtgtaccccagcatgatcagcagctgcaccatcgactggtacgagagatggcccgaggaggccctgctgatcgtggccaacagcttcctgaaggagaaggtgaacttcgagaacagagagaacctgaaggagaagctggcccccacctgcgtgcagatccacaagagcatgaaggacctgaacagaaagtacttcgaggagaccggcagattctactacaccacccccaacagctacctgcagttcatggagaccttcgcccacatcctgagagccagagaggaggagatgcagaccaagagagacagattccacatgggcctgagcaccatcctggaggccaccaccctggtgaccgagatgcaggaggagctgctgatcctgggcccccaggtggagcagaagaccaaggagaccgagaccctgatggagaagctgagaaaggacagccaggtggtggagaaggtgcagatgctggtgaagcaggacgaggagatcgtggccgaggaggtgagaatcgtggaggactacgcccagaagaccgccaacgagctgaagagcgtgctgcccgccttcgacaaggccatcgtggccctgaacgccctggacaaggccgacgtggccgagctgagagtgtacaccagaccccccttcctggtgctgaccgtgatgaacgccgtgtgcatcctgctgcagaagaagcccaactgggccaccgccaagctgctgctgagcgagaccggcttcctgaagaagctgatcaacctggacaaggacagcatccccgacaaggtgttcgtgaagctgaagaagatcgtgaccctgcccgacttcaacccccacaagatcagcctggtgagcgtggcctgctgcagcctgtgccagtgggtgatcgccctgaacaactaccacgaggtgcagaaggtggtgggccccaagcagatccaggtggccgaggcccagaacgtgctgaagatcgccagacagagactggccgagaagcagagaggcctgcagctgatcagcagatggcacaaccagggcctgccccacggccagtacagcgtggagaacgccatcctgatcaagaacggccagcagtggcccctgctgatcgacccccacagacaggcccacaagtggatcagacagatggagggcagcagactgcagaagctgagcatcgaggacagcaactacaccaagaagatcgagaacgccatgaagaccggcggcagcgtgctgctgcagagctgccaggccagcacctggagaaagaagctgtacctgagcaccgagatcgacaacccccacttcctgcccagcgtgtacaacttcgtgaccatgatcaacttcaccgtgaccttccagggcctgcaggaccagctgctgagcaccgtggtgacccacgaggtgccccacctggaggaccagagaagcaagctgctggagagcatcagcctggacgccatcaccctggaggagctggaggagaagaccctgaacctgctgcagaaggccctgggcagcatcctggacgacgacaagatcgtggacaccctgagaaagagcaagatgaccagcaacgagatcagcaagagaatcgaggccaccaagaaggccgagagcgagatccaggccatcagaaagaactacctgcccatcgccaccagaggcgccctgctgtacttcctggtggccgacctgacccagatcaactacatgtaccagttcagcctggactggttccaccaggtgttcgtgagcagcgtggtgagcaagagcaaggagcaggagcacagcttcaagagagagaaggtgagccccaaggaggtgcacgagttcatcagcatcagcaaggagcccaacctggagaacgagaagaacctgctggacaagcacatcaagagcgccatcgacatgctgaccaagagcatcttcaaggtggtgagcagcgccctgttcaacgaggacaagctgtgcttcagcttcagactgtgcaccgtgatcatgcagaacaacgccaacggcaacctgatccaggacgacatcggcttcctgcccgaggaggagtggaacatcttcctgtacagcggcatcctgatcaacatcaagagcgccctgagccagagcagactgaccagcaccttcgagatcggcgagagccagcacctgcagtggctgagcgacagcagatggagacagtgccagtacgtgagcacccacctggagcccttcagcctgctgtgcaagagcctgctgagcaacgtgagccagtgggacaccttcaagaacagcaaggccgtgtacagcctgatcagcacccccttcagcagcgagaacgccagcctggaggagaacaccaagccccccgaggagaagcacaccttctgcctgctgctgagagccatcaaccacaccggcaccgacctgggccccgtgggcagaggccagtggctgaccagcaccgcctgcgacagacacaccgacgtgtgcagcttcagcttcgccctgaacgacggcgtgcccgacgtggagcacgtgcaggacatcttctacggccactgcgtggacaagtaccacgtgaaggtgctgagacccgagagcctgaacaacagcgtgagaaagttcatcaccgagaagatgggcaacaagtacctgcagagaaccggcgtgaacctgaaggacgcctacaagggcagcaacgccagaacccccctgatcctgatccagacccacggcagcgccagcatcaaggactacatccacatcatccagagcctgcccgacgacgacctgcccgaggtgctgggcatccaccccgaggccatcagaagctgctgggagacccagggcgagaagttcatcgagaacctgatcgccatgcagcccaagaccaccaccgccaacctgatgatcagacccgagcagagcaaggacgagctggtgatggagatcctgagcgacctgctgaagagactgcccctgaccgtggagaaggaggagatcgccgtgggcacccccagcaccctgaagagcatgatgagcagcagcatctgggagagcctgagcaagaacctgaaggaccacgaccccctgatccactgcgtgctgctgaccttcctgaagcaggagatcaagagattcgacaagctgctgttcgtgatccacaagagcctgaaggacctgcagctggccatcaagggcgagatcatcctgacccaggagctggaggagatcttcaacagcttcctgaacatgagagtgcccaccctgtggcagaagcacgcctacagaagctgcaagcccctgagcagctggatcgacgacctgatccagagactgaacttcttcaacacctgggccaaggtggcctacaccgccatccagagaagatacatgagattcgtgaccgtgtggaagcagagcatccccagcaccagccagaagtgcaagcaccccgaggacagcgagaacaacttcttcgagggcttccccagcagatactggctgcccgccttcttcttcccccaggccttcctggccgccgtgctgcaggactacggcagaagcagaggcatcgccgtggacgccctgaccttcacccaccacgtgatcagcaacaccaccgacaaggacgagaagttcagcgtgttcatgcccaagaagctgaacatcgtgagaagagccttcaagggcagcgccagcagccacaccggcgtgtacatcttcggcctgttcatcgagggcgccagatggaacagagagcagaagatcctggaggacagcctgcccctggagatgtgctgcgacttccccgacatctacttcctgcccaccaagatcagcaccaagacccccaacgccagcaaccagaccgacagcgagctgtacgccttcgagtgccccgtgtaccagacccccgagagaagcagaatcctggccaccaccggcctgcccaccaacttcctgaccagcgtgtacctgagcaccaagaagccccccagccactggatcaccatgagagtggccctgctgtgcgagaagaacgagaagtag

SEQ ID NO: 79840 - DNA, 2619 bp, Artificial Sequence
  Description of Artificial Sequence: Synthetic coding sequence
atgagcagcaaggccgagaagaagcagagactgagcggcagaggcagcagccaggccagctggagcggcagagccaccagagccgccgtggccacccaggagcagggcaacgcccccgccgtgagcgagcccgagctgcaggccgagctgcccaaggaggagcccgagcccagactggagggcccccaggcccagagcgaggagagcgtggagcccgaggccgacgtgaagcccctgttcctgagcagagccgccctgaccggcctggccgacgccgtgtggacccaggagcacgacgccatcctggagcacttcgcccaggaccccaccgagagcatcctgaccatcttcatcgacccctgcttcggcctgaagctggagctgggcatgcccgtgcagacccagaaccagctggtgtacttcatcagacaggcccccgtgcccatcacctgggagaacttcgaggccaccgtgcagttcggcaccgtgagaggcccctacatccccgccctgctgagactgctgggcggcgtgttcgccccccagatcttcgccaacaccggctggcccgagagcatcagaaaccacttcgccagccacctgcacaagttcctggcctgcctgaccgacaccagatacaagctggagggccacaccgtgctgtacatccccgccgaggccatgaacatgaagcccgagatggtgatcaaggacaaggagctggtgcagagactggagaccagcatgatccactggaccagacagatcaaggagatgctgagcgcccaggagaccgtggagaccggcgagaacctgggccccctggaggagatcgagttctggagaaacagatgcatggacctgagcggcatcagcaagcagctggtgaagaagggcgtgaagcacgtggagagcatcctgcacctggccaagagcagctacctggcccccttcatgaagctggcccagcagatccaggacggcagcagacaggcccagagcaacctgaccttcctgagcatcctgaaggagccctaccaggagctggccttcatgaagcccaaggacatcagcagcaagctgcccaagctgatcagcctgatcagaatcatctgggtgaacagcccccactacaacaccagagagagactgaccagcctgttcagaaagatgagcaacgagatcatcagactgtgctgccacgccatcagcctggacagaatcttcgagggctacgtgagcagcagcaaggaggacctgcagggctgcatcctgtgctgccacgcctggaaggaccactacgtgcaggccgtgcagatgcacatccagttcagcagcagaggctgggtgctggaccagaccagcatcttcgcccaggtggacgccttcgtgcagagatgcaaggacctgatcgaggtgtgcgactgccagtaccacttcgccagatgggaggacggcaagcagggccccctgccctgcttcttcggcgcccagggcccccagatcaccagaaacctgctggagatcgaggacatcttccacaagaacctgcacaccctgagagccgtgagaggcggcatcctggacgtgaagaacacctgctggcacgaggactacaacaagttcagagccggcatcaaggacctggaggtgatgacccagaacctgatcaccagcgccttcgagctggtgagagacgtgccccacggcgtgctgctgctggacaccttccacagactggccagcagagaggccatcaagagaacctacgacaagaaggccgtggacctgtacatgctgttcaacagcgagctggccctggtgaacagagagagaaacaagaagtggcccgacctggagccctacgtggcccagtacagcggcaaggccagatgggtgcacatcctgagaagaagaatcgacagagtgatgacctgcctggccggcgcccacttcctgcccagaatcggcaccggcaaggagagcgtgcacacctaccagcagatggtgcaggccatcgacgagctggtgagaaagaccttccaggagtggaccagcagcctggacaaggactgcatcagaagactggacacccccctgctgagaatcagccaggagaaggccggcatgctggacgtgaacttcgacaagtacagaagccacctggcccccttcccctacacccccctgctgcagctgagccaggagttccacagccacctgctgacccccctgttcatcatcctgagcctgagccacaccatctgcctgctgagcagcttctacttcttcttcagcagcttcatcttcgtgagcccccacctgcccccctgctaccagcacttcaacttcaccacctacctgaagacccagcagaacaagaccatgatcggccaggccagatggctgacccccgtgatccccgccctgtgggaggccgaggtgggcgccagcctggagcccagaagcctgagaaccgcctgggccacctggcagaaccccgtgagcgccaagaacaccaagatcagctgggcctggtggcacaagcccgtggtgagcgccacctgggagggcgaggtgggcggcagccccgagcccggcagacagagactgcagtag

SEQ ID NO: 79841 - DNA, 12591 bp, Artificial Sequence
  Description of Artificial Sequence: Synthetic coding sequence
atgagcagcaaggccgagaagaagcagagactgagcggcagaggcagcagccaggccagctggagcggcagagccaccagagccgccgtggccacccaggagcagggcaacgcccccgccgtgagcgagcccgagctgcaggccgagctgcccaaggaggagcccgagcccagactggagggcccccaggcccagagcgaggagagcgtggagcccgaggccgacgtgaagcccctgttcctgagcagagccgccctgaccggcctggccgacgccgtgtggacccaggagcacgacgccatcctggagcacttcgcccaggaccccaccgagagcatcctgaccatcttcatcgacccctgcttcggcctgaagctggagctgggcatgcccgtgcagacccagaaccagctggtgtacttcatcagacaggcccccgtgcccatcacctgggagaacttcgaggccaccgtgcagttcggcaccgtgagaggcccctacatccccgccctgctgagactgctgggcggcgtgttcgccccccagatcttcgccaacaccggctggcccgagagcatcagaaaccacttcgccagccacctgcacaagttcctggcctgcctgaccgacaccagatacaagctggagggccacaccgtgctgtacatccccgccgaggccatgaacatgaagcccgagatggtgatcaaggacaaggagctggtgcagagactggagaccagcatgatccactggaccagacagatcaaggagatgctgagcgcccaggagaccgtggagaccggcgagaacctgggccccctggaggagatcgagttctggagaaacagatgcatggacctgagcggcatcagcaagcagctggtgaagaagggcgtgaagcacgtggagagcatcctgcacctggccaagagcagctacctggcccccttcatgaagctggcccagcagatccaggacggcagcagacaggcccagagcaacctgaccttcctgagcatcctgaaggagccctaccaggagctggccttcatgaagcccaaggacatcagcagcaagctgcccaagctgatcagcctgatcagaatcatctgggtgaacagcccccactacaacaccagagagagactgaccagcctgttcagaaaggtgtgcgactgccagtaccacttcgccagatgggaggacggcaagcagggccccctgccctgcttcttcggcgcccagggcccccagatcaccagaaacctgctggagatcgaggacatcttccacaagaacctgcacaccctgagagccgtgagaggcggcatcctggacgtgaagaacacctgctggcacgaggactacaacaagttcagagccggcatcaaggacctggaggtgatgacccagaacctgatcaccagcgccttcgagctggtgagagacgtgccccacggcgtgctgctgctggacaccttccacagactggccagcagagaggccatcaagagaacctacgacaagaaggccgtggacctgtacatgctgttcaacagcgagctggccctggtgaacagagagagaaacaagaagtggcccgacctggagccctacgtggcccagtacagcggcaaggccagatgggtgcacatcctgagaagaagaatcgacagagtgatgacctgcctggccggcgcccacttcctgcccagaatcggcaccggcaaggagagcgtgcacacctaccagcagatggtgcaggccatcgacgagctggtgagaaagaccttccaggagtggaccagcagcctggacaaggactgcatcagaagactggacacccccctgctgagaatcagccaggagaaggccggcatgctggacgtgaacttcgacaagagcctgctgatcctgttcgccgagatcgactactgggagagactgctgttcgagaccccccactacgtggtgaacgtggccgagagagccgaggacctgagaatcctgagagagaacctgctgctggtggccagagactacaacagaatcatcgccatgctgagccccgacgagcaggccctgttcaaggagagaatcagactgctggacaagaagatccaccccggcctgaagaagctgcactgggccctgaagggcgccagcgccttcttcatcaccgagtgcagaatccacgccagcaaggtgcagatgatcgtgaacgagttcaaggccagcaccctgaccatcggctggagagcccaggagatgagcgagaagctgctggtgagaatcagcggcaagagagtgtacagagacctggagttcgaggaggaccagagagagcacagagccgccgtgcagcagaagctgatgaacctgcaccaggacgtggtgaccatcatgaccaacagctacgaggtgttcaagaacgacggccccgagatccagcagcagtggatgctgtacatgatcagactggacagaatgatggaggacgccctgagactgaacgtgaagtggagcctgctggagctgagcaaggccatcaacggcgacggcaagaccagccccaaccccctgttccaggtgctggtgatcctgaagaacgacctgcagggcagcgtggcccaggtggagttcagccccaccctgcagaccctggccggcgtggtgaacgacatcggcaaccacctgttcagcaccatcagcgtgttctgccacctgcccgacatcctgaccaagagaaagctgcacagagagcccatccagaccgtggtggagcaggacgaggacatcaagaagatccagacccagatcagcagcggcatgaccaacaacgccagcctgctgcagaactacctgaagacctgggacatgtacagagagatctgggagatcaacaaggacagcttcatccacagataccagagactgaacccccccgtgagcagcttcgtggccgacatcgccagatacaccgaggtggccaacaacgtgcagaaggaggagaccgtgaccaacatccagttcgtgctgctggactgcagccacctgaagttcagcctggtgcagcactgcaacgagtggcagaacaagttcgccaccctgctgagagagatggccgccggcagactgctggagctgcacacctacctgaaggagaacgccgagaagatcagcagacccccccagaccctggaggagctgggcgtgagcctgcagctggtggacgccctgaagcacgacctggccaacgtggagacccagatcccccccatccacgagcagttcgccatcctggagaagtacgaggtgcccgtggaggacagcgtgctggagatgctggacagcctgaacggcgagtgggtggtgttccagcagaccctgctggacagcaagcagatgctgaagaagcacaaggagaagttcaagaccggcctgatccacagcgccgacgacttcaagaagaaggcccacaccctgctggaggacttcgagttcaagggccacttcaccagcaacgtgggctacatgagcgccctggaccagatcacccaggtgagagccatgctgatggccatgagagaggaggagaacagcctgagagccaacctgggcatcttcaagatcgagcagccccccagcaaggacctgcagaacctggagaaggagctggacgccctgcagcagatctgggagatcgccagagactgggaggagaactggaacgagtggaagaccggcagattcctgatcctgcagaccgagaccatggagaccaccgcccacggcctgttcagaagactgaccaagctggccaaggagtacaaggacagaaactgggagatcatcgagaccaccagaagcaagatcgagcagttcaagagaaccatgcccctgatcagcgacctgagaaaccccgccctgagagagagacactgggaccaggtgagagacgagatccagagagagttcgaccaggagagcgagagcttcaccctggagcagatcgtggagctgggcatggaccagcacgtggagaagatcggcgagatcagcgccagcgccaccaaggagctggccatcgaggtggccctgcagaacatcgccaagacctgggacgtgacccagctggacatcgtgccctacaaggacaagggccaccacagactgagaggcaccgaggaggtgttccaggccctggaggacaaccaggtggccctgagcaccatgaaggccagcagattcgtgaaggccttcgagaaggacgtggaccactgggagagatgcctgagcctgatcctggaggtgatcgagatgatcctgaccgtgcagagacagtggatgtacctggagaacatcttcctgggcgaggacatcagaaagcagctgcccaacgagagcaccctgttcgaccaggtgaacagcaactggaaggccatcatggacagaatgaacaaggacaacaacgccctgagaagcacccaccaccccggcctgctggacaccctgatcgagatgaacaccatcctggaggacatccagaagagcctggacatgtacctggagaccaagagacacatcttccccagattctacttcctgagcaacgacgacctgctggagatcctgggccagagcagaaaccccgaggccgtgcagccccacctgaagaagtgcttcgacaacatcaagctgctgagaatccagaaggtgggcggccccagcagcaagtgggaggccgtgggcatgttcagcggcgacggcgagtacatcgacttcctgcacagcgtgttcctggagggccccgtggagagctggctgggcgacgtggagcagaccatgagagtgaccctgagagacctgctgagaaactgccacctggccctgagaaagttcctgaacaagagagacaagtgggtgaaggagtgggccggccaggtggtgatcaccgccagccagatccagtggaccgccgacgtgaccaagtgcctgctgaccgccaaggagagagccgacaagaagatcctgaaggtgatgaagaagaaccaggtgagcatcctgaacaagtacagcgaggccatcagaggcaacctgaccaagatcatgagactgaagatcgtggccctggtgaccatcgagatccacgccagagacgtgctggagaagctgtacaagagcggcctgatggacgtgaacagcttcgactggctgagccagctgagattctactgggagaaggacctggacgactgcgtgatcagacagaccaacacccagttccagtacaactacgagtacctgggcaacagcggcagactggtgatcacccccctgaccgacagatgctacatgaccctgaccaccgccctgcacctgcacagaggcggcagccccaagggccccgccggcaccggcaagaccgagaccgtgaaggacctgggcaaggccctgggcatctacgtgatcgtggtgaactgcagcgagggcctggactacaagagcatgggcagaatgtacagcggcctggcccagaccggcgcctggggctgcttcgacgagttcaacagaatcaacatcgaggtgctgagcgtggtggcccaccagatcctgtgcatcctgagcgccctggccgccggcctgacccacttccacttcgacggcttcgagatcaacctggtgtggagctgcggcatcttcatcaccatgaaccccggctacgccggcagaaccgagctgcccgagaacctgaagagcatgttcagacccatcgccatggtggtgcccgacagcaccctgatcgccgagatcatcctgttcggcgagggcttcggcaactgcaagatcctggccaagaaggtgtacaccctgtacagcctggccgtgcagcagctgagcagacaggaccactacgacttcggcctgagagccctgaccagcctgctgagatacgccggcaagaagagaagactgcagcccgacctgaccgacgaggaggtgctgctgctgagcatgagagacatgaacatcgccaagctgaccagcgtggacgcccccctgttcaacgccatcgtgcaggacctgttccccaacatcgagctgcccgtgatcgactacggcaagctgagagagaccgtggagcaggagatcagagacatgggcctgcagagcacccccttcaccctgaccaaggtgttccagctgtacgagaccaagaacagcagacacagcaccatgatcgtgggctgcaccggcagcggcaagaccgccagctggagaatcctgcaggccagcctgagcagcctgtgcagagccggcgaccccaacttcaacatcgtgagagagttccccctgaaccccaaggccctgagcctgggcgagctgtacggcgagtacgacctgagcaccaacgagtggaccgacggcatcctgagcagcgtgatgagaaccgcctgcgccgacgagaagcccgacgagaagtggatcctgttcgacggccccgtggacaccctgtggatcgagaacatgaacagcgtgatggacgacaacaaggtgctgaccctgatcaacggcgagagaatcgccatgcccgagcaggtgagcctgctgttcgaggtggaggacctggccatggccagccccgccaccgtgagcagatgcggcatggtgtacaccgactacgccgacctgggctggaagccctacgtgcagagctggctggagaagagacccaaggccgaggtggagcccctgcagagaatgttcgagaagctgatcaacaagatgctggccttcaagaaggacaactgcaaggagctggtgcccctgcccgagtacagcggcatcaccagcctgtgcaagctgtacagcgccctggccacccccgagaacggcgtgaaccccgccgacggcgagaactacgtgaccatggtggagatgaccttcgtgttcagcatgatctggagcgtgtgcgccagcgtggacgaggagggcagaaagagaatcgacagctacctgagagagatcgagggcagcttccccaacaaggacaccgtgtacgagtacttcgtggaccccaagatcagaagctggaccagcttcgaggacaagctgcccaagagctggagatacccccccaacgcccccttctacaagatcatggtgcccaccgtggacaccgtgagatacaactacctggtgagcagcctggtggccaaccagaaccccatcctgctggtgggccccgtgggcaccggcaagaccagcatcgcccagagcgtgctgcagagcctgcccagcagccagtggagcgtgctggtggtgaacatgagcgcccagaccaccagcaacaacgtgcagagcatcatcgagagcagagtggagaagagaaccaagggcgtgtacgtgcccttcggcggcaagagcatgatcaccttcatggacgacctgaacatgcccgccaaggacatgttcggcagccagccccccctggagctgatcagactgtggatcgactacggcttctggtacgacagaaccaagcagaccatcaagtacatcagagagatgttcctgatggccgccatgggcccccccggcggcggcagaaccgtgatcagccccagactgagaagcagattcaacatcatcaacatgaccttccccaccaagagccagatcatcagaatcttcggcaccatgatcaaccagaagctgcaggacttcgaggaggaggtgaagcccatcggcaacgtggtgaccgaggccaccctggacatgtacaacaccgtggtgcagagattcctgcccacccccaccaagatgcactacctgttcaacctgagagacatcagcaaggtgttccagggcatgctgagagccaacaaggacttccacgacaccaagagcagcatcaccagactgtggatccacgagtgcttcagagtgttcagcgacagactggtggacgccgccgacaccgaggccttcatgggcatcatcagcgacaagctgggcagcttcttcgacctgaccttccaccacctgtgccccagcaagagaccccccatcttcggcgacttcctgaaggagcccaaggtgtacgaggacctgaccgacctgaccgtgctgaagaccgtgatggagaccgccctgaacgagtacaacctgagccccagcgtggtgcccatgcagctggtgctgttcagagaggccatcgagcacatcaccagaatcgtgagagtgatcggccagcccagaggcaacatgctgctggtgggcatcggcggcagcggcagacagagcctggccagactggccagcagcatctgcgactacaccaccttccagatcgaggtgaccaagcactacagaaagcaggagttcagagacgacatcaagagactgtacagacaggccggcgtggagctgaagaccaccagcttcatcttcgtggacacccagatcgccgacgagagcttcctggaggacatcaacaacatcctgagcagcggcgaggtgcccaacctgtacaagcccgacgagttcgaggagatccagagccacatcatcgaccaggccagagtggagcaggtgcccgagagcagcgacagcctgttcgcctacctgatcgagagagtgcagaacaacctgcacatcgtgctgtgcctgagccccatgggcgaccccttcagaaactggatcagacagtaccccgccctggtgaactgcaccaccatcaactggttcagcgagtggccccaggaggccctgctggaggtggccgagaagtgcctgatcggcgtggacctgggcacccaggagaacatccacagaaaggtggcccagatcttcgtgaccatgcactggagcgtggcccagtacagccagaagatgctgctggagctgagaagacacaactacgtgacccccaccaagtacctggagctgctgagcggctacaagaagctgctgggcgagaagagacaggagctgctggcccaggccaacaagctgagaaccggcctgttcaagatcgacgagaccagagagaaggtgcaggtgatgagcctggagctggaggacgccaagaagaaggtggccgagttccagaagcagtgcgaggagtacctggtgatcatcgtgcagcagaagagagaggccgacgagcagcagaaggccctggagagcctgaacaagaaggacatcggcgagatcaagagctacggcagaccccccgcccaggtggagatcgtgatgcaggccgtgatgatcctgagaggcaacgagcccacctgggccgaggccaagagacagctgggcgagcagaacttcatcaagagcctgatcaacttcgacaaggacaacatcagcgacaaggtgctgaagaagatcggcgcctactgcgcccagcccgacttccagcccgacatcatcggcagagtgagcctggccgccaagagcctgtgcatgtgggtgagagccatggagctgtacggcagactgtacagagtggtggagcccaagagaatcagaatgaacgccgccctggcccagctgagagagaagcaggccgccctggccgaggcccaggagaagctgagagaggtggccgagaagctggagatgctgaagaagcagtacgacgagaagctggcccagaaggaggagctgagaaagaagagcgaggagatggagctgaagctggagagagccggcatgctggtgagcggcctggccggcgagaaggccagatgggaggagaccgtgcagggcctggaggaggacctgggctacctggtgggcgactgcctgctggccgccgccttcctgagctacatgggccccttcctgaccaactacagagacgagatcgtgaaccagatctggatcggcaagatctgggagctgcaggtgccctgcagccccagcttcgccatcgacaacttcctgtgcaaccccaccaaggtgagagactggaacatccagggcctgcccagcgacgccttcagcaccgagaacggcatcatcgtgaccagaggcaacagatgggccctgatgatcgacccccaggcccaggccctgaagtggatcaagaacatggagggcggccagggcctgaagatcatcgacctgcagatgagcgactacctgagaatcctggagcacgccatccacttcggctaccccgtgctgctgcagaacgtgcaggagtacctggaccccaccctgaaccccatgctgaacaagagcgtggccagaatcggcggcagactgctgatgagaatcggcgacaaggaggtggagtacaacaccaacttcagattctacatcaccaccaagctgagcaacccccactacagccccgagaccagcgccaagaccaccatcgtgaacttcgccgtgaaggagcagggcctggaggcccagctgctgggcatcgtggtgagaaaggagagacccgagctggaggagcagaaggacagcctggtgatcaacatcgccgccggcaagagaaagctgaaggagctggaggacgagatcctgagactgctgaacgaggccaccggcagcctgctggacgacgtgcagctggtgaacaccctgcacaccagcaagatcaccgccaccgaggtgaccgagcagctggagaccagcgagaccaccgagatcaacaccgacctggccagagaggcctacagaccctgcgcccagagagccagcatcctgttcttcgtgctgaacgacatgggctgcatcgaccccatgtaccagttcagcctggacgcctacatcagcctgttcatcctgagcatcgacaagagccacagaagcaacaagctggaggacagaatcgactacctgaacgactaccacacctacgccgtgtacagatacacctgcagaaccctgttcgagagacacaagctgctgttcagcttccacatgtgcgccaagatcctggagaccagcggcaagctgaacatggacgagtacaacttcttcctgagaggcggcgtggtgctggacagagagggccagatggacaacccctgcagcagctggctggccgacgcctactgggacaacatcaccgagctggacaagctgaccaacttccacggcctgatgaacagcttcgagcagtaccccagagactggcacctgtggtacaccaacgccgcccccgagaaggccatgctgcccggcgagtgggagaacgcctgcaacgagatgcagagaatgctgatcgtgagaagcctgagacaggacagagtggccttctgcgtgaccagcttcatcatcaccaacctgggcagcagattcatcgagccccccgtgctgaacatgaagagcgtgctggaggacagcacccccagaagccccctggtgttcatcctgagccccggcgtggaccccaccagcgccctgctgcagctggccgagcacatgggcatggcccagagattccacgccctgagcctgggccagggccaggcccccatcgccgccagactgctgagagagggcgtgacccagggccactgggtgttcctggccaactgccacctgagcctgagctggatgcccaacctggacaagctggtggagcagctgcaggtggaggacccccaccccagcttcagactgtggctgagcagcatcccccaccccgacttccccatcagcatcctgcaggtgagcatcaagatgaccaccgagccccccaagggcctgaaggccaacatgaccagactgtaccagctgatgagcgagccccagttcagcagatgcagcaagcccgccaagtacaagaagctgctgttcagcctgtgcttcttccacagcgtgctgctggagagaaagaagttcctgcagctgggctggaacatcatctacggcttcaacgacagcgacttcgaggtgagcgagaacctgctgagcctgtacctggacgagtacgaggagaccccctgggacgccctgaagtacctgatcgccggcatcaactacggcggccacgtgaccgacgactgggacagaagactgctgaccacctacatcaacgactacttctgcgaccagagcctgagcacccccttccacagactgagcgccctggagacctacttcatccccaaggacggcagcctggccagctacaaggagtacatcagcctgctgcccggcatggacccccccgaggccttcggccagcaccccaacgccgacgtggccagccagatcaccgaggcccagaccctgttcgacaccctgctgagcctgcagccccagatcacccccaccagagccggcggccagaccagagaggagaaggtgctggagctggccgccgacgtgaagcagaagatccccgagatgatcgactacgagggcacccagaagctgctggccctggaccccagccccctgaacgtggtgctgctgcaggagatccagagatacaacaccctgatgcagaccatcctgttcagcctgaccgacctggagatccccagctgcgtgagccacaagagcgagagagtggtgctggagctgagcgccgtgaagcaccccagacagtag

SEQ ID NO: 79842 - DNA, 13284 bp, Artificial Sequence; identical to SEQ ID NO: 79824
  Description of Artificial Sequence: Synthetic coding sequence

SEQ ID NO: 79843 - DNA, 12351 bp, Artificial Sequence
  Description of Artificial Sequence: Synthetic coding sequence
atgggcgccaccggcagactggagctgaccctggccgcccccccccaccccggccccgccttccagagaagcaaggccagagagacccagggcgaggaggagggcagcgagatgcagatcgccaagagcgacagcatccaccacatgagccacagccagggccagcccgagctgccccccctgcccgccagcgccaacgaggagcccagcggcctgtaccagaccgtgatgagccacagcttctacccccccctgatgcagagaaccagctggaccctggccgcccccttcaaggagcagcaccaccacagaggccccagcgacagcatcgccaacaactacagcctgatggcccaggacctgaagctgaaggacctgctgaaggtgtaccagcccgccaccatcagcgtgcccagagacagaaccggccagggcctgcccagcagcggcaacagaagcagcagcgagcccatgagaaagaagaccaagttcagcagcagaaacaaggaggacagcaccagaatcaagctggccttcaagaccagcatcttcagccccatgaagaaggaggtgaagaccagcctgaccttccccggcagcagacccatgagccccgagcagcagctggacgtgatgctgcagcaggagatggagatggagagcaaggagaagaagcccagcgagagcgacctggagagatactactactacctgaccaacggcatcagaaaggacatgatcgcccccgaggagggcgaggtgatggtgagaatcagcaagctgatcagcaacaccctgctgaccagccccttcctggagcccctgatggtggtgctggtgcaggagaaggagaacgactactactgcagcctgatgaagagcatcgtggactacatcctgatggaccccatggagagaaagagactgttcatcgagagcatccccagactgttcccccagagagtgatcagagcccccgtgccctggcacagcgtgtacagaagcgccaagaagtggaacgaggagcacctgcacaccgtgaaccccatgatgctgagactgaaggagctgtggttcgccgagttcagagacctgagattcgtgagaaccgccgagatcctggccggcaagctgcccctgcagccccaggagttctgggacgtgatccagaagcactgcctggaggcccaccagaccctgctgaacaagtggatccccacctgcgcccagctgttcaccagcagaaaggagcactggatccacttcgcccccaagagcaactacgacagcagcagaaacatcgaggagtacttcgccagcgtggccagcttcatgagcctgcagctgagagagctggtgatcaagagcctggaggacctggtgagcctgttcatgatccacaaggacggcaacgacttcaaggagccctaccaggagatgaagttcttcatcccccagctgatcatgatcaagctggaggtgagcgagcccatcatcgtgttcaaccccagcttcgacggctgctgggagctgatcagagacagcttcctggagatcatcaagaacagcaacggcatccccaagctgaagtacatccccctgaagttcagcttcaccgccgccgccgccgacagacagtgcgtgaaggccgccgagcccggcgagcccagcatgcacgccgccgccaccgccatggccgagctgaagggctacaacctgctgctgggcaccgtgaacgccgaggagaagctggtgagcgacttcctgatccagaccttcaaggtgttccagaagaaccaggtgggcccctgcaagtacctgaacgtgtacaagaagtacgtggacctgctggacaacaccgccgagcagaacatcgccgccttcctgaaggagaaccacgacatcgacgacttcgtgaccaagatcaacgccatcaagaagagaagaaacgagatcgccagcatgaacatcaccgtgcccctggccatgttctgcctggacgccaccgccctgaaccacgacctgtgcgagagagcccagaacctgaaggaccacctgatccagttccaggtggacgtgaacagagacaccaacaccagcatctgcaaccagtacagccacatcgccgacaaggtgagcgaggtgcccgccaacaccaaggagctggtgagcctgatcgagttcctgaagaagagcagcgccgtgaccgtgttcaagctgagaagacagctgagagacgccagcgagagactggagttcctgatggactacgccgacctgccctaccagatcgaggacatcttcgacaacagcagaaacctgctgctgcacaagagagaccaggccgagatggacctgatcaagagatgcagcgagttcgagctgagactggagggctaccacagagagctggagagcttcagaaagagagaggtgatgaccaccgaggagatgaagcacaacgtggagaagctgaacgagctgagcaagaacctgaacagagccttcgccgagttcgagctgatcaacaaggaggaggagctgctggagaaggagaagagcacctaccccctgctgcaggccatgctgaagaacaaggtgccctacgagcagctgtggagcaccgcctacgagttcagcatcaagagcgaggagtggatgaacggccccctgttcctgctgaacgccgagcagatcgccgaggagatcggcaacatgtggagaaccacctacaagctgatcaagaccctgagcgacgtgcccgcccccagaagactggccgagaacgtgaagatcaagatcgacaagttcaagcagtacatccccatcctgagcatcagctgcaaccccggcatgaaggacagacactggcagcagatcagcgagatcgtgggctacgagatcaagcccaccgagaccacctgcctgagcaacatgctggagttcggcttcggcaagttcgtggagaagctggagcccatcggcgccgccgccagcaaggagtacagcctggagaagaacctggacagaatgaagctggactgggtgaacgtgaccttcagcttcgtgaagtacagagacaccgacaccaacatcctgtgcgccatcgacgacatccagatgctgctggacgaccacgtgatcaagacccagaccatgtgcggcagccccttcatcaagcccatcgaggccgagtgcagaaagtgggaggagaagctgatcagaatccaggacaacctggacgcctggctgaagtgccaggccacctggctgtacctggagcccatcttcagcagcgaggacatcatcgcccagatgcccgaggagggcagaaagttcggcatcgtggacagctactggaagagcctgatgagccaggccgtgaaggacaacagaatcctggtggccgccgaccagcccagaatggccgagaagctgcaggaggccaacttcctgctggaggacatccagaagggcctgaacgactacctggagaagaagagactgttcttccccagattcttcttcctgagcaacgacgagctgctggagatcctgagcgagaccaaggaccccctgagagtgcagccccacctgaagaagtgcttcgagggcatcgccaagctggagttcaccgacaacctggagatcgtgggcatgatcagcagcgagaaggagaccgtgcccttcatccagaagatctaccccgccaacgccaagggcatggtggagaagtggctgcagcaggtggagcagatgatgctggccagcatgagagaggtgatcggcctgggcatcgaggcctacgtgaaggtgcccagaaaccactgggtgctgcagtggcccggccaggtggtgatctgcgtgagcagcatcttctggacccaggaggtgagccaggccctggccgagaacaccctgctggacttcctgaagaagagcaacgaccagatcgcccagatcgtgcagctggtgagaggcaagctgagcagcggcgccagactgaccctgggcgccctgaccgtgatcgacgtgcacgccagagacgtggtggccaagctgagcgaggacagagtgagcgacctgaacgacttccagtggatcagccagctgagatactactgggtggccaaggacgtgcaggtgcagatcatcaccaccgaggccctgtacggctacgagtacctgggcaacagccccagactggtgatcacccccctgaccgacagatgctacagaaccctgatgggcgccctgaagctgaacctgggcggcgcccccgagggccccgccggcaccggcaagaccgagaccaccaaggacctggccaaggccctggccaagcagtgcgtggtgttcaactgcagcgacggcctggactacaaggccatgggcaagttcttcaagggcctggcccaggccggcgcctgggcctgcttcgacgagttcaacagaatcgaggtggaggtgctgagcgtggtggcccagcagatcctgagcatccagcaggccatcatcagaaagctgaagaccttcatcttcgagggcaccgagctgagcctgaaccccacctgcgccgtgttcatcaccatgaaccccggctacgccggcagagccgagctgcccgacaacctgaaggccctgttcagaaccgtggccatgatggtgcccgactacgccctgatcggcgagatcagcctgtacagcatgggcttcctggacagcagaagcctggcccagaagatcgtggccacctacagactgtgcagcgagcagctgagcagccagcaccactacgactacggcatgagagccgtgaagagcgtgctgaccgccgccggcaacctgaagctgaagtaccccgaggagaacgagagcgtgctgctgctgagagccctgctggacgtgaacctggccaagttcctggcccaggacgtgcccctgttccagggcatcatcagcgacctgttccccggcgtggtgctgcccaagcccgactacgaggtgttcctgaaggtgctgaacgacaacatcaagaagatgaagctgcagcccgtgccctggttcatcggcaagatcatccagatctacgagatgatgctggtgagacacggctacatgatcgtgggcgaccccatgggcggcaagaccagcgcctacaaggtgctggccgccgccctgggcgacctgcacgccgccaaccagatggaggagttcgccgtggagtacaagatcatcaaccccaaggccatcaccatgggccagctgtacggctgcttcgaccaggtgagccacgagtggatggacggcgtgctggccaacgccttcagagagcaggccagcagcctgagcgacgacagaaagtggatcatcttcgacggccccgtggacgccatctggatcgagaacatgaacaccgtgctggacgacaacaagaagctgtgcctgatgagcggcgagatcatccagatgaacagcaagatgagcctgatcttcgagcccgccgacctggagcaggccagccccgccaccgtgagcagatgcggcatgatctacatggagccccaccagctgggctggaagcccctgaaggacagctacatggacaccctgcccagcagcctgaccaaggagcacaaggagctggtgaacgacatgttcatgtggctggtgcagccctgcctggagttcggcagactgcactgcaagttcgtggtgcagaccagccccatccacctggccttcagcatgatgagactgtacagcagcctgctggacgagatcagagccgtggaggaggaggagatggagctgggcgagggcctgagcagccagcagatcttcctgtggctgcagggcctgttcctgttcagcctggtgtggaccgtggccggcaccatcaacgccgacagcagaaagaagttcgacgtgttcttcagaaacctgatcatgggcatggacgacaaccaccccagacccaagagcgtgaagctgaccaagaacaacatcttccccgagagaggcagcatctacgacttctacttcatcaagcaggccagcggccactgggagacctggacccagtacatcaccaaggaggaggagaaggtgcccgccggcgccaaggtgagcgagctgatcatccccaccatggagaccgccagacagagcttcttcctgaagacctacctggaccacgagatccccatgctgttcgtgggccccaccggcaccggcaagagcgccatcaccaacaacttcctgctgcacctgcccaagaacacctacctgcccaactgcatcaacttcagcgccagaaccagcgccaaccagacccaggacatcatcatgagcaagctggacagaagaagaaagggcctgttcggcccccccatcggcaagaaggccgtggtgttcgtggacgacctgaacatgcccgccaaggaggtgtacggcgcccagccccccatcgagctgctgagacagtggatcgaccacggctactggttcgacaagaaggacaccaccagactggacatcgtggacatgctgctggtgaccgccatgggcccccccggcggcggcagaaacgacatcaccggcagattcaccagacacctgaacatcatcagcatcaacgccttcgaggacgacatcctgaccaagatcttcagcagcatcgtggactggcacttcggcaagggcttcgacgtgatgttcctgagatacggcaagatgctggtgcaggccaccaagaccatctacagagacgccgtggagaacttcctgcccacccccagcaagagccactacgtgttcaacctgagagacttcagcagagtgatccagggcgtgctgctgtgcccccacacccacctgcaggacgtggagaagtgcatcagactgtggatccacgaggtgtacagagtgttctacgacagactgatcgacaaggaggacagacaggtgttcttcaacatggtgaaggagaccaccagcaactgcttcaagcagaccatcgagaaggtgctgatccacctgagccccaccggcaagatcgtggacgacaacatcagaagcctgttcttcggcgactacttcaagcccgagagcgaccagaagatctacgacgagatcaccgacctgaagcagctgaccgtggtgatggagcactacctggaggagttcaacaacatcagcaaggcccccatgagcctggtgatgttcagattcgccatcgagcacatcagcagaatctgcagagtgctgaagcaggacaagggccacctgctgctggtgggcatcggcggcagcggcagacagagcgccgccaagctgagcaccttcatgaacgcctacgagctgtaccagatcgagatcaccaagaactacgccggcaacgactggagagaggacctgaagaagatcatcctgcaggtgggcgtggccaccaagagcaccgtgttcctgttcgccgacaaccagatcaaggacgagagcttcgtggaggacatcaacatgctgctgaacaccggcgacgtgcccaacatcttccccgccgacgagaaggccgacatcgtggagaagatgcagaccgccgccagaacccagggcgagaaggtggaggtgacccccctgagcatgtacaacttcttcatcgagagagtgatcaacaagatcagcttcagcctggccatgagccccatcggcgacgccttcagaaacagactgagaatgttccccagcctgatcaactgctgcaccatcgactggttccagagctggcccaccgacgccctggagctggtggccaacaagttcctggaggacgtggagctggacgacaacatcagagtggaggtggtgagcatgtgcaagtacttccaggagagcgtgaagaagctgagcctggactactacaacaagctgagaagacacaactacgtgacccccaccagctacctggagctgatcctgaccttcaagaccctgctgaacagcaagagacaggaggtggccatgatgagaaacagatacctgaccggcctgcagaagctggacttcgccgccagccaggtggccgtgatgcagagagagctgaccgccctgcagccccagctgatcctgaccagcgaggagaccgccaagatgatggtgaagatcgaggccgagaccagagaggccgacggcaagaagctgctggtgcaggccgacgagaaggaggccaacgtggccgccgccatcgcccagggcatcaagaacgagtgcgagggcgacctggccgaggccatgcccgccctggaggccgccctggccgccctggacaccctgaaccccgccgacatcagcctggtgaagagcatgcagaacccccccggccccgtgaagctggtgatggagagcatctgcatcatgaagggcatgaagcccgagagaaagcccgaccccagcggcagcggcaagatgatcgaggactactggggcgtgagcaagaagatcctgggcgacctgaagttcctggagagcctgaagacctacgacaaggacaacatcccccccctgaccatgaagagaatcagagagagattcatcaaccaccccgagttccagcccgccgtgatcaagaacgtgagcagcgcctgcgagggcctgtgcaagtgggtgagagccatggaggtgtacgacagagtggccaaggtggtggcccccaagagagagagactgagagaggccgagggcaagctggccgcccagatgcagaagctgaaccagaagagagccgagctgaagctggtggtggacagactgcaggccctgaacgacgacttcgaggagatgaacaccaagaagaaggacctggaggagaacatcgagatctgcagccagaagctggtgagagccgagaagctgatcagcggcctgggcggcgagaaggacagatggaccgaggccgccagacagctgggcatcagatacaccaacctgaccggcgacgtgctgctgagcagcggcaccgtggcctacctgggcgccttcaccgtggactacagagtgcagtgccagaaccagtggctggccgagtgcaaggacaaggtgatccccggcttcagcgacttcagcctgagccacaccctgggcgaccccatcaagatcagagcctggcagatcgccggcctgcccgtggacagcttcagcatcgacaacggcatcatcgtgagcaacagcagaagatgggccctgatgatcgacccccacggccaggccaacaagtggatcaagaacatggagaaggccaacaagctggccgtgatcaagttcagcgacagcaactacatgagaatgctggagaacgccctgcagctgggcacccccgtgctgatcgagaacatcggcgaggagctggacgccagcatcgagcccatcctgctgaaggccaccttcaagcagcagggcgtggagtacatgagactgggcgagaacatcatcgagtacagcagagacttcaagctgtacatcaccaccagactgagaaacccccactacctgcccgaggtggccgtgaaggtgtgcctgctgaacttcatgatcacccccctgggcctgcaggaccagctgctgggcatcgtggccgccaaggagaagcccgagctggaggagaagaagaaccagctgatcgtggagagcgccaagaacaagaagcacctgaaggagatcgaggacaagatcctggaggtgctgagcatgagcaagggcaacatcctggaggacgagaccgccatcaaggtgctgagcagcagcaaggtgctgagcgaggagatcagcgagaagcagaaggtggccagcatgaccgagacccagatcgacgagaccagaatgggctacaagcccgtggccgtgcacagcgccaccatcttcttctgcatcagcgacctggccaacatcgagcccatgtaccagtacagcctgacctggttcatcaacctgtacatgcacagcctgacccacagcaccaagagcgaggagctgaacctgagaatcaagtacatcatcgaccacttcaccctgagcatctacaacaacgtgtgcagaagcctgttcgagaaggacaagctgctgttcagcctgctgctgaccatcggcatcatgaagcagaagaaggagatcaccgaggaggtgtggtacttcctgctgaccggcggcatcgccctggacaacccctaccccaaccccgccccccagtggctgagcgagaaggcctgggccgagatcgtgagagccagcgccctgcccaagctgcacggcctgatggagcacctggagcagaacctgggcgagtggaagctgatctacgacagcgcctggccccacgaggagcagctgcccggcagctggaagttcagccagggcctggagaagatggtgatcctgagatgcctgagacccgacaagatggtgcccgccgtgagagagttcatcgccgagcacatgggcaagctgtacatcgaggcccccaccttcgacctgcagggcagctacaacgacagcagctgctgcgcccccctgatcttcgtgctgagccccagcgccgaccccatggccggcctgctgaagttcgccgacgacctgggcatgggcggcaccagaacccagaccatcagcctgggccagggccagggccccatcgccgccaagatgatcaacaacgccatcaaggacggcacctgggtggtgctgcagaactgccacctggccgccagctggatgcccaccctggagaagatctgcgaggaggtgatcgtgcccgagagcaccaacgccagattcagactgtggctgaccagctaccccagcgagaagttccccgtgagcatcctgcagaacggcatcaagatgaccaacgagccccccaagggcctgagagccaacctgctgagaagctacctgaacgaccccatcagcgaccccgtgttcttccagagctgcgccaaggccgtgatgtggcagaagatgctgttcggcctgtgcttcttccacgccgtggtgcaggagagaagaaacttcggccccctgggctggaacatcccctacgagttcaacgagagcgacctgagaatcagcatgtggcagatccagatgttcctgaacgactacaaggaggtgcccttcgacgccctgacctacctgaccggcgagtgcaactacggcggcagagtgaccgacgacaaggacagaagactgctgctgagcctgctgagcatgttctactgcaaggagatcgaggaggactactacagcctggcccccggcgacacctactacatccccccccacggcagctaccagagctacatcgactacctgagaaacctgcccatcaccgcccaccccgaggtgttcggcctgcacgagaacgccgacatcaccaaggacaaccaggagaccaaccagctgttcgagggcgtgctgctgaccctgcccagacagagcggcggcagcggcaagagcccccaggaggtggtggaggagctggcccaggacatcctgagcaagctgcccagagacttcgacctggaggaggtgatgaagctgtaccccgtggtgtacgaggagagcatgaacaccgtgctgagacaggagctgatcagattcaacagactgaccaaggtggtgagaagaagcctgatcaacctgggcagagccatcaagggccaggtgctgatgagcagcgagctggaggaggtgttcaacagcatgctggtgggcaaggtgcccgccatgtgggccgccaagagctaccccagcctgaagcccctgggcggctacgtggccgacctgctggccagactgaccttcttccaggagtggatcgacaagggcccccccgtggtgttctggatcagcggcttctacttcacccagagcttcctgaccggcgtgagccagaactacgccagaaagtacaccatccccatcgaccacatcggcttcgagttcgaggtgaccccccaggagaccgtgatggagaacaaccccgaggacggcgcctacatcaagggcctgttcctggagggcgccagatgggacagaaagaccatgcagatcggcgagagcctgcccaagatcctgtacgaccccctgcccatcatctggctgaagcccggcgagagcgccatgttcctgcaccaggacatctacgtgtgccccgtgtacaagaccagcgccagaagaggcaccctgagcaccaccggccacagcaccaactacgtgctgagcatcgagctgcccaccgacatgccccagaagcactggatcaacagaggcgtggccagcctgtgccagctggacaactag

SEQ ID NO: 79844 - DNA, 2262 bp, Artificial Sequence
  Description of Artificial Sequence: Synthetic coding sequence
atgggcgacatggactgcagcagccagaagatcgccaagagcgacagcatccaccacatgagccacagccagggccagcccgagctgccccccctgcccgccagcgccaacgaggagcccagcggcctgtaccagaccgtgatgagccacagcttctacccccccctgatgcagagaaccagctggaccctggccgcccccttcaaggagcagcaccaccacagaggccccagcgacagcatcgccaacaactacagcctgatggcccaggacctgaagctgaaggacctgctgaaggtgtaccagcccgccaccatcagcgtgcccagagacagaaccggccagggcctgcccagcagcggcaacagaagcagcagcgagcccatgagaaagaagaccaagttcagcagcagaaacaaggaggacagcaccagaatcaagctggccttcaagaccagcatcttcagccccatgaagaaggaggtgaagaccagcctgaccttccccggcagcagacccatgagccccgagcagcagctggacgtgatgctgcagcaggagatggagatggagagcaaggagaagaagcccagcgagagcgacctggagagatactactactacctgaccaacggcatcagaaaggacatgatcgcccccgaggagggcgaggtgatggtgagaatcagcaagctgatcagcaacaccctgctgaccagccccttcctggagcccctgatggtggtgctggtgcaggagaaggagaacgactactactgcagcctgatgaagagcatcgtggactacatcctgatggaccccatggagagaaagagactgttcatcgagagcatccccagactgttcccccagagagtgatcagagcccccgtgccctggcacagcgtgtacagaagcgccaagaagtggaacgaggagcacctgcacaccgtgaaccccatgatgctgagactgaaggagctgtggttcgccgagttcagagacctgagattcgtgagaaccgccgagatcctggccggcaagctgcccctgcagccccaggagttctgggacgtgatccagaagcactgcctggaggcccaccagaccctgctgaacaagtggatccccacctgcgcccagctgttcaccagcagaaaggagcactggatccacttcgcccccaagagcaactacgacagcagcagaaacatcgaggagtacttcgccagcgtggccagcttcatgagcctgcagctgagagagctggtgatcaagagcctggaggacctggtgagcctgttcatgatccacaaggacggcaacgacttcaaggagccctaccaggagatgaagttcttcatcccccagctgatcatgatcaagctggaggtgagcgagcccatcatcgtgttcaaccccagcttcgacggctgctgggagctgatcagagacagcttcctggagatcatcaagaacagcaacggcatccccaaggtggagagcgtgctgttccccgagctgaagggctacaacctgctgctgggcaccgtgaacgccgaggagaagctggtgagcgacttcctgatccagaccttcaaggtgttccagaagaaccaggtgggcccctgcaagtacctgaacgtgtacaagaagtacgtggacctgctggacaacaccgccgagcagaacatcgccgccttcctgaaggagaaccacgacatcgacgacttcgtgaccaagatcaacgccatcaagaagagaagaaacgagatcgccagcatgaacatcaccgtgcccctggccatgttctgcctggacgccaccgccctgaaccacgacctgtgcgagagagcccagaacctgaaggaccacctgatccagttccaggtggacgtgaacagagacaccaacaccagcatctgcaaccagtacagccacatcgccgacaaggtgagcgaggtgcccgccaacaccaaggagctggtgagcctgatcgagttcctgaagaagagcagcgccgtgaccgtgttcaagctgagaagacagctgagagacgccagcgagagactggagttcctgatggactacgccgacctgccctacgaggacatcaagctgaacagcaccctgttcctgtggcccgaccagatcgaggacatcttcgacaacagcagaaacctgctgctgcacaagagagaccaggccgagatggacctgatcaagagatacagagagagcctgggcctgagctggaagtag

SEQ ID NO: 79845 - DNA, 5664 bp, Artificial Sequence
  Description of Artificial Sequence: Synthetic coding sequence
atgggcgccaccggcagactggagctgaccctggccgcccccccccaccccggccccgccttccagagaagcaaggccagagagacccagggcgaggaggagggcagcgagatgcagatcgccaagagcgacagcatccaccacatgagccacagccagggccagcccgagctgccccccctgcccgccagcgccaacgaggagcccagcggcctgtaccagaccgtgatgagccacagcttctacccccccctgatgcagagaaccagctggaccctggccgcccccttcaaggagcagcaccaccacagaggccccagcgacagcatcgccaacaactacagcctgatggcccaggacctgaagctgaaggacctgctgaaggtgtaccagcccgccaccatcagcgtgcccagagacagaaccggccagggcctgcccagcagcggcaacagaagcagcagcgagcccatgagaaagaagaccaagttcagcagcagaaacaaggaggacagcaccagaatcaagctggccttcaagaccagcatcttcagccccatgaagaaggaggtgaagaccagcctgaccttccccggcagcagacccatgagccccgagcagcagctggacgtgatgctgcagcaggagatggagatggagagcaaggagaagaagcccagcgagagcgacctggagagatactactactacctgaccaacggcatcagaaaggacatgatcgcccccgaggagggcgaggtgatggtgagaatcagcaagctgatcagcaacaccctgctgaccagccccttcctggagcccctgatggtggtgctggtgcaggagaaggagaacgactactactgcagcctgatgaagagcatcgtggactacatcctgatggaccccatggagagaaagagactgttcatcgagagcatccccagactgttcccccagagagtgatcagagcccccgtgccctggcacagcgtgtacagaagcgccaagaagtggaacgaggagcacctgcacaccgtgaaccccatgatgctgagactgaaggagctgtggttcgccgagttcagagacctgagattcgtgagaaccgccgagatcctggccggcaagctgcccctgcagccccaggagttctgggacgtgatccagaagcactgcctggaggcccaccagaccctgctgaacaagtggatccccacctgcgcccagctgttcaccagcagaaaggagcactggatccacttcgcccccaagagcaactacgacagcagcagaaacatcgaggagtacttcgccagcgtggccagcttcatgagcctgcagctgagagagctggtgatcaagagcctggaggacctggtgagcctgttcatgatccacaaggacggcaacgacttcaaggagccctaccaggagatgaagttcttcatcccccagctgatcatgatcaagctggaggtgagcgagcccatcatcgtgttcaaccccagcttcgacggctgctgggagctgatcagagacagcttcctggagatcatcaagaacagcaacggcatccccaagctgaagtacatccccctgaagttcagcttcaccgccgccgccgccgacagacagtgcgtgaaggccgccgagcccggcgagcccagcatgcacgccgccgccaccgccatggccgagctgaagggctacaacctgctgctgggcaccgtgaacgccgaggagaagctggtgagcgacttcctgatccagaccttcaaggtgttccagaagaaccaggtgggcccctgcaagtacctgaacgtgtacaagaagtacgtggacctgctggacaacaccgccgagcagaacatcgccgccttcctgaaggagaaccacgacatcgacgacttcgtgaccaagatcaacgccatcaagaagagaagaaacgagatcgccagcatgaacatcaccgtgcccctggccatgttctgcctggacgccaccgccctgaaccacgacctgtgcgagagagcccagaacctgaaggaccacctgatccagttccaggtggacgtgaacagagacaccaacaccagcatctgcaaccagtacagccacatcgccgacaaggtgagcgaggtgcccgccaacaccaaggagctggtgagcctgatcgagttcctgaagaagagcagcgccgtgaccgtgttcaagctgagaagacagctgagagacgccagcgagagactggagttcctgatggactacgccgacctgccctaccagatcgaggacatcttcgacaacagcagaaacctgctgctgcacaagagagaccaggccgagatggacctgatcaagagatgcagcgagttcgagctgagactggagggctaccacagagagctggagagcttcagaaagagagaggtgatgaccaccgaggagatgaagcacaacgtggagaagctgaacgagctgagcaagaacctgaacagagccttcgccgagttcgagctgatcaacaaggaggaggagctgctggagaaggagaagagcacctaccccctgctgcaggccatgctgaagaacaaggtgccctacgagcagctgtggagcaccgcctacgagttcagcatcaagagcgaggagtggatgaacggccccctgttcctgctgaacgccgagcagatcgccgaggagatcggcaacatgtggagaaccacctacaagctgatcaagaccctgagcgacgtgcccgcccccagaagactggccgagaacgtgaagatcaagatcgacaagttcaagcagtacatccccatcctgagcatcagctgcaaccccggcatgaaggacagacactggcagcagatcagcgagatcgtgggctacgagatcaagcccaccgagaccacctgcctgagcaacatgctggagttcggcttcggcaagttcgtggagaagctggagcccatcggcgccgccgccagcaaggagtacagcctggagaagaacctggacagaatgaagctggactgggtgaacgtgaccttcagcttcgtgaagtacagagacaccgacaccaacatcctgtgcgccatcgacgacatccagatgctgctggacgaccacgtgatcaagacccagaccatgtgcggcagccccttcatcaagcccatcgaggccgagtgcagaaagtgggaggagaagctgatcagaatccaggacaacctggacgcctggctgaagtgccaggccacctggctgtacctggagcccatcttcagcagcgaggacatcatcgcccagatgcccgaggagggcagaaagttcggcatcgtggacagctactggaagagcctgatgagccaggccgtgaaggacaacagaatcctggtggccgccgaccagcccagaatggccgagaagctgcaggaggccaacttcctgctggaggacatccagaagggcctgaacgactacctggagaagaagagactgttcttccccagattcttcttcctgagcaacgacgagctgctggagatcctgagcgagaccaaggaccccctgagagtgcagccccacctgaagaagtgcttcgagggcatcgccaagctggagttcaccgacaacctggagatcgtgggcatgatcagcagcgagaaggagaccgtgcccttcatccagaagatctaccccgccaacgccaagggcatggtggagaagtggctgcagcaggtggagcagatgatgctggccagcatgagagaggtgatcggcctgggcatcgaggcctacgtgaaggtgcccagaaaccactgggtgctgcagtggcccggccaggtggtgatctgcgtgagcagcatcttctggacccaggaggtgagccaggccctggccgagaacaccctgctggacttcctgaagaagagcaacgaccagatcgcccagatcgtgcagctggtgagaggcaagctgagcagcggcgccagactgaccctgggcgccctgaccgtgatcgacgtgcacgccagagacgtggtggccaagctgagcgaggacagagtgagcgacctgaacgacttccagtggatcagccagctgagatactactgggtggccaaggacgtgcaggtgcagatcatcaccaccgaggccctgtacggctacgagtacctgggcaacagccccagactggtgatcacccccctgaccgacagatgctacagaaccctgatgggcgccctgaagctgaacctgggcggcgcccccgagggccccgccggcaccggcaagaccgagaccaccaaggacctggccaaggccctggccaagcagtgcgtggtgttcaactgcagcgacggcctggactacaaggccatgggcaagttcttcaagggcctggcccaggccggcgcctgggcctgcttcgacgagttcaacagaatcgaggtggaggtgctgagcgtggtggcccagcagatcctgagcatccagcaggccatcatcagaaagctgaagaccttcatcttcgagggcaccgagctgagcctgaaccccacctgcgccgtgttcatcaccatgaaccccggctacgccggcagagccgagctgcccgacaacctgaaggccctgttcagaaccgtggccatgatggtgcccgactacgccctgatcggcgagatcagcctgtacagcatgggcttcctggacagcagaagcctggcccagaagatcgtggccacctacagactgtgcagcgagcagctgagcagccagcaccactacgactacggcatgagagccgtgaagagcgtgctgaccgccgccggcaacctgaagctgaagtaccccgaggagaacgagagcgtgctgctgctgagagccctgctggacgtgaacctggccaagttcctggcccaggacgtgcccctgttccagggcatcatcagcgacctgttccccggcgtggtgctgcccaagcccgactacgaggtgttcctgaaggtgctgaacgacaacatcaagaagatgaagctgcagcccgtgccctggttcatcggcaagatcatccagatctacgagatgatgctggtgagacacggctacatgatcgtgggcgaccccatgggcggcaagaccagcgcctacaaggtgctggccgccgccctgggcgacctgcacgccgccaaccagatggaggagttcgccgtggagtacaagatcatcaaccccaaggccatcaccatgggccagctgtacggctgcttcgaccaggtgagccacgagtggatggacggcgtgctggccaacgccttcagagagcaggccagcagcctgagcgacgacagaaagtggatcatcttcgacggccccgtggacgccatctggatcgagaacatgaacaccgtgctggacgacaacaagaagctgtgcctgatgagcggcgagatcatccagatgaacagcaagatgagcctgatcttcgagcccgccgacctggagcaggccagccccgccaccgtgagcagatgcggcatgatctacatggagccccaccagctgggctggaagcccctgaaggacagctacatggacaccctgcccagcagcctgaccaaggagcacaaggagctgatgaagagcggccagtag

SEQ ID NO: 79846 - DNA, 462 bp, Artificial Sequence
  Description of Artificial Sequence: Synthetic coding sequence
atgctgcacatgggcctggcccacgtgaagagaatgcccagaagcagcagactgcagtgcaaggaggcccaggccttcttcagcctgcagagcggcacctacagagtgctgagcacccccctgaagctgggcgtgtgggaggagaagaagcactgggccgccctgctgcagcccgtgagcctgggcagaaagtggaagaagagaccctgcaacctggacgactacgtgtggggccagctgaagtacatccccctgaagttcagcttcaccgccgccgccgccgacagacagtgcgtgaaggccgccgagcccggcgagcccagcatgcacgccgccgccaccgccatggccggcaccagagccggcaccaccttcgacgagctgcagtgccaggaggacatggtgtgcaccagattcgagaacaaggcctacgtgaacaccaacgacttcaccagacagtag

SEQ ID NO: 79847 - DNA, 13875 bp, Artificial Sequence
  Description of Artificial Sequence: Synthetic coding sequence
atgttcagaatcggcagaagacagctgtggaagcacagcgtgaccagagtgctgacccagagactgaagggcgagaaggaggccaagagagccctgctggacgccagacacaactacctgttcgccatcgtggccagctgcctggacctgaacaagaccgaggtggaggacgccatcctggagggcaaccagatcgagagaatcgaccagctgttcgccgtgggcggcctgagacacctgatgttctactaccaggacgtggaggaggccgagaccggccagctgggcagcctgggcggcgtgaacctggtgagcggcaagatcaagaagcccaaggtgttcgtgaccgagggcaacgacgtggccctgaccggcgtgtgcgtgttcttcatcagaaccgaccccagcaaggccatcacccccgacaacatccaccaggaggtgagcttcaacatgctggacgccgccgacggcggcctgctgaacagcgtgagaagactgctgagcgacatcttcatccccgccctgagagccaccagccacggctggggcgagctggagggcctgcaggacgccgccaacatcagacaggagttcctgagcagcctggagggcttcgtgaacgtgctgagcggcgcccaggagagcctgaaggagaaggtgaacctgagaaagtgcgacatcctggagctgaagaccctgaaggagcccaccgactacctgaccctggccaacaaccccgagaccctgggcaagatcgaggactgcatgaaggtgtggatcaagcagaccgagcaggtgctggccgagaacaaccagctgctgaaggaggccgacgacgtgggccccagagccgagctggagcactggaagaagagactgagcaagttcaactacctgctggagcagctgaagagccccgacgtgaaggccgtgctggccgtgctggccgccgccaagagcaagctgctgaagacctggagagagatggacatcagaatcaccgacgccaccaacgaggccaaggacaacgtgaagtacctgtacaccctggagaagtgctgcgaccccctgtacagcagcgaccccctgagcatgatggacgccatccccaccctgatcaacgccatcaagatgatctacagcatcagccactactacaacaccagcgagaagatcaccagcctgttcgtgaaggtgaccaaccagatcatcagcgcctgcaaggcctacatcaccaacaacggcaccgccagcatctggaaccagccccaggacgtggtggaggagaagatcctgagcgccatcaagctgaagcaggagtaccagctgtgcttccacaagaccaagcagaagctgaagcagaaccccaacgccaagcagttcgacttcagcgagatgtacatcttcggcaagttcgagaccttccacagaagactggccaagatcatcgacatcttcaccaccctgaagacctacagcgtgctgcaggacagcaccatcgagggcctggaggacatggccaccaagtaccagggcatcgtggccaccatcaagaagaaggagtacaacttcctggaccagagaaagatggacttcgaccaggactacgaggagttctgcaagcagaccaacgacctgcacaacgagctgagaaagttcatggacgtgaccttcgccaagatccagaacaccaaccaggccctgagaatgctgaagaagttcgagagactgaacatccccaacctgggcatcgacgacaagtaccagctgatcctggagaactacggcgccgacatcgacatgatcagcaagctgtacaccaagcagaagtacgacccccccctggccagaaaccagccccccatcgccggcaagatcctgtgggccagacagctgttccacagaatccagcagcccatgcagctgttccagcagcaccccgccgtgctgagcaccgccgaggccaagcccatcatcagaagctacaacagaatggccaaggtgctgctggagttcgaggtgctgttccacagagcctggctgagacagatcgaggagatccacgtgggcctggaggccagcctgctggtgaaggcccccggcaccggcgagctgttcgtgaacttcgacccccagatcctgatcctgttcagagagaccgagtgcatggcccagatgggcctggaggtgagccccctggccaccagcctgttccagaagagagacagatacaagagaaacttcagcaacatgaagatgatgctggccgagtaccagagagtgaagagcaagatccccgccgccatcgagcagctgatcgtgccccacctggccaaggtggacgaggccctgcagcccggcctggccgccctgacctggaccagcctgaacatcgaggcctacctggagaacaccttcgccaagatcaaggacctggagctgctgctggacagagtgaacgacctgatcgagttcagaatcgacgccatcctggaggagatgagcagcacccccctgtgccagctgccccaggaggagcccctgacctgcgaggagttcctgcagatgaccaaggacctgtgcgtgaacggcgcccagatcctgcacttcaagagcagcctggtggaggaggccgtgaacgagctggtgaacatgctgctggacgtggaggtgctgagcgaggaggagagcgagaagatcagcaacgagaacagcgtgaactacaagaacgagagcagcgccaagagagaggagggcaacttcgacaccctgaccagcagcatcaacgccagagccaacgccctgctgctgaccaccgtgaccagaaagaagaaggagaccgagatgctgggcgaggaggccagagagctgctgagccacttcaaccaccagaacatggacgccctgctgaaggtgaccagaaacaccctggaggccatcagaaagagaatccacagcagccacaccatcaacttcagagacagcaacagcgccagcaacatgaagcagaacagcctgcccatcttcagagccagcgtgaccctggccatccccaacatcgtgatggcccccgccctggaggacgtgcagcagaccctgaacaaggccgtggagtgcatcatcagcgtgcccaagggcgtgagacagtggagcagcgagctgctgagcaagaagaagatccaggagagaaagatggccgccctgcagagcaacgaggacagcgacagcgacgtggagatgggcgagaacgagctgcaggacaccctggagatcgccagcgtgaacctgcccatccccgtgcagaccaagaactactacaagaacgtgagcgagaacaaggagatcgtgaagctggtgagcgtgctgagcaccatcatcaacagcaccaagaaggaggtgatcaccagcatggactgcttcaagagatacaaccacatctggcagaagggcaaggaggaggccatcaagaccttcatcacccagagccccctgctgagcgagttcgagagccagatcctgtacttccagaacctggagcaggagatcaacgccgagcccgagtacgtgtgcgtgggcagcatcgccctgtacaccgccgacctgaagttcgccctgaccgccgagaccaaggcctggatggtggtgatcggcagacactgcaacaagaagtacagaagcgagatggagaacatcttcatgctgatcgaggagttcaacaagaagctgaacagacccatcaaggacctggacgacatcagaatcgccatggccgccctgaaggagatcagagaggagcagatcagcatcgacttccaggtgggccccatcgaggagagctacgccctgctgaacagatacggcctgctgatcgccagagaggagatcgacaaggtggacaccctgcactacgcctgggagaagctgctggccagagccggcgaggtgcagaacaagctggtgagcctgcagcccagcttcaagaaggagctgatcagcgccgtggaggtgttcctgcaggactgccaccagttctacctggactacgacctgaacggccccatggccagcggcctgaagccccaggaggccagcgacagactgatcatgttccagaaccagttcgacaacatctacagaaagtacatcacctacaccggcggcgaggagctgttcggcctgcccgccacccagtacccccagctgctggagatcaagaagcagctgaacctgctgcagaagatctacaccctgtacaacagcgtgatcgagaccgtgaacagctactacgacatcctgtggagcgaggtgaacatcgagaagatcaacaacgagctgctggagttccagaacagatgcagaaagctgcccagagccctgaaggactggcaggccttcctggacctgaagaagatcatcgacgacttcagcgagtgctgccccctgctggagtacatggccagcaaggccatgatggagagacactgggagagaatcaccaccctgaccggccacagcctggacgtgggcaacgagagcttcaagctgagaaacatcatggaggcccccctgctgaagtacaaggaggagatcgaggacatctgcatcagcgccgtgaaggagagagacatcgagcagaagctgaagcaggtgatcaacgagtgggacaacaagaccttcaccttcggcagcttcaagaccagaggcgagctgctgctgagaggcgacagcaccagcgagatcatcgccaacatggaggacagcctgatgctgctgggcagcctgctgagcaacagatacaacatgcccttcaaggcccagatccagaagtgggtgcagtacctgagcaacagcaccgacatcatcgagagctggatgaccgtgcagaacctgtggatctacctggaggccgtgttcgtgggcggcgacatcgccaagcagctgcccaaggaggccaagagattcagcaacatcgacaagagctgggtgaagatcatgaccagagcccacgaggtgcccagcgtggtgcagtgctgcgtgggcgacgagaccctgggccagctgctgccccacctgctggaccagctggagatctgccagaagagcctgaccggctacctggagaagaagagactgtgcttccccagattcttcttcgtgagcgaccccgccctgctggagatcctgggccaggccagcgacagccacaccatccaggcccacctgctgaacgtgttcgacaacatcaagagcgtgaagttccacgagaagatctacgacagaatcctgagcatcagcagccaggagggcgagaccatcgagctggacaagcccgtgatggccgagggcaacgtggaggtgtggctgaacagcctgctggaggagagccagagcagcctgcacctggtgatcagacaggccgccgccaacatccaggagaccggcttccagctgaccgagttcctgagcagcttccccgcccaggtgggcctgctgggcatccagatgatctggaccagagacagcgaggaggccctgagaaacgccaagttcgacaagaagatcatgcagaagaccaaccaggccttcctggagctgctgaacaccctgatcgacgtgaccaccagagacctgagcagcaccgagagagtgaagtacgagaccctgatcaccatccacgtgcaccagagagacatcttcgacgacctgtgccacatgcacatcaagagccccatggacttcgagtggctgaagcagtgcagattctacttcaacgaggacagcgacaagatgatgatccacatcaccgacgtggccttcatctaccagaacgagttcctgggctgcaccgacagactggtgatcacccccctgaccgacagatgctacatcaccctggcccaggccctgggcatgagcatgggcggcgcccccgccggccccgccggcaccggcaagaccgagaccaccaaggacatgggcagatgcctgggcaagtacgtggtggtgttcaactgcagcgaccagatggacttcagaggcctgggcagaatcttcaagggcctggcccagagcggcagctggggctgcttcgacgagttcaacagaatcgacctgcccgtgctgagcgtggccgcccagcagatcagcatcatcctgacctgcaagaaggagcacaagaagagcttcatcttcaccgacggcgacaacgtgaccatgaaccccgagttcggcctgttcctgaccatgaaccccggctacgccggcagacaggagctgcccgagaacctgaagatcaacttcagaagcgtggccatgatggtgcccgacagacagatcatcatcagagtgaagctggccagctgcggcttcatcgacaacgtggtgctggccagaaagttcttcaccctgtacaagctgtgcgaggagcagctgagcaagcaggtgcactacgacttcggcctgagaaacatcctgagcgtgctgagaaccctgggcgccgccaagagagccaaccccatggacaccgagagcaccatcgtgatgagagtgctgagagacatgaacctgagcaagctgatcgacgaggacgagcccctgttcctgagcctgatcgaggacctgttccccaacatcctgctggacaaggccggctaccccgagctggaggccgccatcagcagacaggtggaggaggccggcctgatcaaccaccccccctggaagctgaaggtgatccagctgttcgagacccagagagtgagacacggcatgatgaccctgggccccagcggcgccggcaagaccacctgcatccacaccctgatgagagccatgaccgactgcggcaagccccacagagagatgagaatgaaccccaaggccatcaccgccccccagatgttcggcagactggacgtggccaccaacgactggaccgacggcatcttcagcaccctgtggagaaagaccctgagagccaagaagggcgagcacatctggatcatcctggacggccccgtggacgccatctggatcgagaacctgaacagcgtgctggacgacaacaagaccctgaccctggccaacggcgacagaatccccatggcccccaactgcaagatcatcttcgagccccacaacatcgacaacgccagccccgccaccgtgagcagaaacggcatggtgttcatgagcagcagcatcctggactggagccccatcctggagggcttcctgaagaagagaagcccccaggaggccgagatcctgagacagctgtacaccgagagcttccccgacctgtacagattctgcatccagaacctggagtacaagatggaggtgctggaggccttcgtgatcacccagagcatcaacatgctgcagggcctgatccccctgaaggagcagggcggcgaggtgagccaggcccacctgggcagactgttcgtgttcgccctgctgtggagcgccggcgccgccctggagctggacggcagaagaagactggagctgtggctgagaagcagacccaccggcaccctggagctgcccccccccgccggccccggcgacaccgccttcgactactacgtggcccccgacggcacctggacccactggaacaccagaacccaggagtacctgtaccccagcgacaccacccccgagtacggcagcatcctggtgcccaacgtggacaacgtgagaaccgacttcctgatccagaccatcgccaagcagggcaaggccgtgctgctgatcggcgagcagggcaccgccaagaccgtgatcatcaagggcttcatgagcaagtacgaccccgagtgccacatgatcaagagcctgaacttcagcagcgccaccacccccctgatgttccagagaaccatcgagagctacgtggacaagagaatgggcaccacctacggcccccccgccggcaagaagatgaccgtgttcatcgacgacgtgaacatgcccatcatcaacgagtggggcgaccaggtgaccaacgagatcgtgagacagctgatggagcagaacggcttctacaacctggagaagcccggcgagttcaccagcatcgtggacatccagttcctggccgccatgatccaccccggcggcggcagaaacgacatcccccagagactgaagagacagttcagcatcttcaactgcaccctgcccagcgaggccagcgtggacaagatcttcggcgtgatcggcgtgggccactactgcacccagagaggcttcagcgaggaggtgagagacagcgtgaccaagctggtgcccctgaccagaagactgtggcagatgaccaagatcaagatgctgcccacccccgccaagttccactacgtgttcaacctgagagacctgagcagagtgtggcagggcatgctgaacaccaccagcgaggtgatcaaggagcccaacgacctgctgaagctgtggaagcacgagtgcaagagagtgatcgccgacagattcaccgtgagcagcgacgtgacctggttcgacaaggccctggtgagcctggtggaggaggagttcggcgaggagaagaagctgctggtggactgcggcatcgacacctacttcgtggacttcctgagagacgcccccgaggccgccggcgagaccagcgaggaggccgacgccgagacccccaagatctacgagcccatcgagagcttcagccacctgaaggagagactgaacatgttcctgcagctgtacaacgagagcatcagaggcgccggcatggacatggtgttcttcgccgacgccatggtgcacctggtgaagatcagcagagtgatcagaaccccccagggcaacgccctgctggtgggcgtgggcggcagcggcaagcagagcctgaccagactggccagcttcatcgccggctacgtgagcttccagatcaccctgaccagaagctacaacaccagcaacctgatggaggacctgaaggtgctgtacagaaccgccggccagcagggcaagggcatcaccttcatcttcaccgacaacgagatcaaggacgagagcttcctggagtacatgaacaacgtgctgagcagcggcgaggtgagcaacctgttcgccagagacgagatcgacgagatcaacagcgacctggccagcgtgatgaagaaggagttccccagatgcctgcccaccaacgagaacctgcacgactacttcatgagcagagtgagacagaacctgcacatcgtgctgtgcttcagccccgtgggcgagaagttcagaaacagagccctgaagttccccgccctgatcagcggctgcaccatcgactggttcagcagatggcccaaggacgccctggtggccgtgagcgagcacttcctgaccagctacgacatcgactgcagcctggagatcaagaaggaggtggtgcagtgcatgggcagcttccaggacggcgtggccgagaagtgcgtggactacttccagagattcagaagaagcacccacgtgacccccaagagctacctgagcttcatccagggctacaagttcatctacggcgagaagcacgtggaggtgagaaccctggccaacagaatgaacaccggcctggagaagctgaaggaggccagcgagagcgtggccgccctgagcaaggagctggaggccaaggagaaggagctgcaggtggccaacgacaaggccgacatggtgctgaaggaggtgaccatgaaggcccaggccgccgagaaggtgaaggccgaggtgcagaaggtgaaggacagagcccaggccatcgtggacagcatcagcaaggacaaggccatcgccgaggagaagctggaggccgccaagcccgccctggaggaggccgaggccgccctgcagaccatcagacccagcgacatcgccaccgtgagaaccctgggcagacccccccacctgatcatgagaatcatggactgcgtgctgctgctgttccagagaaaggtgagcgccgtgaagatcgacctggagaagagctgcaccatgcccagctggcaggagagcctgaagctgatgaccgccggcaacttcctgcagaacctgcagcagttccccaaggacaccatcaacgaggaggtgatcgagttcctgagcccctacttcgagatgcccgactacaacatcgagaccgccaagagagtgtgcggcaacgtggccggcctgtgcagctggaccaaggccatggccagcttcttcagcatcaacaaggaggtgctgcccctgaaggccaacctggtggtgcaggagaacagacacctgctggccatgcaggacctgcagaaggcccaggccgagctggacgacaagcaggccgagctggacgtggtgcaggccgagtacgagcaggccatgaccgagaagcagaccctgctggaggacgccgagagatgcagacacaagatgcagaccgccagcaccctgatcagcggcctggccggcgagaaggagagatggaccgagcagagccaggagttcgccgcccagaccaagagactggtgggcgacgtgctgctggccaccgccttcctgagctacagcggccccttcaaccaggagttcagagacctgctgctgaacgactggagaaaggagatgaaggccagaaagatccccttcggcaagaacctgaacctgagcgagatgctgatcgacgcccccaccatcagcgagtggaacctgcagggcctgcccaacgacgacctgagcatccagaacggcatcatcgtgaccaaggccagcagataccccctgctgatcgacccccagacccagggcaagatctggatcaagaacaaggagagcagaaacgagctgcagatcaccagcctgaaccacaagtacttcagaaaccacctggaggacagcctgagcctgggcagacccctgctgatcgaggacgtgggcgaggagctggaccccgccctggacaacgtgctggagagaaacttcatcaagaccggcagcaccttcaaggtgaaggtgggcgacaaggaggtggacgtgctggacggcttcagactgtacatcaccaccaagctgcccaaccccgcctacacccccgagatcagcgccagaaccagcatcatcgacttcaccgtgaccatgaagggcctggaggaccagctgctgggcagagtgatcctgaccgagaagcaggagctggagaaggagagaacccacctgatggaggacgtgaccgccaacaagagaagaatgaaggagctggaggacaacctgctgtacagactgaccagcacccagggcagcctggtggaggacgagagcctgatcgtggtgctgagcaacaccaagagaaccgccgaggaggtgacccagaagctggagatcagcgccgagaccgaggtgcagatcaacagcgccagagaggagtacagacccgtggccaccagaggcagcatcctgtacttcctgatcaccgagatgagactggtgaacgagatgtaccagaccagcctgagacagttcctgggcctgttcgacctgagcctggccagaagcgtgaagagccccatcaccagcaagagaatcgccaacatcatcgagcacatgacctacgaggtgtacaagtacgccgccagaggcctgtacgaggagcacaagttcctgttcaccctgctgctgaccctgaagatcgacatccagagaaacagagtgaagcacgaggagttcctgaccctgatcaagggcggcgccagcctggacctgaaggcctgcccccccaagcccagcaagtggatcctggacatcacctggctgaacctggtggagctgagcaagctgagacagttcagcgacgtgctggaccagatcagcagaaacgagaagatgtggaagatctggttcgacaaggagaaccccgaggaggagcccctgcccaacgcctacgacaagagcctggactgcttcagaagactgctgctgatcagaagctggtgccccgacagaaccatcgcccaggccagaaagtacatcgtggacagcatgggcgagaagtacgccgagggcgtgatcctggacctggagaagacctgggaggagagcgaccccagaacccccctgatctgcctgctgagcatgggcagcgaccccaccgacagcatcatcgccctgggcaagagactgaagatcgagaccagatacgtgagcatgggccagggccaggaggtgcacgccagaaagctgctgcagcagaccatggccaacggcggctgggccctgctgcagaactgccacctgggcctggacttcatggacgagctgatggacatcatcatcgagaccgagctggtgcacgacgccttcagactgtggatgaccaccgaggcccacaagcagttccccatcaccctgctgcagatgagcatcaagttcgccaacgaccccccccagggcctgagagccggcctgaagagaacctacagcggcgtgagccaggacctgctggacgtgagcagcggcagccagtggaagcccatgctgtacgccgtggccttcctgcacagcaccgtgcaggagagaagaaagttcggcgccctgggctggaacatcccctacgagttcaaccaggccgacttcaacgccaccgtgcagttcatccagaaccacctggacgacatggacgtgaagaagggcgtgagctggaccaccatcagatacatgatcggcgagatccagtacggcggcagagtgaccgacgactacgacaagagactgctgaacaccttcgccaaggtgtggttcagcgagaacatgttcggccccgacttcagcttctaccagggctacaacatccccaagtgcagcaccgtggacaactacctgcagtacatccagagcctgcccgcctacgacagccccgaggtgttcggcctgcaccccaacgccgacatcacctaccagagcaagctggccaaggacgtgctggacaccatcctgggcatccagcccaaggacaccagcggcggcggcgacgagaccagagaggccgtggtggccagactggccgacgacatgctggagaagctgccccccgactacgtgcccttcgaggtgaaggagagactgcagaagatgggccccttccagcccatgaacatcttcctgagacaggagatcgacagaatgcagagagtgctgagcctggtgagaagcaccctgaccgagctgaagctggccatcgacggcaccatcatcatgagcgagaacctgagagacgccctggactgcatgttcgacgccagaatccccgcctggtggaagaaggccagctggatcagcagcaccctgggcttctggttcaccgagctgatcgagagaaacagccagttcaccagctgggtgttcaacggcagaccccactgcttctggatgaccggcttcttcaacccccagggcttcctgaccgccatgagacaggagatcaccagagccaacaagggctgggccctggacaacatggtgctgtgcaacgaggtgaccaagtggatgaaggacgacatcagcgccccccccaccgagggcgtgtacgtgtacggcctgtacctggagggcgccggctgggacaagagaaacatgaagctgatcgagagcaagcccaaggtgctgttcgagctgatgcccgtgatcagaatctacgccgagaacaacaccctgagagaccccagattctacagctgccccatctacaagaagcccgtgagaaccgacctgaactacatcgccgccgtggacctgagaaccgcccagacccccgagcactgggtgctgagaggcgtggccctgctgtgcgacgtgaagtag

SEQ ID NO: 79848 - DNA, 12477 bp, Artificial Sequence
  Description of Artificial Sequence: Synthetic coding sequence
atgaccttcagagccaccgacagcgagttcgacctgaccaacatcgaggagtacgccgagaacagcgccctgagcagactgaacaacatcaaggccaagcagagagtgagctacgtgaccagcaccgagaacgagagcgacacccagatcctgaccttcagacacatcaccaaggcccaggagaagaccagaaagagacagcagcccatcaagctggagcccctgcccgtgctgaaggtgtaccaggaccacaagcagcccgagtacatccacgagcagaacagattccagctgatgaccgccggcatcatcaagagacccgtgagcatcgccaagaagagcttcgccaccagcagcacccagttcctggagcaccaggacgccgtgaagaagatgcagatccacagaccctacgtggaggtgttcagccccagcccccccaagctgccccacaccggcatcggcaagagaggcctgttcggcaccagaagcagcgcctaccccaagtacaccttccacgacagagaggaggtggtgaaggccaacatcagagaccccctgcagatcatcaagatcatcagagagaacgagcacctgggcttcctgtacatgatccccgccgtgcccagaagcagcatcgagtacgacacctacaacctgaaggtggtgagctacgagaacatcaacaagaacgactactacaccatcagccagagagccgtgacccacatctacaacgaggacatcgagttcatcgagatcgacagatgggagcaggagtacctgtaccacagagagctgaccaagatccccatcttcagcctgttcagaaagtggaaggccttcagcgtgtggagaaagaacgtgagaagcaagaagatcaccggctgccagaagagcctgcagaagaacctgttcatcgtgaacccccacctgagacccgccctgctgaagatcaacgagctgtgctaccacctgagcttcatgggcctgtgctacatcgagaagtgccacacctacaccctgcaggagttcaaggccgcccaggtgatcagactggccgaggtgaccgagagactgggcgagttcagaaacgaggccaagtacgtggtgagaagagcctgcagattcgccctgagagccgccggcttcgtgcccgacgactgcgccttcggccccttcgaggactaccacaaggtgcagagcagcggcagcttcatcaacaccccccacgagctgcccacctacggcgacagcgagaagatgacctacaccgagcaggccagcaagagacactactgcatgagactgacctgcttcatcagactgaacgactacctgatcgagaacaccatgcacatcctgaccgtgaacgccgtgaacagcctgctgaaccacctgaccgacaagctgaagagaacccccagcgccgacgtgatccagaagtggatcaccgaggagaagcccgaggtgcccgacaagaagggcaccctgatggtggagaagcaggaggaggacgagagcctgatccccatgttcctgaccgagctgatgctgaccgtgcagagcctgctgttcgagcccagcctggaggacttcctggacggcatcctgggcgccgtgaaccactgccagaacaccgtgctgagcgtgcccaacctggtgcccgacagctacttcgacgccttcaccagcccctacatcaacaacaagctggagggcaagacctgcggcaccggccccagcctggccgccgtgttcgaggacgacaagaacttccacaccatcatcagccagatcaaggagaccatccaggccgccttcgagagcgccagaatctacgccgccaccttcgagaagttccagatcttcttcaaggagaacgagagcctggacctgcaggccctgaagctgcaggagcccgacatcaacttcttcagcgagcagctggagaagtaccacaagcagcacaaggacgccgtggccctgagacccaccagaaacgtgggcctgctgctgatcgacaccagactgctgagagagaagctgatccccagccccctgagatgcctggaggtgctgaacttcatgctgcccagacagagcaagaagaaggtggacgccatcatcttcgaggcccaggacgccgagtacaagctggagttcgtgcccaccaccaccaccgagtacgtgcacagcctgctgttcctggacgagatccaggagagaatcgagagcctggaggacgagggcaacatcgtgacccagatgtacaagctgatggagcagtaccaggtgcccaccccccccgaggacttcgccgtgttcgccaccatgaagcccagcatcgtggccgtgagaaacgccatcgacaagagcgtgggcgacagagagagcagcatcaagcagttctgcgtgcacctgggcagcgacctggaggagctgaacaacgaggtgaacgaggtgaagctgcaggcccaggacccccagatcctggacatcagcgccgaccaggacaagatcagactgatcctgaacaacctgcagagcgtgctggccgacctgcagaagagagccttccagtacaagagctaccagaagaacttcaaggtggaggtgagcaagttcgaggccctggaggaggtgagcgccgagctgaagctgaagcagctgctgtgggacagcttcagcgagtgggacaagctgcagcaggagtggctgaagagcaagttcgactgcctggaccccgaggtgctgaacggccaggtgagcaagtacgccaagttcgtgacccagctggagaagggcctgccccccaacagcgtggtgccccagctgaagtacaaggtggagaagatgaaggagaagctgcccgtgatcatcgacctgagaaaccccaccctgaaggccagacactgggccgccatcgagcagaccgtggacgccaccctggtggacgccgagatccccctgaccctggagagactgagccagctgcacgtgttcgacttcggccaggagatccaggacatcagcggccaggccagcggcgaggccgccctggaggccatcctgaagaaggtggaggacagctggaagaccaccgagttcgtgatcctgccccacagagacagcaaggacgtgttcatcctgggcggcaccgacgacatccaggtgctgctggacgacagcaccatcaacgtggccaccctggccagcagcagatacctgggccccctgaagaccagagtggacgagtggcagaagcagctggccctgttcaaccagaccctggaggagtggctgacctgccagagaaactggctgtacctggagagcatcttcaacgcccccgacatccagagacagctgcccgccgaggccaagatgttcctgcaggtggacaagagctggaaggagatcatgagaaaggtgaacagactgcccaacgccctgagagccgccacccagcccggcctgctggagaccttccagaacaacaacgccctgctggaccagatccagaagtgcctggaggcctacctggagagcaagagagtgatcttccccagattctacttcctgagcaacgacgagctgctggagatcctggcccagaccagaaacccccaggccgtgcagccccacctgagaaagtgcttcgacagcatcagcaagctggagttcgccctgatgccccccgccgagggcaagatccccggcatcgacggcgagcccgagaaggtgtacaccaacgacatcctggccatgctgagccccgagggcgagagagtgagcctgggcaagggcctgaaggccagaggcaacgtggaggagtggctgggcaaggtggaggaggccatgttcaccagcctgagaagactgtgcaaggccgccatcgccgactaccagggcaagctgagaaccgactgggtggtggccggccaccccagccaggtgatcctgaccgtgagccagatcatgtggtgcagagacctgaccgagtgcctggagaccgagcacagcaaccacatccaggccctgaagaacttcgagaaggtgaacttcgagagactgaacgccctggccgccatcgtgcagggcagcctgcccaagctgcacagaaacatcctgaccgccctgatcaccatcgacgtgcacgccagagacatcgtgaccgagctggtgcagagcaaggtggagaccgtggagagcttcgactggcagagacagctgagatactactgggacatcgacctggacaactgcgtggccagaatggccctgagccagtacacctacggctacgagtacctgggcgcctgccccagactggtgatcacccccctgaccgacagatgctacctgtgcctgatgggcgccctgcagctggacctgggcggcgcccccgccggccccgccggcaccggcaagaccgagaccaccaaggacctggccaaggccctggccatccagtgcgtggtgttcaactgcagcgacggcctggactacaagatgatgggcagattcttcagcggcctggcccagagcggcgcctggtgctgcttcgacgagttcaacagaatcgacatcgaggtgctgagcgtgatcgcccagcagctgatcaccatcagaaacgccaaggccgccaagctgagcagattcatgttcgagggcagagagatcaagctggtgatgacctgcgccgccttcatcaccatgaaccccggctacgccggcagaaccgagctgcccgacaacctgaaggccctgttcagacccttcgccatgatggtgcccaactacgccctgatcgccgaggtgatcctgtacagcgagggcttcgagagcagcaagatcctggccagaaagatgacccagatgtacaagctgtgcagcgagcagctgagccagcaggaccactacgacttcggcatgagagccgtgaagagcgtgctggtgatggccggcagcctgaagagagagaaccccgacctgaacgaggacgtggtgctgatcagagccctgcaggacagcaacctgcccaagttcctgaccgacgacgccctgctgttcagcggcatcatcagcgacctgttccccggcgtgcagatccccgagcacgactacggcatcctgcagagcaccatcgtggacgtgatgaacagacagaacctgcagcccgagatgtgcatggtgagaaaggtgatccagttctacgagaccatgctggtgagacacggcgtgatgctggtgggccccaccggcggcggcaagaccaccgtgtacagaatcctggccgagaccctgggcaacctgcagaagctgggcatcgagaacagcttctaccaggccgtgaagacctacgtgctgaaccccaagagcatcaccatgggcgagctgtacggcgaggtgaacaacctgaccctggagtggaaggacggcctgatggccctgagcgtgagagccgccgtgaacgacaccagcgaggaccacaagtggatcatcagcgacggccccgtggacgccctgtggatcgagaacatgaacaccgtgctggacgacaacaagatgctgtgcctggccaacagcgagagaatcaagctgaccccccagatccacatgctgttcgaggtgcaggacctgagagtggccagccccgccaccgtgagcagatgcggcatggtgttcgtggaccccgaggagctgaagtggatgccctacgtgaagacctggatgaagggcatcagcaagaagctgaccgaggagacccaggagtacatcctgaacctgttccagagatacgtggacgagggcctgcacttcatcaacaagaagtgcagccaggccatcccccaggtggacatcagcaaggtgaccaccctgtgctgcctgctggagagcctgatcctgggcaaggacggcgtgaacctggccatggagcagaccaagctgaacaccatcctgtgccagaccttcgtgttctgctacctgtggagcctgggcggcaacctgaccgagaactactacgacagcttcgacaccttcatcagaacccagttcgacgacaaccccgacgccagactgcccaacagcggcgacctgtggagcatccacatggacttcgacaccaagagactggacccctgggagagaatcatccccaccttcaagtacaacagagacgtgcccttcttcgagatgctggtgcccaccaccgacaccgtgagatacggctacctgatggagaagctgctggccgtgaagcacagcgtgctgttcaccggcatcaccggcgtgggcaagagcgtgatcgccaagggcctgctgaacaagatccaggagagcgccggctacgtgcccgtgtacctgaacttcagcgcccagaccagcagcgccagaacccaggagatcatcgagagcaagctggagagaaagagaaagaacatcctgggcgcccccggcaacaagagaatcgtgatcttcgtggacgacctgaacatgcccagactggacagatacggcagccagccccccatcgagctgctgagacagtaccaggacttcggcggcttctacgacagaaacaagctgttctggaaggagatccaggacgtgaccatcatcagcgcctgcgccccccccggcggcggcagaaaccccgtgacccccagattcatcagacacttcagcatgctgtgcctgcccatgcccagcgagcacagcctgaagcagatcttccaggccatcctgaacggcttcctgagcgacttcccccccgccgtgaagcagaccgccagcagcatcgtggaggccagcgtggagatctacaacaagatgagcgtggacctgctgcccacccccgccaagagccactacgtgttcaacctgagagacctgagcaagtgcgtgcagggcatcctgcagtgcgaccccggcaccatcagagaggagatccagatcttcagactgttctgccacgagtgccagagagtgttccacgacagactgatcaacaacgaggacaagcactacttccacgtgatcctgaccgagatggccaacaagcacttcggcatcgccatcgacctggagtacttcctgaacaagcccatcatcttcggcgacttcatcaagttcggcgccgacaaggccgacagaatctacgacgacatgcccgacatcgagaagaccgccaacgtgctgcaggactacctggacgactacaacctgaccaaccccaaggaggtgaagctggtgttcttccaggacgccatcgagcacgtgagcagaatcgccagaatgatcagacaggagagaggcaacgccctgctggtgggcgtgggcggcaccggcaagcagagcctgaccagactggccgcccacatctgcggctacaagtgcctgcagatcgagctgagcagaggctacaactacgacagcttccacgaggacctgagaaagctgtacaagatggccggcgtggaggacaagaacatggtgttcctgttcaccgacacccagatcgtggtggaggagttcctggaggacatcaacaacatcctgaacagcggcgaggtgcccaacctgttcgagaaggacgagctggagcaggtgctggccgccaccagacccagagccaaggaggtgggcatcagcgagggcaacagagacgaggtgttccagtacttcatcagcaaggtgagacagaagctgcacatcgtgctgtgcatgagccccgtgggcgaggccttcagaagcagatgcagaatgttccccagcctggtgaactgctgcaccatcgactggttcgtgcagtggcccagagaggccctgctgagcgtgagcaagaccttcttcagccaggtggacgccggcaacgaggagctgaaggagaagctgcccctgatgtgcgtgaacgtgcacctgagcgtgagcagcatggccgagagatactacaacgagctgagaagaagatactacaccacccccaccagctacctggagctgatcaacctgtacctgagcatgctgagcgagaagagaaagcagatcatcagcgccagagacagagtgaagaacggcctgaccaagctgctggagaccaacatcctggtggacaagatgaagctggacctgagcgccctggagcccgtgctgctggccaagagcgaggacgtggaggccctgatggagaagctggccgtggaccaggagagcgccgaccaggtgagaaacaccgtgcaggaggacgaggccaccgccaaggtgaaggccgaggagacccaggccatcgccgacgacgcccagagagacctggacgaggccctgcccgccctggacgccgccaacaaggccctggacagcctggacaaggccgacatcagcgagatcagagtgttcaccaagccccccgacctggtgatgaccgtgatggaggccatcagcatcctgctgaacgccaagcccgactggcccagcgccaagcagctgctgggcgacagcaacttcctgaagagactgctggagtacgacaaggagaacatcaagccccagatcctggccaagctgcagaagtacatcaacaaccccgacttcgtgcccgagaaggtggagaaggtgagcaaggcctgcaagagcatgtgcatgtgggtgagagccatggacctgtacagcagagtggtgaaggtggtggagcccaagagacagaagctgagagccgcccaggccgagctggacatcaccatggccaccctgagagagaagcaggccctgctgagacaggtggaggaccagatccaggccctgcaggacgagtacgacaagggcgtgaacgagaaggagagcctggccaagaccatggccctgaccaaggccagactggtgagagccggcaagctgaccgccgccctggaggacgagcaggtgagatgggaggagagcatccagaagttcgaggaggagatcagcaacatcaccggcaacgtgttcatcgccgccgcctgcgtggcctactacggcgccttcaccgcccagtacagacagagcctgatcgagtgctggatccaggactgccagagcctggagatccccatcgaccccagcttcagcctgatcaacatcctgggcgacccctacgagatcagacagtggaacaccgacggcctgcccagagacctgatcagcaccgagaacggcatcctggtgacccagggcagaagatggcccctgatgatcgacccccaggaccaggccaacagatggatcagaaacaaggagagcaagagcggcctgaagatcatcaagctgaccgacagcaacttcctgagaatcctggagaacagcatcagactgggcctgcccgtgctgctggaggagctgaaggagaccctggaccccgccctggagcccatcctgctgaagcagatcttcatcagcggcggcagactgctgatcagactgggcgacagcgacatcgactacgacaagaacttcagattctacatgaccaccaagatgcccaacccccactacctgcccgaggtgtgcatcaaggtgaccatcatcaacttcaccgtgaccaagagcggcctggaggaccagctgctgagcgacgtggtgagactggagaagcccagactggaggagcagagaatcaagctgatcgtgagaatcaacaccgacaagaaccagctgaagaccatcgaggagaagatcctgagaatgctgttcaccagcgagggcaacatcctggacaacgaggagctgatcgacaccctgcaggacagcaagatcaccagcggcgccatcaagaccagactggaggaggccgagagcaccgagcagatgatcaacgtggccagagagaagtacagacccgtggccacccagggcagcgtgatgtacttcgtgatcgccagcctgagcgagatcgaccccatgtaccagtacagcctgaagtacttcaagcagctgttcaacaccaccatcgagaccagcgtgaagaccgagaacctgcagcagagactggacgtgctgctggagcagaccctgctgaccgcctacgtgaacgtgagcagaggcctgttcgagcagcacaagctgatctacagcttcatgctgtgcgtggagatgatgagacagcagggcaccctgagcgacgccgagtggaacttcttcctgagaggcagcgccggcctggagaaggagagaccccccaagcccgaggccccctggctgcccaccgccacctggttcgcctgctgcgacctggaggagagcttccccgtgttccacggcctgacccagaacatcctgagccaccccatcagcatcagactgggcagcttcgagacctacatcaacccccagaagtgggagggctacagcaagatgaagcacgaggacaagcacatgagacaggagaaggaggccgcccaccaggacccctggagcgccggcctgagcagcttccacaagctgatcctgatcaagtgctgcaaggaggagaaggtggtgttcgccctgaccgacttcgtgatcgagaacctgggcaagcagttcatcgagaccccccccgtggacctgcccaccctgtaccaggacatgagctgcaacacccccctggtgttcatcctgagcaccggcagcgaccccatgggcgccttccagagattcgccagagagagcggctacagcgagagagtgcagagcatcagcctgggccagggccagggccccatcgccgagaagatggtgaaggacgccatgaagagcggcaactgggtgttcctgcagaactgccacctggccgtgagctggatgctggccatggaggagctgatcaagaccttcaccgaccccgacagcgccatcaaggacaccttcagactgttcctgagcagcatgcccagcaacaccttccccgtgaccgtgctgcagaacagcgtgaaggtgaccaacgagccccccaagggcctgagagccaacatcagaagagccttcaccgagatgacccccagcttcttcgaggagaacatcctgggcaagaagtggagacagatcatcttcggcatctgcttcttccacgccatcatccaggagagaaagaagttcggccccctgggctggaacatctgctacgagttcaacgacagcgacagagagtgcgccctgctgaacctgaagctgtactgcaaggagggcaagatcccctgggacgccctgatctacatcaccggcgagatcacctacggcggcagagtgaccgacagctgggaccagagatgcctgagaaccatcctgaagagattcttcagccccgagaccctggaggaggactacaagtacagcgagagcggcatctacttcgcccccatggccgacagcctgcaggagttcaaggactacatcgagaacctgcccctgatcgacgaccccgagatcttcggcatgcacgagaacgccaacctggtgttccagtacaaggagaccagcaccctgatcaacaccatcctggaggtgcagcccagaagcagcaccggcggcgagggcaagagcaacgacgagatcgtgcaggagctggtggccagcgtgcagaccagagtgcccgagaagctggagatggagggcgccagcgagagcctgttcgtgaaggacctgcagggcagactgaacagcctgaccaccgtgctgggccaggaggtggacagattcaacaacctgctgaagctgatccacaccagcctggagaccctgaacaaggccatcgccggcttcgtggtgatgagcgaggagatggagaaggtgtacaacagcttcctgaacaaccaggtgcccgccctgtggagcaacaccgcctaccccagcctgaagcccctgggcagctgggtgaaggacctgatcctgagaaccagcttcgtggacctgtggctgaagagaggccagcccaagagctactggatcagcggcttcttcttcccccagggcttcctgaccggcaccctgcagaaccacgccagaaagtacaacctgcccatcgacgagctgagcttcaagtacagcgtgatccccacctacagagaccaggccgccgtgatcgaggccgccaagaccgtgcagttcggccaggagctgcccatggacatggagctgcccagccccgaggacggcgtgctggtgcacggcatgttcatggacgccagcagatgggacgacaaggagatggtgatcgaggacgccctgcccggccagatgaaccccgtgctgcccgtggtgcacttcgagccccagcagaactacaagcccagccccaccctgtaccactgccccctgtacaagaccggcgccagagccggcaccctgagcaccaccggccacagcaccaacttcgtggtgaccgtgctgctgcccagcaagagaagcaaggactactggatcgccaagggcagcgccctgctgtgccagctgagcgagtag

SEQ ID NO: 79849 - DNA, 12477 bp, Artificial Sequence; identical to SEQ ID NO: 79848
  Description of Artificial Sequence: Synthetic coding sequence

SEQ ID NO: 79850 - DNA, 7593 bp, Artificial Sequence
  Description of Artificial Sequence: Synthetic coding sequence
atgaccttcagagccaccgacagcgagttcgacctgaccaacatcgaggagtacgccgagaacagcgccctgagcagactgaacaacatcaaggccaagcagagagtgagctacgtgaccagcaccgagaacgagagcgacacccagatcctgaccttcagacacatcaccaaggcccaggagaagaccagaaagagacagcagcccatcaagctggagcccctgcccgtgctgaaggtgtaccaggaccacaagcagcccgagtacatccacgagcagaacagattccagctgatgaccgccggcatcatcaagagacccgtgagcatcgccaagaagagcttcgccaccagcagcacccagttcctggagcaccaggacgccgtgaagaagatgcagatccacagaccctacgtggaggtgttcagccccagcccccccaagctgccccacaccggcatcggcaagagaggcctgttcggcaccagaagcagcgcctaccccaagtacaccttccacgacagagaggaggtggtgaaggccaacatcagagaccccctgcagatcatcaagatcatcagagagaacgagcacctgggcttcctgtacatgatccccgccgtgcccagaagcagcatcgagtacgacacctacaacctgaaggtggtgagctacgagaacatcaacaagaacgactactacaccatcagccagagagccgtgacccacatctacaacgaggacatcgagttcatcgagatcgacagatgggagcaggagtacctgtaccacagagagctgaccaagatccccatcttcagcctgttcagaaagtggaaggccttcagcgtgtggagaaagaacgtgagaagcaagaagatcaccggctgccagaagagcctgcagaagaacctgttcatcgtgaacccccacctgagacccgccctgctgaagatcaacgagctgtgctaccacctgagcttcatgggcctgtgctacatcgagaagtgccacacctacaccctgcaggagttcaaggccgcccaggtgatcagactggccgaggtgaccgagagactgggcgagttcagaaacgaggccaagtacgtggtgagaagagcctgcagattcgccctgagagccgccggcttcgtgcccgacgactgcgccttcggccccttcgaggactaccacaaggtgcagagcagcggcagcttcatcaacaccccccacgagctgcccacctacggcgacagcgagaagatgacctacaccgagcaggccagcaagagacactactgcatgagactgacctgcttcatcagactgaacgactacctgatcgagaacaccatgcacatcctgaccgtgaacgccgtgaacagcctgctgaaccacctgaccgacaagctgaagagaacccccagcgccgacgtgatccagaagtggatcaccgaggagaagcccgaggtgcccgacaagaagggcaccctgatggtggagaagcaggaggaggacgagagcctgatccccatgttcctgaccgagctgatgctgaccgtgcagagcctgctgttcgagcccagcctggaggacttcctggacggcatcctgggcgccgtgaaccactgccagaacaccgtgctgagcgtgcccaacctggtgcccgacagctacttcgacgccttcaccagcccctacatcaacaacaagctggagggcaagacctgcggcaccggccccagcctggccgccgtgttcgaggacgacaagaacttccacaccatcatcagccagatcaaggagaccatccaggccgccttcgagagcgccagaatctacgccgccaccttcgagaagttccagatcttcttcaaggagaacgagagcctggacctgcaggccctgaagctgcaggagcccgacatcaacttcttcagcgagcagctggagaagtaccacaagcagcacaaggacgccgtggccctgagacccaccagaaacgtgggcctgctgctgatcgacaccagactgctgagagagaagctgatccccagccccctgagatgcctggaggtgctgaacttcatgctgcccagacagagcaagaagaaggtggacgccatcatcttcgaggcccaggacgccgagtacaagctggagttcgtgcccaccaccaccaccgagtacgtgcacagcctgctgttcctggacgagatccaggagagaatcgagagcctggaggacgagggcaacatcgtgacccagatgtacaagctgatggagcagtaccaggtgcccaccccccccgaggacttcgccgtgttcgccaccatgaagcccagcatcgtggccgtgagaaacgccatcgacaagagcgtgggcgacagagagagcagcatcaagcagttctgcgtgcacctgggcagcgacctggaggagctgaacaacgaggtgaacgaggtgaagctgcaggcccaggacccccagatcctggacatcagcgccgaccaggacaagatcagactgatcctgaacaacctgcagagcgtgctggccgacctgcagaagagagccttccagtacaagagctaccagaagaacttcaaggtggaggtgagcaagttcgaggccctggaggaggtgagcgccgagctgaagctgaagcagctgctgtgggacagcttcagcgagtgggacaagctgcagcaggagtggctgaagagcaagttcgactgcctggaccccgaggtgctgaacggccaggtgagcaagtacgccaagttcgtgacccagctggagaagggcctgccccccaacagcgtggtgccccagctgaagtacaaggtggagaagatgaaggagaagctgcccgtgatcatcgacctgagaaaccccaccctgaaggccagacactgggccgccatcgagcagaccgtggacgccaccctggtggacgccgagatccccctgaccctggagagactgagccagctgcacgtgttcgacttcggccaggagatccaggacatcagcggccaggccagcggcgaggccgccctggaggccatcctgaagaaggtggaggacagctggaagaccaccgagttcgtgatcctgccccacagagacagcaaggacgtgttcatcctgggcggcaccgacgacatccaggtgctgctggacgacagcaccatcaacgtggccaccctggccagcagcagatacctgggccccctgaagaccagagtggacgagtggcagaagcagctggccctgttcaaccagaccctggaggagtggctgacctgccagagaaactggctgtacctggagagcatcttcaacgcccccgacatccagagacagctgcccgccgaggccaagatgttcctgcaggtggacaagagctggaaggagatcatgagaaaggtgaacagactgcccaacgccctgagagccgccacccagcccggcctgctggagaccttccagaacaacaacgccctgctggaccagatccagaagtgcctggaggcctacctggagagcaagagagtgatcttccccagattctacttcctgagcaacgacgagctgctggagatcctggcccagaccagaaacccccaggccgtgcagccccacctgagaaagtgcttcgacagcatcagcaagctggagttcgccctgatgccccccgccgagggcaagatccccggcatcgacggcgagcccgagaaggtgtacaccaacgacatcctggccatgctgagccccgagggcgagagagtgagcctgggcaagggcctgaaggccagaggcaacgtggaggagtggctgggcaaggtggaggaggccatgttcaccagcctgagaagactgtgcaaggccgccatcgccgactaccagggcaagctgagaaccgactgggtggtggccggccaccccagccaggtgatcctgaccgtgagccagatcatgtggtgcagagacctgaccgagtgcctggagaccgagcacagcaaccacatccaggccctgaagaacttcgagaaggtgaacttcgagagactgaacgccctggccgccatcgtgcagggcagcctgcccaagctgcacagaaacatcctgaccgccctgatcaccatcgacgtgcacgccagagacatcgtgaccgagctggtgcagagcaaggtggagaccgtggagagcttcgactggcagagacagctgagatactactgggacatcgacctggacaactgcgtggccagaatggccctgagccagtacacctacggctacgagtacctgggcgcctgccccagactggtgatcacccccctgaccgacagatgctacctgtgcctgatgggcgccctgcagctggacctgggcggcgcccccgccggccccgccggcaccggcaagaccgagaccaccaaggacctggccaaggccctggccatccagtgcgtggtgttcaactgcagcgacggcctggactacaagatgatgggcagattcttcagcggcctggcccagagcggcgcctggtgctgcttcgacgagttcaacagaatcgacatcgaggtgctgagcgtgatcgcccagcagctgatcaccatcagaaacgccaaggccgccaagctgagcagattcatgttcgagggcagagagatcaagctggtgatgacctgcgccgccttcatcaccatgaaccccggctacgccggcagaaccgagctgcccgacaacctgaaggccctgttcagacccttcgccatgatggtgcccaactacgccctgatcgccgaggtgatcctgtacagcgagggcttcgagagcagcaagatcctggccagaaagatgacccagatgtacaagctgtgcagcgagcagctgagccagcaggaccactacgacttcggcatgagagccgtgaagagcgtgctggtgatggccggcagcctgaagagagagaaccccgacctgaacgaggacgtggtgctgatcagagccctgcaggacagcaacctgcccaagttcctgaccgacgacgccctgctgttcagcggcatcatcagcgacctgttccccggcgtgcagatccccgagcacgactacggcatcctgcagagcaccatcgtggacgtgatgaacagacagaacctgcagcccgagatgtgcatggtgagaaaggtgatccagttctacgagaccatgctggtgagacacggcgtgatgctggtgggccccaccggcggcggcaagaccaccgtgtacagaatcctggccgagaccctgggcaacctgcagaagctgggcatcgagaacagcttctaccaggccgtgaagacctacgtgctgaaccccaagagcatcaccatgggcgagctgtacggcgaggtgaacaacctgaccctggagtggaaggacggcctgatggccctgagcgtgagagccgccgtgaacgacaccagcgaggaccacaagtggatcatcagcgacggccccgtggacgccctgtggatcgagaacatgaacaccgtgctggacgacaacaagatgctgtgcctggccaacagcgagagaatcaagctgaccccccagatccacatgctgttcgaggtgcaggacctgagagtggccagccccgccaccgtgagcagatgcggcatggtgttcgtggaccccgaggagctgaagtggatgccctacgtgaagacctggatgaagggcatcagcaagaagctgaccgaggagacccaggagtacatcctgaacctgttccagagatacgtggacgagggcctgcacttcatcaacaagaagtgcagccaggccatcccccaggtggacatcagcaaggtgaccaccctgtgctgcctgctggagagcctgatcctgggcaaggacggcgtgaacctggccatggagcagaccaagctgaacaccatcctgtgccagaccttcgtgttctgctacctgtggagcctgggcggcaacctgaccgagaactactacgacagcttcgacaccttcatcagaacccagttcgacgacaaccccgacgccagactgcccaacagcggcgacctgtggagcatccacatggacttcgacaccaagagactggacccctgggagagaatcatccccaccttcaagtacaacagagacgtgcccttcttcgagatgctggtgcccaccaccgacaccgtgagatacggctacctgatggagaagctgctggccgtgaagcacagcgtgctgttcaccggcatcaccggcgtgggcaagagcgtgatcgccaagggcctgctgaacaagatccaggagagcgccggctacgtgcccgtgtacctgaacttcagcgcccagaccagcagcgccagaacccaggagatcatcgagagcaagctggagagaaagagaaagaacatcctgggcgcccccggcaacaagagaatcgtgatcttcgtggacgacctgaacatgcccagactggacagatacggcagccagccccccatcgagctgctgagacagtaccaggacttcggcggcttctacgacagaaacaagctgttctggaaggagatccaggacgtgaccatcatcagcgcctgcgccccccccggcggcggcagaaaccccgtgacccccagattcatcagacacttcagcatgctgtgcctgcccatgcccagcgagcacagcctgaagcagatcttccaggccatcctgaacggcttcctgagcgacttcccccccgccgtgaagcagaccgccagcagcatcgtggaggccagcgtggagatctacaacaagatgagcgtggacctgctgcccacccccgccaagagccactacgtgttcaacctgagagacctgagcaagtgcgtgcaggacaagcacttcggcatcgccatcgacctggagtacttcctgaacaagcccatcatcttcggcgacttcatcaagttcggcgccgacaaggccgacagaatctacgacgacatgcccgacatcgagaagaccgccaacgtgctgcaggactacctggacgactacaacctgaccaaccccaaggaggtgaagctggtgttcttccaggacgccatcgagcacgtgagcagaatcgccagaatgatcagacaggagagaggcaacgccctgctggtgggcgtgggcggcaccggcaagcagagcctgaccagactggccgcccacatctgcggctacaagtgcctgcagatcgagctgagcagaggctacaactacgacagcttccacgaggacctgagaaagctgtacaagatggccggcgtggaggacaagaacatggtgttcctgttcaccgacacccagatcgtggtggaggagttcctggaggacatcaacaacatcctgaacagcggcgaggtgcccaacctgttcgagaaggacgagctggagcaggtgctggccgccaccagacccagagccaaggaggtgggcatcagcgagggcaacagagacgaggtgggctgcgccagagtggtgatgtggctgtaccacaagaacgtgagcagccccttcatctag

SEQ ID NO: 79851 - DNA, 14088 bp, Artificial Sequence
  Description of Artificial Sequence: Synthetic coding sequence
ggcgccgaggccccccccagcaccgaggaggccgccccccccagaagcgaggaggaggaggcccccagaccccccaccgtggaggcccccgccgaggacggcttcagccccagcgccgaggacgccgtgagcagcgtggtggactacagagacctgatccccagcgaggagggcatcgtgctgcccgacgaccacgaggccgacctgaacagagtgagacagagactggcccccagacccgtgcagagcgtgatcagcgaggtgctgagcctgcccagcagcagaagaagcagcagatacagaagaagcatgagcggcctgcccaacctgcaggagaccctgaaggagagacaggccagattcagagaggccagagagagcagaagactgaagatcgaccccagctacaagtacatcttcgagatcctggccgagaacctgggcctggacatcgtgaccgtggaggagctgatcctggactgccccagcctggaggccttcaccaacttcttcgccaaggacggctgcaagaccctgaagttcctgtaccaggagggcgacgtgcccggcatcgagtgcggcagaaccatcgccggcgccaccaagggcgccaagatgatgaagctgtacatcgacaacgccgcccccgacaagctgaagggcctgtgcatcttcttcgtgagatgcagaaacgacgtggccatcaacgtgaagaccatccaggaggaggccctgttcaccgtgctggacgccagcaagggcctgctgaacggcatcagagacatgctggccaacatcttcctgcccgccgtgctggccaccaacaactggggcgccctgaaccagagcaagcagggcgagagcgagaagcacatcttcaccgagaccatcaacagatacctgagcttcctggacggcgccagaatcagcatcgagggcaccgtgaagctgaagaccatcgacaacgtgaacttcagcaagctgcacaccttcgaggaggtgaccgccgccgccagcaacagcgagaccgtgcaccagctggaggaggtgctgatggtgtggtacaagcagatcgagcaggtgctgatcgagagcgagcagatgagaaaggaggccggcgacagcggccccctgaccgagctggagcactggaagagaatgagcgccaagttcaactacatcatcgagcagatcaagggccccagctgcaaggccgtgatcaacgtgctgaacgtggcccacagcaagctgctgaagaactggagagacctggacgccagaatcaccgacaccgccaacgagagcaaggacaacgtgagatacctgtacaccctggagaaggtgtgccagcccctgtacaaccacgacctggtgagcatggcccacggcatccagaacctgatcaacgccatcagaatgatccacggcgtgagcagatactacaacaccagcgagagaatgaccagcctgttcatcaaggtgaccaaccagatggtgaccgcctgcaaggcctacatcaccgacggcggcctgaaccacgtgtgggaccaggagacccccgtggtgctgaagaagatccaggactgcatcttcctgttcaaggagtaccaggccagcttccacaagaccagaaagctgatcagcgagagcagcggcgagaagagcttcgaggtgagcgagatgtacatcttcggcaagttcgaggccttctgcaagagactggagaagatcaccgagatgatcaccgtggtgcagacctacagcaccctgagcaacagcaccatcgagggcatcgacatcatggccatcaagttcagaaacatctaccagggcgtgaagaagaagcagtacgacatcctggaccccagaagaaccgagttcgacaccgacttcctggacttcatgaccaagatcaacggcctggaggtgcagatccaggccttcatgaacagcagcttcggcaagatcctgagcagccagcaggccctgcagctgctgcagagattccagaagctgaacatcccctgcctgggcctggagatcaaccacaccatcgagagaatcctgcagtactacgtggccgagctggacgccaccaagaagctgtaccacagccagaaggacgacccccccctggccagaaacatgccccccatcgccggcaagatcctgtgggtgagacagctgtacagaagaatcagcgagcccatcaactacttcttcaagaacagcgacatcctgagcagccccgacggcaaggccgtgatcagacagtacaacaagatcagctacgtgctggtggagttcgaggtggtgtaccacaccgcctggatcagagagatcagccagctgcactacgccctgcaggccaccctgttcgtgagacaccccgagaccggcaagctgctggtgaacttcgaccccaagatcctggaggtggtgagagagaccaagtgcatgatcaagatgaagctggacgtgcccgagcaggccaagagactgctgaagctggagagcaagctgaaggccgacaagctgtacctgcagggcctgctgcagtactacgacgagctgtgccaggaggtgcccagcgtgttcgtgaacctgatgacccccaagatgaagaaggtggagagcgtgctgagacagggcctgaccgtgctgacctggagcagcctgaccctggagagcttcttccaggaggtggagctggtgctggacatgttcaaccagctgctgaagaagatcagcgacctgtgcgagatgcacatcgacaccgtgctgaaggagatcgccaagaccgtgctgatcagcctgcccgagagcggcgccaccaaggtggaggacatgctgaccctgaacgagacctacaccaaggagtgggccgacatcctgaaccacaagagcaagcacgtggaggaggccgtgagagagctgatcagcatcttcgagcagatctacgaggtgaagtacaccggcaaggtgggcaagcagagcgagcagagaaagcacgtggtgttcggcagcgagaccggcgagggcgagaacaacgactacgaggccaacatcgtgaacgagttcgacacccacgacaaggaggacgagttcaagaaggagtgcaaggaggtgttcgccttcttcagccaccagctgctggacagcctgcagaaggccaccagactgagcctggacaccatgaagagaagaatcttcgtggccagcctgtacggcagaaagcagagcgaggacatcatcagcttcatcaagagcgaggtgcacctggccatccccaacgtggtgatgatccccagcctggacgacatccagcaggccatcaacagaatgatccagctgaccctggaggtgagcagaggcgtggcccactggggccagcagcagatcagacccatcaagagcgtgatccccagccccaccaccaccgacgtgacccaccagaacaccggcaagctgctgaagaaggaggagagaagcttcgaggaggccatccccgccagaaagctgaagaacttctaccccggcgtggccgagcacaaggacatcagcaagctggtgctgctgctgagcagcagcgtgaacagcctgagaaaggccgcccacgaggccctgcaggacttccagaagtacaagaccctgtggaccgaggacagagacgtgaaggtgaaggagttcctggccaacaaccccagcctgaccgagatcagaagcgagatcctgcactacgccaccttcgagcaggagatcgacgagctgaagcccatcatcgtggtgggcgccctggagctgcacaccgagcccatgaagctggccctgagcatcgaggccaaggcctggaagatgctgctgtgcagatacctgaacgaggagtacaagaagaagatgagctacatgatcgccttcatcaacgagtacctgaagaagctgagcagacccatcagagacctggacgacgtgagattcgccatggaggccctgagctgcatcagagacaacgagatccagatggacatgaccctgggccccatcgaggaggcctacgccatcctgaacagattcgaggtggaggtgaccaaggaggagagcgaggccgtggacaccctgagatacagcttcaacaagctgcagagcaaggccgtgagcgtgcaggaggacctggtgcaggtgcagcccaagttcaagagcaacctgctggagagcgtggaggtgttcagagaggacgtgatcaacttcgccgaggcctacgagctggagggccccatggtgcccaacatccccccccaggaggccagcaacagactgcagatcttccaggccagcttcgacgacctgtggagaaagttcgtgacctacagcagcggcgagcagctgttcggcctgcccgtgaccgactacgaggtgctgcacaagaccagaaaggagctgaacctgctgcagaagctgtacggcctgtacgacaccgtgatgagcagcatcagcggctactacgagatcctgtggggcgacgtggacatcgagaagatcaacgccgagctgctggagttccagaacagatgcagaaagctgcccaagggcctgaaggactggcaggccttcctggacctgaagaagagaatcgacgacttcagcgagagctgccccctgctggagatgatgaccaacaaggccatgaagcagagacactgggacagaatcagcgagctgaccggcacccccttcgacgtggagagcgacagcttctgcctgagaaacatcatggaggcccccctgctgaagcacaaggacgacatcgaggacatctgcatcagcgccatcaaggagaaggacatcgaggccaagctgacccaggtgatcgagaactggaccaaccagaacctgagcttcgccgccttcaagggcaagggcgagctgctgctgaagggcaccgagagcggcgagatcatcaccctgatggaggacagcctgatggtgctgggcagcctgctgagcaacagatacaacgcccccttcaagaagaacatccagaactgggtgtacaagctgagcaccagcagcgacatcatcgaggagtggctggtggtgcagaacctgtgggtgtacctggaggccgtgttcgtgggcggcgacatcgccaagcagctgccccaggaggccaagagattccagaacatcgacaagagctggatcaagatcatgcagagagcccacgagaaccccaacgtgatcaactgctgcgtgggcgacgagaccatgggccagctgctgccccacctgcacgagcagctggaggtgtgccagaagagcctgaccggctacctggagaagaagagactgctgttccccagattcttcttcgtgagcgaccccgtgctgctggagatcctgggccaggccagcgacagccacaccatccagccccacctgcccgccgtgagcgacaacatcaacgaggtgaccttccacgccaaggactacgacagaatcatggccgtgatcagcagagagggcgagaagatcgtgctggacaacagcgtgatggccaagggccccgtggagatctggctgctggacctgctgaagatgcagatgagcagcctgcacaacatcatcagaagcgccttctaccagatcagcgacagcggcttccagctgctgcccttcctgagccacttccccgcccaggtgggcctgctgggcatccagatgctgtggacccacgacagcgaggaggccctgagaaacgccaaggacgacagaaagatcatgcaggtgaccaaccagaagttcctggacatcctgaacaccctgatcagccagaccacccacgacctgagcaagttcgacagagtgaagttcgagaccctgatcaccatccacgtgcaccagagagacatcttcgacgacctggtgaagatgcacatcaagagccccaccgacttcgagtggctgaagcagagcagattctacttcaaggaggacctggaccagaccgtggtgagcatcaccgacgtggacttcatctaccagaacgagttcctgggctgcaccgacagactggtgatcacccccctgaccgacagatgctacatcaccctggcccaggccctgggcatgaacatgggcggcgcccccgccggccccgccggcaccggcaagaccgagaccaccaaggacatgggcagatgcctgggcaagtacgtggtggtgttcaactgcagcgaccagatggacttcagaggcctgggcagaatcttcaagggcctggcccagagcggcagctggggctgcttcgacgagttcaacagaatcgagctgcccgtgctgagcgtggccgcccagcagatctacatcgtgctgaccgccagaaaggagagaaagaagcagttcatcttcagcgacggcgactgcgtggacctgaaccccgagttcggcatcttcctgaccatgaaccccggctacgccggcagacaggagctgcccgagaacctgaagatccagttcagaaccgtggccatgatggtgcccgacagacagatcatcatgagagtgaagctggccagctgcggcttcctggagaacgtgatcctggcccagaagttctacgtgctgtacaagctgtgcgaggagcagctgaccaagcaggtgcactacgacttcggcctgagaaacatcctgagcgtgctgagaaccctgggcagccagaagagagccagacccgaggacagcgagctgagcatcgtgatgagaggcctgagagacatgaacctgagcaagctggtggacgaggacgagcccctgttcctgagcctgatcaacgacctgttccccggcctgcagctggacagcaacacctacgccgagctgcagaacgccgtggcccaccaggtgcagatcgagggcctgatcaaccaccccccctggaacctgaagctggtgcagctgtacgagaccagcctggtgagacacggcctgatgaccctgggccccagcggcagcggcaagaccaccgtgatcaccatcctgatgaaggcccagaccgagtgcggcagaccccacagagagatgagaatgaaccccaaggccatcaccgccccccagatgttcggcagactggacaccgccaccaacgactggaccgacggcatcttcagcaccctgtggagaaagaccctgaaggccaagaagggcgagaacatcttcctgatcctggacggccccgtggacgccatctggatcgagaacctgaacagcgtgctggacgacaacaagaccctgaccctggccaacggcgacagaatccccatggcccccagctgcaagctgctgttcgaggtgcacaacatcgagaacgccagccccgccaccgtgagcagaatgggcatggtgtacatcagcagcagcgccctgagctggagacccatcctgcaggcctggctgaagaagagaaccgcccaggaggccgccgtgttcctgaccctgtacgagaaggtgttcgaggacacctacacctacatgaagctgaacctgaaccccaagatgcagctgctggagtgcaactacatcgtgcagagcctgaacctgctggagggcctgatccccagcaaggaggagggcggcgtgagctgcgtggagcacctgcacaagctgttcgtgttcggcctgatgtggagcctgggcgccctgctggagctggagagcagagagaagctggaggccttcctgagacagcacgagagcaagctggacctgcccgagatccccaagggcagcaaccagaccatgtacgagttctacgtgaccgactacggcgactgggagcactggaacaagaagctgcagccctactactaccccaccgacagcatccccgagtacagcagcatcctggtgcccaacgtggacaacatcagaaccaacttcctgatcgacaccatcgccaagcagcacaaggccgtgctgctgaccggcgagcagggcaccgccaagaccgtgatggtgaaggcctacctgaagaagtacgaccccgaggtgcagctgagcaagagcctgaacttcagcagcgccaccgagcccatgatgttccagagaaccatcgagagctacgtggacaagagaatcggcagcacctacggcccccccggcggcagaaagatgaccgtgttcatcgacgacatcaacatgcccgtgatcaacgagtggggcgaccagatcaccaacgagatcgtgagacagatgatggagatggagggcatgtacagcctggacaagcccggcgacttcaccaccatcgtggacgtgcagctgatcgccgccatgatccaccccggcggcggcagaaacgacatcccccagagactgaagagacagttcaccgtgttcaactgcaccctgcccagcaacgccagcatcgacaagatcttcggcatcatcggctgcggctacttcgacccctgcagaagcttcaagccccagatctgcgagatgatcgtgaacctggtgagcgtgggcagagtgctgtggcagtggaccaaggtgaagatgctgcccacccccagcaagttccactacatcttcaacctgagagacctgagcagaatctggcagggcatgctgaccatcaaggccgaggagtgcgccagcatccccaccctgctgagcctgttcaagcacgagtgcagcagagtgatcgccgacagattcatcacccccgaggacgagcagtggttcaacgcccacctgaccagagccgtggaggagaacatcggcagcgacgccgccagctgcatcctgcccgagccctacttcgtggacttcctgagagagatgcccgagcccaccggcgacgagcccgaggacagcgtgttcgaggtgcccaagatctacgagctgatgcccagcttcgacttcctggccgagaagctgcagttctaccagagacagttcaacgagatcatcagaggcaccagcctggacctggtgttcttcaaggacgccatgacccacctgatcaagatcagcagaatcatcagaaccagctgcggcaacgccctgctggtgggcgtgggcggcagcggcaagcagagcctgagcagactggccagcttcatcgccggctaccagatcttccagatcaccctgaccagaagctacaacgtgaccaacctgaccgacgacctgaaggccctgtacaaggtggccggcgccgacggcaagggcatcaccttcatcttcaccgacagcgagatcaaggacgaggccttcctggagtacctgaacaacctgctgagcagcggcgagatcagcaacctgttcgccagagacgagatggacgagatcacccagggcctgatcagcgtgatgaagagagagctgcccagacacccccccaccttcgacaacctgtacgagtacttcatcagcagaagcagaaagaacctgcacgtggtgctgtgcttcagccccgtgggcgagaagttcagagccagaagcctgaagttccccggcctgatcagcggctgcaccatggactggttcagcagatggcccagagaggccctgatcgccgtggccagctacttcctgagcgactacaacatcgtgtgcagcagcgagatcaagagacaggtggtggagaccatgggcctgttccacgacatggtgagcgagagctgcgagagctacttccagagatacagaagaagagcccacgtgacccccaagagctacctgagcttcatcaacggctacaagaacatctacgccgagaaggtgaagttcatcaacgagcaggccgagagaatgaacatcggcctggacaagctgatggaggccagcgagagcgtggccaagctgagccaggacctggccgtgaaggagaaggagctggccgtggccagcatcaaggccgacgaggtgctggccgaggtgaccgtgagcgcccaggccagcgccaagatcaagaacgaggtgcaggaggtgaaggacaaggcccagaagatcgtggacgagatcgacagcgagaaggtgaaggccgagagcaagctggaggccgccaagcccgccctggaggaggccgaggccgccctgaacaccatcaagcccaacgacatcgccaccgtgagaaagctggccaagcccccccacctgatcatgagaatcatggactgcgtgctgctgctgttccagaagaagatcgaccccgtgaccatggaccccgagaagagctgctgcaagcccagctggggcgagagcctgaagctgatgagcgccaccggcttcctgtggagcctgcagcagttccccaaggacaccatcaacgaggagaccgtggagctgctgcagccctacttcaacatggacgactacaccttcgagagcgccaagaaggtgtgcggcaacgtggccggcctgctgagctggaccctggccatggccatcttctacggcatcaacagagaggtgctgcccctgaaggccaacctggccaagcaggagggcagactggccgtggccaacgccgagctgggcaaggcccaggccctgctggacgagaagcaggccgagctggacaaggtgcaggccaagttcgacgccgccatgaacgagaagatggacctgctgaacgacgccgacacctgcagaaagaagatgcaggccgccagcaccctgatcgacggcctgagcggcgagaagatcagatggacccagcagagcaaggagttcaaggcccagatcaacagactggtgggcgacatcctgctgtgcaccggcttcctgagctacctgggccccttcaaccagatcttcagaaactacctgctgaaggaccagtgggagatggagctgagagccagaaagatccccttcaccgagaacctgaacctgatcagcatgctggtggacccccccaccatcggcgagtggggcctgcagggcctgcccggcgacgacctgagcatccagaacggcatcatcgtgaccaaggccaccagataccccctgctgatcgacccccagacccagggcaagacctggatcaagagcaaggagaaggagaacgacctgcaggtgaccagcctgaaccacaagtacttcagaacccacctggaggacagcctgagcctgggcagacccctgctgatcgaggacatccacgaggagctggaccccgccctggacaacgtgctggagaagaacttcatcaagagcggcaccaccttcaaggtgaaggtgggcgacaaggagtgcgacatcatggacaccttcaagctgtacatcaccaccaagctgcccaaccccgccttcacccccgagatcaacgccaagaccagcgtgatcgacttcaccgtgaccatgaagggcctggagaaccagctgctgagaagagtgatcctgaccgagaagcaggagctggaggccgagagagtgaagctgctggaggacgtgaccttcaacaagagaaagatgaaggagctggaggacaacctgctgtacaagctgagcgccaccaagggcagcctggtggacgacgagagcctgatcggcgtgctgagaaccaccaagcagaccgccgccgaggtgagcgagaagctgcacgtggccgccgagaccgagatcaagatcaacgccgcccaggaggagttcagacccgccgccaccagaggcagcatcctgtacttcctgatcaccgagatgagcatggtgaacatcatgtaccagaccagcctggcccagttcctgaagctgttcgaccagagcatggccagaagcgagaagagccccctgccccagaagagaatcaccaacatcatcgagtacctgacctacgaggtgttcacctacagcgtgagaggcctgtacgagaaccacaagttcctgttcgtgctgctgatgaccctgaagatcgacctgcagagaggcaccgtgaagcacagagagttccaggccctgatcaagggcggcgccgccctggacctgaaggcctgcccccccaagccctacagatggatcctggacatgacctggctgaacctggtggagctgagcaagctgccccagttcgccgagatcatgaaccagatcagcagaaacgagaagggctggaagagctggttcgacaaggacgcccccgaggaggagatcatccccgacggctacaacgacagcctggacacctgccacaagctgctgctgatcagaagctggtgccccgacagaaccgtgttccaggccagaaagtacatcgccgacagcctggaggagaagtacaccgagcccgtgatcctgaacctggagaagacctgggaggagagcgacaccagaacccccctgatctgcttcctgagcatgggcagcgaccccaccaaccagatcgacgccctggccaagaagctgaagctggagtgcagaaccatcagcatgggccagggccaggaggtgcacgccagaaagctgatccagatgagcatgcagcagggcggctgggtgctgctgcagaactgccacctgggcctggagttcatggaggagctgctggagaccctgatcaccaccgaggccagcgacgacagcttcagagtgtggatcaccaccgagccccacgacagattccccatcaccctgctgcagaccagcctgaagttcaccaacgagcccccccagggcgtgagagccggcctgaagagaaccttcgccggcatcaaccaggacctgctggacatcagcaacctgcccatgtggaagcccatgctgtacaccgtggccttcctgcacagcaccgtgcaggagagaagaaagttcggccccctgggctggaacatcccctacgagttcaacagcgccgacttcagcgccagcgtgcagttcatccagaaccacctggacgagtgcgacatcaagaagggcgtgagctggaacaccgtgagatacatgatcggcgaggtgcagtacggcggcagagtgaccgacgacttcgacaagagactgctgaactgcttcgccagagtgtggttcagcgagaagatgttcgagcccagcttctgcttctacaccggctacaagatccccctgtgcaagaccctggaccagtacttcgagtacatccagagcctgcccagcctggacaaccccgaggtgttcggcctgcaccccaacgccgacatcacctaccagagcaacaccgccagcgccgtgctggagaccatcaccaacatccagcccaaggagagcggcggcggcgtgggcgagaccagagaggccatcgtgtacagactgagcgaggacatgctgagcaagctgccccccgactacatcccccacgaggtgaagagcagactgatcaagatgggccacctgaacagcatgaacatcttcctgagacaggagatcgacagaatgcagagagtgatcagcatcctgagaagcagcctgagcgacctgaagctggccatcgagggcaccatcatcatgagcgagaacctgagagacgccctggacaacatgtacgacgccagaatcccccagctgtggaagagagtgagctgggacagcagcaccctgggcttctggttcaccgagctgctggagagaaacgcccagttcagcacctggatcttcgagggcagacccaacgtgttctggatgaccggcttcttcaacccccagggcttcctgaccgccatgagacaggaggtgaccagagcccacaagggctgggccctggacaccgtgaccatccacaacgaggtgctgagacagaccaaggaggagatcaccagcccccccggcgagggcgtgtacatctacggcctgtacatggacggcgccgcctgggacagaagaaacggcaagctgatggagagcacccccaaggtgctgttcacccagctgcccgtgctgcacatcttcgccatcaacagcaccgcccccaaggaccccaagctgtacgtgtgccccatctacaagaagcccagaagaaccgacctgaccttcatcaccgtggtgtacctgagaaccgtgctgagccccgaccactggatcctgagaggcgtggccctgctgtgcgacatcaagtag

SEQ ID NO: 79852 - DNA, 13473 bp, Artificial Sequence
  Description of Artificial Sequence: Synthetic coding sequence
atgatgaagctgtacatcgacaacgccgcccccgacaagctgaagggcctgtgcatcttcttcgtgagatgcagaaacgacgtggccatcaacgtgaagaccatccaggaggaggccctgttcaccgtgctggacgccagcaagggcctgctgaacggcatcagagacatgctggccaacatcttcctgcccgccgtgctggccaccaacaactggggcgccctgaaccagagcaagcagggcgagagcgagaagcacatcttcaccgagaccatcaacagatacctgagcttcctggacggcgccagaatcagcatcgagggcaccgtgaagctgaagaccatcgacaacgtgaacttcagcaagctgcacaccttcgaggaggtgaccgccgccgccagcaacagcgagaccgtgcaccagctggaggaggtgctgatggtgtggtacaagcagatcgagcaggtgctgatcgagagcgagcagatgagaaaggaggccggcgacagcggccccctgaccgagctggagcactggaagagaatgagcgccaagttcaactacatcatcgagcagatcaagggccccagctgcaaggccgtgatcaacgtgctgaacgtggcccacagcaagctgctgaagaactggagagacctggacgccagaatcaccgacaccgccaacgagagcaaggacaacgtgagatacctgtacaccctggagaaggtgtgccagcccctgtacaaccacgacctggtgagcatggcccacggcatccagaacctgatcaacgccatcagaatgatccacggcgtgagcagatactacaacaccagcgagagaatgaccagcctgttcatcaaggtgaccaaccagatggtgaccgcctgcaaggcctacatcaccgacggcggcctgaaccacgtgtgggaccaggagacccccgtggtgctgaagaagatccaggactgcatcttcctgttcaaggagtaccaggccagcttccacaagaccagaaagctgatcagcgagagcagcggcgagaagagcttcgaggtgagcgagatgtacatcttcggcaagttcgaggccttctgcaagagactggagaagatcaccgagatgatcaccgtggtgcagacctacagcaccctgagcaacagcaccatcgagggcatcgacatcatggccatcaagttcagaaacatctaccagggcgtgaagaagaagcagtacgacatcctggaccccagaagaaccgagttcgacaccgacttcctggacttcatgaccaagatcaacggcctggaggtgcagatccaggccttcatgaacagcagcttcggcaagatcctgagcagccagcaggccctgcagctgctgcagagattccagaagctgaacatcccctgcctgggcctggagatcaaccacaccatcgagagaatcctgcagtactacgtggccgagctggacgccaccaagaagctgtaccacagccagaaggacgacccccccctggccagaaacatgccccccatcgccggcaagatcctgtgggtgagacagctgtacagaagaatcagcgagcccatcaactacttcttcaagaacagcgacatcctgagcagccccgacggcaaggccgtgatcagacagtacaacaagatcagctacgtgctggtggagttcgaggtggtgtaccacaccgcctggatcagagagatcagccagctgcactacgccctgcaggccaccctgttcgtgagacaccccgagaccggcaagctgctggtgaacttcgaccccaagatcctggaggtggtgagagagaccaagtgcatgatcaagatgaagctggacgtgcccgagcaggccaagagactgctgaagctggagagcaagctgaaggccgacaagctgtacctgcagggcctgctgcagtactacgacgagctgtgccaggaggtgcccagcgtgttcgtgaacctgatgacccccaagatgaagaaggtggagagcgtgctgagacagggcctgaccgtgctgacctggagcagcctgaccctggagagcttcttccaggaggtggagctggtgctggacatgttcaaccagctgctgaagaagatcagcgacctgtgcgagatgcacatcgacaccgtgctgaaggagatcgccaagaccgtgctgatcagcctgcccgagagcggcgccaccaaggtggaggacatgctgaccctgaacgagacctacaccaaggagtgggccgacatcctgaaccacaagagcaagcacgtggaggaggccgtgagagagctgatcagcatcttcgagcagatctacgaggtgaagtacaccggcaaggtgggcaagcagagcgagcagagaaagcacgtggtgttcggcagcgagaccggcgagggcgagaacaacgactacgaggccaacatcgtgaacgagttcgacacccacgacaaggaggacgagttcaagaaggagtgcaaggaggtgttcgccttcttcagccaccagctgctggacagcctgcagaaggccaccagactgagcctggacaccatgaagagaagaatcttcgtggccagcctgtacggcagaaagcagagcgaggacatcatcagcttcatcaagagcgaggtgcacctggccatccccaacgtggtgatgatccccagcctggacgacatccagcaggccatcaacagaatgatccagctgaccctggaggtgagcagaggcgtggcccactggggccagcagcagatcagacccatcaagagcgtgatccccagccccaccaccaccgacgtgacccaccagaacaccggcaagctgctgaagaaggaggagagaagcttcgaggaggccatccccgccagaaagctgaagaacttctaccccggcgtggccgagcacaaggacatcagcaagctggtgctgctgctgagcagcagcgtgaacagcctgagaaaggccgcccacgaggccctgcaggacttccagaagtacaagaccctgtggaccgaggacagagacgtgaaggtgaaggagttcctggccaacaaccccagcctgaccgagatcagaagcgagatcctgcactacgccaccttcgagcaggagatcgacgagctgaagcccatcatcgtggtgggcgccctggagctgcacaccgagcccatgaagctggccctgagcatcgaggccaaggcctggaagatgctgctgtgcagatacctgaacgaggagtacaagaagaagatgagctacatgatcgccttcatcaacgagtacctgaagaagctgagcagacccatcagagacctggacgacgtgagattcgccatggaggccctgagctgcatcagagacaacgagatccagatggacatgaccctgggccccatcgaggaggcctacgccatcctgaacagattcgaggtggaggtgaccaaggaggagagcgaggccgtggacaccctgagatacagcttcaacaagctgcagagcaaggccgtgagcgtgcaggaggacctggtgcaggtgcagcccaagttcaagagcaacctgctggagagcgtggaggtgttcagagaggacgtgatcaacttcgccgaggcctacgagctggagggccccatggtgcccaacatccccccccaggaggccagcaacagactgcagatcttccaggccagcttcgacgacctgtggagaaagttcgtgacctacagcagcggcgagcagctgttcggcctgcccgtgaccgactacgaggtgctgcacaagaccagaaaggagctgaacctgctgcagaagctgtacggcctgtacgacaccgtgatgagcagcatcagcggctactacgagatcctgtggggcgacgtggacatcgagaagatcaacgccgagctgctggagttccagaacagatgcagaaagctgcccaagggcctgaaggactggcaggccttcctggacctgaagaagagaatcgacgacttcagcgagagctgccccctgctggagatgatgaccaacaaggccatgaagcagagacactgggacagaatcagcgagctgaccggcacccccttcgacgtggagagcgacagcttctgcctgagaaacatcatggaggcccccctgctgaagcacaaggacgacatcgaggacatctgcatcagcgccatcaaggagaaggacatcgaggccaagctgacccaggtgatcgagaactggaccaaccagaacctgagcttcgccgccttcaagggcaagggcgagctgctgctgaagggcaccgagagcggcgagatcatcaccctgatggaggacagcctgatggtgctgggcagcctgctgagcaacagatacaacgcccccttcaagaagaacatccagaactgggtgtacaagctgagcaccagcagcgacatcatcgaggagtggctggtggtgcagaacctgtgggtgtacctggaggccgtgttcgtgggcggcgacatcgccaagcagctgccccaggaggccaagagattccagaacatcgacaagagctggatcaagatcatgcagagagcccacgagaaccccaacgtgatcaactgctgcgtgggcgacgagaccatgggccagctgctgccccacctgcacgagcagctggaggtgtgccagaagagcctgaccggctacctggagaagaagagactgctgttccccagattcttcttcgtgagcgaccccgtgctgctggagatcctgggccaggccagcgacagccacaccatccagccccacctgcccgccgtgagcgacaacatcaacgaggtgaccttccacgccaaggactacgacagaatcatggccgtgatcagcagagagggcgagaagatcgtgctggacaacagcgtgatggccaagggccccgtggagatctggctgctggacctgctgaagatgcagatgagcagcctgcacaacatcatcagaagcgccttctaccagatcagcgacagcggcttccagctgctgcccttcctgagccacttccccgcccaggtgggcctgctgggcatccagatgctgtggacccacgacagcgaggaggccctgagaaacgccaaggacgacagaaagatcatgcaggtgaccaaccagaagttcctggacatcctgaacaccctgatcagccagaccacccacgacctgagcaagttcgacagagtgaagttcgagaccctgatcaccatccacgtgcaccagagagacatcttcgacgacctggtgaagatgcacatcaagagccccaccgacttcgagtggctgaagcagagcagattctacttcaaggaggacctggaccagaccgtggtgagcatcaccgacgtggacttcatctaccagaacgagttcctgggctgcaccgacagactggtgatcacccccctgaccgacagatgctacatcaccctggcccaggccctgggcatgaacatgggcggcgcccccgccggccccgccggcaccggcaagaccgagaccaccaaggacatgggcagatgcctgggcaagtacgtggtggtgttcaactgcagcgaccagatggacttcagaggcctgggcagaatcttcaagggcctggcccagagcggcagctggggctgcttcgacgagttcaacagaatcgagctgcccgtgctgagcgtggccgcccagcagatctacatcgtgctgaccgccagaaaggagagaaagaagcagttcatcttcagcgacggcgactgcgtggacctgaaccccgagttcggcatcttcctgaccatgaaccccggctacgccggcagacaggagctgcccgagaacctgaagatccagttcagaaccgtggccatgatggtgcccgacagacagatcatcatgagagtgaagctggccagctgcggcttcctggagaacgtgatcctggcccagaagttctacgtgctgtacaagctgtgcgaggagcagctgaccaagcaggtgcactacgacttcggcctgagaaacatcctgagcgtgctgagaaccctgggcagccagaagagagccagacccgaggacagcgagctgagcatcgtgatgagaggcctgagagacatgaacctgagcaagctggtggacgaggacgagcccctgttcctgagcctgatcaacgacctgttccccggcctgcagctggacagcaacacctacgccgagctgcagaacgccgtggcccaccaggtgcagatcgagggcctgatcaaccaccccccctggaacctgaagctggtgcagctgtacgagaccagcctggtgagacacggcctgatgaccctgggccccagcggcagcggcaagaccaccgtgatcaccatcctgatgaaggcccagaccgagtgcggcagaccccacagagagatgagaatgaaccccaaggccatcaccgccccccagatgttcggcagactggacaccgccaccaacgactggaccgacggcatcttcagcaccctgtggagaaagaccctgaaggccaagaagggcgagaacatcttcctgatcctggacggccccgtggacgccatctggatcgagaacctgaacagcgtgctggacgacaacaagaccctgaccctggccaacggcgacagaatccccatggcccccagctgcaagctgctgttcgaggtgcacaacatcgagaacgccagccccgccaccgtgagcagaatgggcatggtgtacatcagcagcagcgccctgagctggagacccatcctgcaggcctggctgaagaagagaaccgcccaggaggccgccgtgttcctgaccctgtacgagaaggtgttcgaggacacctacacctacatgaagctgaacctgaaccccaagatgcagctgctggagtgcaactacatcgtgcagagcctgaacctgctggagggcctgatccccagcaaggaggagggcggcgtgagctgcgtggagcacctgcacaagctgttcgtgttcggcctgatgtggagcctgggcgccctgctggagctggagagcagagagaagctggaggccttcctgagacagcacgagagcaagctggacctgcccgagatccccaagggcagcaaccagaccatgtacgagttctacgtgaccgactacggcgactgggagcactggaacaagaagctgcagccctactactaccccaccgacagcatccccgagtacagcagcatcctggtgcccaacgtggacaacatcagaaccaacttcctgatcgacaccatcgccaagcagcacaaggccgtgctgctgaccggcgagcagggcaccgccaagaccgtgatggtgaaggcctacctgaagaagtacgaccccgaggtgcagctgagcaagagcctgaacttcagcagcgccaccgagcccatgatgttccagagaaccatcgagagctacgtggacaagagaatcggcagcacctacggcccccccggcggcagaaagatgaccgtgttcatcgacgacatcaacatgcccgtgatcaacgagtggggcgaccagatcaccaacgagatcgtgagacagatgatggagatggagggcatgtacagcctggacaagcccggcgacttcaccaccatcgtggacgtgcagctgatcgccgccatgatccaccccggcggcggcagaaacgacatcccccagagactgaagagacagttcaccgtgttcaactgcaccctgcccagcaacgccagcatcgacaagatcttcggcatcatcggctgcggctacttcgacccctgcagaagcttcaagccccagatctgcgagatgatcgtgaacctggtgagcgtgggcagagtgctgtggcagtggaccaaggtgaagatgctgcccacccccagcaagttccactacatcttcaacctgagagacctgagcagaatctggcagggcatgctgaccatcaaggccgaggagtgcgccagcatccccaccctgctgagcctgttcaagcacgagtgcagcagagtgatcgccgacagattcatcacccccgaggacgagcagtggttcaacgcccacctgaccagagccgtggaggagaacatcggcagcgacgccgccagctgcatcctgcccgagccctacttcgtggacttcctgagagagatgcccgagcccaccggcgacgagcccgaggacagcgtgttcgaggtgcccaagatctacgagctgatgcccagcttcgacttcctggccgagaagctgcagttctaccagagacagttcaacgagatcatcagaggcaccagcctggacctggtgttcttcaaggacgccatgacccacctgatcaagatcagcagaatcatcagaaccagctgcggcaacgccctgctggtgggcgtgggcggcagcggcaagcagagcctgagcagactggccagcttcatcgccggctaccagatcttccagatcaccctgaccagaagctacaacgtgaccaacctgaccgacgacctgaaggccctgtacaaggtggccggcgccgacggcaagggcatcaccttcatcttcaccgacagcgagatcaaggacgaggccttcctggagtacctgaacaacctgctgagcagcggcgagatcagcaacctgttcgccagagacgagatggacgagatcacccagggcctgatcagcgtgatgaagagagagctgcccagacacccccccaccttcgacaacctgtacgagtacttcatcagcagaagcagaaagaacctgcacgtggtgctgtgcttcagccccgtgggcgagaagttcagagccagaagcctgaagttccccggcctgatcagcggctgcaccatggactggttcagcagatggcccagagaggccctgatcgccgtggccagctacttcctgagcgactacaacatcgtgtgcagcagcgagatcaagagacaggtggtggagaccatgggcctgttccacgacatggtgagcgagagctgcgagagctacttccagagatacagaagaagagcccacgtgacccccaagagctacctgagcttcatcaacggctacaagaacatctacgccgagaaggtgaagttcatcaacgagcaggccgagagaatgaacatcggcctggacaagctgatggaggccagcgagagcgtggccaagctgagccaggacctggccgtgaaggagaaggagctggccgtggccagcatcaaggccgacgaggtgctggccgaggtgaccgtgagcgcccaggccagcgccaagatcaagaacgaggtgcaggaggtgaaggacaaggcccagaagatcgtggacgagatcgacagcgagaaggtgaaggccgagagcaagctggaggccgccaagcccgccctggaggaggccgaggccgccctgaacaccatcaagcccaacgacatcgccaccgtgagaaagctggccaagcccccccacctgatcatgagaatcatggactgcgtgctgctgctgttccagaagaagatcgaccccgtgaccatggaccccgagaagagctgctgcaagcccagctggggcgagagcctgaagctgatgagcgccaccggcttcctgtggagcctgcagcagttccccaaggacaccatcaacgaggagaccgtggagctgctgcagccctacttcaacatggacgactacaccttcgagagcgccaagaaggtgtgcggcaacgtggccggcctgctgagctggaccctggccatggccatcttctacggcatcaacagagaggtgctgcccctgaaggccaacctggccaagcaggagggcagactggccgtggccaacgccgagctgggcaaggcccaggccctgctggacgagaagcaggccgagctggacaaggtgcaggccaagttcgacgccgccatgaacgagaagatggacctgctgaacgacgccgacacctgcagaaagaagatgcaggccgccagcaccctgatcgacggcctgagcggcgagaagatcagatggacccagcagagcaaggagttcaaggcccagatcaacagactggtgggcgacatcctgctgtgcaccggcttcctgagctacctgggccccttcaaccagatcttcagaaactacctgctgaaggaccagtgggagatggagctgagagccagaaagatccccttcaccgagaacctgaacctgatcagcatgctggtggacccccccaccatcggcgagtggggcctgcagggcctgcccggcgacgacctgagcatccagaacggcatcatcgtgaccaaggccaccagataccccctgctgatcgacccccagacccagggcaagacctggatcaagagcaaggagaaggagaacgacctgcaggtgaccagcctgaaccacaagtacttcagaacccacctggaggacagcctgagcctgggcagacccctgctgatcgaggacatccacgaggagctggaccccgccctggacaacgtgctggagaagaacttcatcaagagcggcaccaccttcaaggtgaaggtgggcgacaaggagtgcgacatcatggacaccttcaagctgtacatcaccaccaagctgcccaaccccgccttcacccccgagatcaacgccaagaccagcgtgatcgacttcaccgtgaccatgaagggcctggagaaccagctgctgagaagagtgatcctgaccgagaagcaggagctggaggccgagagagtgaagctgctggaggacgtgaccttcaacaagagaaagatgaaggagctggaggacaacctgctgtacaagctgagcgccaccaagggcagcctggtggacgacgagagcctgatcggcgtgctgagaaccaccaagcagaccgccgccgaggtgagcgagaagctgcacgtggccgccgagaccgagatcaagatcaacgccgcccaggaggagttcagacccgccgccaccagaggcagcatcctgtacttcctgatcaccgagatgagcatggtgaacatcatgtaccagaccagcctggcccagttcctgaagctgttcgaccagagcatggccagaagcgagaagagccccctgccccagaagagaatcaccaacatcatcgagtacctgacctacgaggtgttcacctacagcgtgagaggcctgtacgagaaccacaagttcctgttcgtgctgctgatgaccctgaagatcgacctgcagagaggcaccgtgaagcacagagagttccaggccctgatcaagggcggcgccgccctggacctgaaggcctgcccccccaagccctacagatggatcctggacatgacctggctgaacctggtggagctgagcaagctgccccagttcgccgagatcatgaaccagatcagcagaaacgagaagggctggaagagctggttcgacaaggacgcccccgaggaggagatcatccccgacggctacaacgacagcctggacacctgccacaagctgctgctgatcagaagctggtgccccgacagaaccgtgttccaggccagaaagtacatcgccgacagcctggaggagaagtacaccgagcccgtgatcctgaacctggagaagacctgggaggagagcgacaccagaacccccctgatctgcttcctgagcatgggcagcgaccccaccaaccagatcgacgccctggccaagaagctgaagctggagtgcagaaccatcagcatgggccagggccaggaggtgcacgccagaaagctgatccagatgagcatgcagcagggcggctgggtgctgctgcagaactgccacctgggcctggagttcatggaggagctgctggagaccctgatcaccaccgaggccagcgacgacagcttcagagtgtggatcaccaccgagccccacgacagattccccatcaccctgctgcagaccagcctgaagttcaccaacgagcccccccagggcgtgagagccggcctgaagagaaccttcgccggcatcaaccaggacctgctggacatcagcaacctgcccatgtggaagcccatgctgtacaccgtggccttcctgcacagcaccgtgcaggagagaagaaagttcggccccctgggctggaacatcccctacgagttcaacagcgccgacttcagcgccagcgtgcagttcatccagaaccacctggacgagtgcgacatcaagaagggcgtgagctggaacaccgtgagatacatgatcggcgaggtgcagtacggcggcagagtgaccgacgacttcgacaagagactgctgaactgcttcgccagagtgtggttcagcgagaagatgttcgagcccagcttctgcttctacaccggctacaagatccccctgtgcaagaccctggaccagtacttcgagtacatccagagcctgcccagcctggacaaccccgaggtgttcggcctgcaccccaacgccgacatcacctaccagagcaacaccgccagcgccgtgctggagaccatcaccaacatccagcccaaggagagcggcggcggcgtgggcgagaccagagaggccatcgtgtacagactgagcgaggacatgctgagcaagctgccccccgactacatcccccacgaggtgaagagcagactgatcaagatgggccacctgaacagcatgaacatcttcctgagacaggagatcgacagaatgcagagagtgatcagcatcctgagaagcagcctgagcgacctgaagctggccatcgagggcaccatcatcatgagcgagaacctgagagacgccctggacaacatgtacgacgccagaatcccccagctgtggaagagagtgagctgggacagcagcaccctgggcttctggttcaccgagctgctggagagaaacgcccagttcagcacctggatcttcgagggcagacccaacgtgttctggatgaccggcttcttcaacccccagggcttcctgaccgccatgagacaggaggtgaccagagcccacaagggctgggccctggacaccgtgaccatccacaacgaggtgctgagacagaccaaggaggagatcaccagcccccccggcgagggcgtgtacatctacggcctgtacatggacggcgccgcctgggacagaagaaacggcaagctgatggagagcacccccaaggtgctgttcacccagctgcccgtgctgcacatcttcgccatcaacagcaccgcccccaaggaccccaagctgtacgtgtgccccatctacaagaagcccagaagaaccgacctgaccttcatcaccgtggtgtacctgagaaccgtgctgagccccgaccactggatcctgagaggcgtggccctgctgtgcgacatcaagtag

SEQ ID NO: 79853 - DNA, 13365 bp, Artificial Sequence
  Description of Artificial Sequence: Synthetic coding sequence
atgatgaagctgtacatcgacaacgccgcccccgacaagctgaagggcctgtgcatcttcttcgtgagatgcagaaacgacgtggccatcaacgtgaagaccatccaggaggaggccctgttcaccgtgctggacgccagcaagggcctgctgaacggcatcagagacatgctggccaacatcttcctgcccgccgtgctggccaccaacaactggggcgccctgaaccagagcaagcagggcgagagcgagaagcacatcttcaccgagaccatcaacagatacctgagcttcctggacggcgccagaatcagcatcgagggcaccgtgaagctgaagaccatcgacaacgtgaacttcagcaagctgcacaccttcgaggaggtgaccgccgccgccagcaacagcgagaccgtgcaccagctggaggaggtgctgatggtgtggtacaagcagatcgagcaggtgctgatcgagagcgagcagatgagaaaggaggccggcgacagcggccccctgaccgagctggagcactggaagagaatgagcgccaagttcaactacatcatcgagcagatcaagggccccagctgcaaggccgtgatcaacgtgctgaacgtggcccacagcaagctgctgaagaactggagagacctggacgccagaatcaccgacaccgccaacgagagcaaggacaacgtgagatacctgtacaccctggagaaggtgtgccagcccctgtacaaccacgacctggtgagcatggcccacggcatccagaacctgatcaacgccatcagaatgatccacggcgtgagcagatactacaacaccagcgagagaatgaccagcctgttcatcaaggtgaccaaccagatggtgaccgcctgcaaggcctacatcaccgacggcggcctgaaccacgtgtgggaccaggagacccccgtggtgctgaagaagatccaggactgcatcttcctgttcaaggagtaccaggccagcttccacaagaccagaaagctgatcagcgagagcagcggcgagaagagcttcgaggtgagcgagatgtacatcttcggcaagttcgaggccttctgcaagagactggagaagatcaccgagatgatcaccgtggtgcagacctacagcaccctgagcaacagcaccatcgagggcatcgacatcatggccatcaagttcagaaacatctaccagggcgtgaagaagaagcagtacgacatcctggaccccagaagaaccgagttcgacaccgacttcctggacttcatgaccaagatcaacggcctggaggtgcagatccaggccttcatgaacagcagcttcggcaagatcctgagcagccagcaggccctgcagctgctgcagagattccagaagctgaacatcccctgcctgggcctggagatcaaccacaccatcgagagaatcctgcagtactacgtggccgagctggacgccaccaagaagctgtaccacagccagaaggacgacccccccctggccagaaacatgccccccatcgccggcaagatcctgtgggtgagacagctgtacagaagaatcagcgagcccatcaactacttcttcaagaacagcgacatcctgagcagccccgacggcaaggccgtgatcagacagtacaacaagatcagctacgtgctggtggagttcgaggtggtgtaccacaccgcctggatcagagagatcagccagctgcactacgccctgcaggccaccctgttcgtgagacaccccgagaccggcaagctgctggtgaacttcgaccccaagatcctggaggtggtgagagagaccaagtgcatgatcaagatgaagctggacgtgcccgagcaggccaagagactgctgaagctggagagcaagctgaaggccgacaagctgtacctgcagggcctgctgcagtactacgacgagctgtgccaggaggtgcccagcgtgttcgtgaacctgatgacccccaagatgaagaaggtggagagcgtgctgagacagggcctgaccgtgctgacctggagcagcctgaccctggagagcttcttccaggaggtggagctggtgctggacatgttcaaccagctgctgaagaagatcagcgacctgtgcgagatgcacatcgacaccgtgctgaaggagatcgccaagaccgtgctgatcagcctgcccgagagcggcgccaccaaggtggaggacatgctgaccctgaacgagacctacaccaaggagtgggccgacatcctgaaccacaagagcaagcacgtggaggaggccgtgagagagctgatcagcatcttcgagcagatctacgaggtgaagtacaccggcaaggtgggcaagcagagcgagcagagaaagcacgtggtgttcggcagcgagaccggcgagggcgagaacaacgactacgaggccaacatcgtgaacgagttcgacacccacgacaaggaggacgagttcaagaaggagtgcaaggaggtgttcgccttcttcagccaccagctgctggacagcctgcagaaggccaccagactgagcctggacaccatgaagagaagaatcttcgtggccagcctgtacggcagaaagcagagcgaggacatcatcagcttcatcaagagcgaggtgcacctggccatccccaacgtggtgatgatccccagcctggacgacatccagcaggccatcaacagaatgatccagctgaccctggaggtgagcagaggcgtggcccactggggccagcagcagatcagacccatcaagagcgtgatccccagccccaccaccaccgacgtgacccaccagaacaccggcaagctgctgaagaaggaggagagaagcttcgaggaggccatccccgccagaaagctgaagaacttctaccccggcgtggccgagcacaaggacatcagcaagctggtgctgctgctgagcagcagcgtgaacagcctgagaaaggccgcccacgaggccctgcaggacttccagaagtacaagaccctgtggaccgaggacagagacgtgaaggtgaaggagttcctggccaacaaccccagcctgaccgagatcagaagcgagatcctgcactacgccaccttcgagcaggagatcgacgagctgaagcccatcatcgtggtgggcgccctggagctgcacaccgagcccatgaagctggccctgagcatcgaggccaaggcctggaagatgctgctgtgcagatacctgaacgaggagtacaagaagaagatgagctacatgatcgccttcatcaacgagtacctgaagaagctgagcagacccatcagagacctggacgacgtgagattcgccatggaggccctgagctgcatcagagacaacgagatccagatggacatgaccctgggccccatcgaggaggcctacgccatcctgaacagattcgaggtggaggtgaccaaggaggagagcgaggccgtggacaccctgagatacagcttcaacaagctgcagagcaaggccgtgagcgtgcaggaggacctggtgcaggtgcagcccaagttcaagagcaacctgctggagagcgtggaggtgttcagagaggacgtgatcaacttcgccgaggcctacgagctggagggccccatggtgcccaacatccccccccaggaggccagcaacagactgcagatcttccaggccagcttcgacgacctgtggagaaagttcgtgacctacagcagcggcgagcagctgttcggcctgcccgtgaccgactacgaggtgctgcacaagaccagaaaggagctgaacctgctgcagaagctgtacggcctgtacgacaccgtgatgagcagcatcagcggctactacgagatcctgtggggcgacgtggacatcgagaagatcaacgccgagctgctggagttccagaacagatgcagaaagctgcccaagggcctgaaggactggcaggccttcctggacctgaagaagagaatcgacgacttcagcgagagctgccccctgctggagatgatgaccaacaaggccatgaagcagagacactgggacagaatcagcgagctgaccggcacccccttcgacgtggagagcgacagcttctgcctgagaaacatcatggaggcccccctgctgaagcacaaggacgacatcgaggacatctgcatcagcgccatcaaggagaaggacatcgaggccaagctgacccaggtgatcgagaactggaccaaccagaacctgagcttcgccgccttcaagggcaagggcgagctgctgctgaagggcaccgagagcggcgagatcatcaccctgatggaggacagcctgatggtgctgggcagcctgctgagcaacagatacaacgcccccttcaagaagaacatccagaactgggtgtacaagctgagcaccagcagcgacatcatcgaggagtggctggtggtgcagaacctgtgggtgtacctggaggccgtgttcgtgggcggcgacatcgccaagcagctgccccaggaggccaagagattccagaacatcgacaagagctggatcaagatcatgcagagagcccacgagaaccccaacgtgatcaactgctgcgtgggcgacgagaccatgggccagctgctgccccacctgcacgagcagctggaggtgtgccagaagagcctgaccggctacctggagaagaagagactgctgttccccagattcttcttcgtgagcgaccccgtgctgctggagatcctgggccaggccagcgacagccacaccatccagccccacctgcccgccgtgagcgacaacatcaacgaggtgaccttccacgccaaggactacgacagaatcatggccgtgatcagcagagagggcgagaagatcgtgctggacaacagcgtgatggccaagggccccgtggagatctggctgctggacctgctgaagatgcagatgagcagcctgcacaacatcatcagaagcgccttctaccagatcagcgacagcggcttccagctgctgcccttcctgagccacttccccgcccaggtgggcctgctgggcatccagatgctgtggacccacgacagcgaggaggccctgagaaacgccaaggacgacagaaagatcatgcaggtgaccaaccagaagttcctggacatcctgaacaccctgatcagccagaccacccacgacctgagcaagttcgacagagtgaagttcgagaccctgatcaccatccacgtgcaccagagagacatcttcgacgacctggtgaagatgcacatcaagagccccaccgacttcgagtggctgaagcagagcagattctacttcaaggaggacctggaccagaccgtggtgagcatcaccgacgtggacttcatctaccagaacgagttcctgggctgcaccgacagactggtgatcacccccctgaccgacagatgctacatcaccctggcccaggccctgggcatgaacatgggcggcgcccccgccggccccgccggcaccggcaagaccgagaccaccaaggacatgggcagatgcctgggcaagtacgtggtggtgttcaactgcagcgaccagatggacttcagaggcctgggcagaatcttcaagggcctggcccagagcggcagctggggctgcttcgacgagttcaacagaatcgagctgcccgtgctgagcgtggccgcccagcagatctacatcgtgctgaccgccagaaaggagagaaagaagcagttcatcttcagcgacggcgactgcgtggacctgaaccccgagttcggcatcttcctgaccatgaaccccggctacgccggcagacaggagctgcccgagaacctgaagatccagttcagaaccgtggccatgatggtgcccgacagacaggtgcactacgacttcggcctgagaaacatcctgagcgtgctgagaaccctgggcagccagaagagagccagacccgaggacagcgagctgagcatcgtgatgagaggcctgagagacatgaacctgagcaagctggtggacgaggacgagcccctgttcctgagcctgatcaacgacctgttccccggcctgcagctggacagcaacacctacgccgagctgcagaacgccgtggcccaccaggtgcagatcgagggcctgatcaaccaccccccctggaacctgaagctggtgcagctgtacgagaccagcctggtgagacacggcctgatgaccctgggccccagcggcagcggcaagaccaccgtgatcaccatcctgatgaaggcccagaccgagtgcggcagaccccacagagagatgagaatgaaccccaaggccatcaccgccccccagatgttcggcagactggacaccgccaccaacgactggaccgacggcatcttcagcaccctgtggagaaagaccctgaaggccaagaagggcgagaacatcttcctgatcctggacggccccgtggacgccatctggatcgagaacctgaacagcgtgctggacgacaacaagaccctgaccctggccaacggcgacagaatccccatggcccccagctgcaagctgctgttcgaggtgcacaacatcgagaacgccagccccgccaccgtgagcagaatgggcatggtgtacatcagcagcagcgccctgagctggagacccatcctgcaggcctggctgaagaagagaaccgcccaggaggccgccgtgttcctgaccctgtacgagaaggtgttcgaggacacctacacctacatgaagctgaacctgaaccccaagatgcagctgctggagtgcaactacatcgtgcagagcctgaacctgctggagggcctgatccccagcaaggaggagggcggcgtgagctgcgtggagcacctgcacaagctgttcgtgttcggcctgatgtggagcctgggcgccctgctggagctggagagcagagagaagctggaggccttcctgagacagcacgagagcaagctggacctgcccgagatccccaagggcagcaaccagaccatgtacgagttctacgtgaccgactacggcgactgggagcactggaacaagaagctgcagccctactactaccccaccgacagcatccccgagtacagcagcatcctggtgcccaacgtggacaacatcagaaccaacttcctgatcgacaccatcgccaagcagcacaaggccgtgctgctgaccggcgagcagggcaccgccaagaccgtgatggtgaaggcctacctgaagaagtacgaccccgaggtgcagctgagcaagagcctgaacttcagcagcgccaccgagcccatgatgttccagagaaccatcgagagctacgtggacaagagaatcggcagcacctacggcccccccggcggcagaaagatgaccgtgttcatcgacgacatcaacatgcccgtgatcaacgagtggggcgaccagatcaccaacgagatcgtgagacagatgatggagatggagggcatgtacagcctggacaagcccggcgacttcaccaccatcgtggacgtgcagctgatcgccgccatgatccaccccggcggcggcagaaacgacatcccccagagactgaagagacagttcaccgtgttcaactgcaccctgcccagcaacgccagcatcgacaagatcttcggcatcatcggctgcggctacttcgacccctgcagaagcttcaagccccagatctgcgagatgatcgtgaacctggtgagcgtgggcagagtgctgtggcagtggaccaaggtgaagatgctgcccacccccagcaagttccactacatcttcaacctgagagacctgagcagaatctggcagggcatgctgaccatcaaggccgaggagtgcgccagcatccccaccctgctgagcctgttcaagcacgagtgcagcagagtgatcgccgacagattcatcacccccgaggacgagcagtggttcaacgcccacctgaccagagccgtggaggagaacatcggcagcgacgccgccagctgcatcctgcccgagccctacttcgtggacttcctgagagagatgcccgagcccaccggcgacgagcccgaggacagcgtgttcgaggtgcccaagatctacgagctgatgcccagcttcgacttcctggccgagaagctgcagttctaccagagacagttcaacgagatcatcagaggcaccagcctggacctggtgttcttcaaggacgccatgacccacctgatcaagatcagcagaatcatcagaaccagctgcggcaacgccctgctggtgggcgtgggcggcagcggcaagcagagcctgagcagactggccagcttcatcgccggctaccagatcttccagatcaccctgaccagaagctacaacgtgaccaacctgaccgacgacctgaaggccctgtacaaggtggccggcgccgacggcaagggcatcaccttcatcttcaccgacagcgagatcaaggacgaggccttcctggagtacctgaacaacctgctgagcagcggcgagatcagcaacctgttcgccagagacgagatggacgagatcacccagggcctgatcagcgtgatgaagagagagctgcccagacacccccccaccttcgacaacctgtacgagtacttcatcagcagaagcagaaagaacctgcacgtggtgctgtgcttcagccccgtgggcgagaagttcagagccagaagcctgaagttccccggcctgatcagcggctgcaccatggactggttcagcagatggcccagagaggccctgatcgccgtggccagctacttcctgagcgactacaacatcgtgtgcagcagcgagatcaagagacaggtggtggagaccatgggcctgttccacgacatggtgagcgagagctgcgagagctacttccagagatacagaagaagagcccacgtgacccccaagagctacctgagcttcatcaacggctacaagaacatctacgccgagaaggtgaagttcatcaacgagcaggccgagagaatgaacatcggcctggacaagctgatggaggccagcgagagcgtggccaagctgagccaggacctggccgtgaaggagaaggagctggccgtggccagcatcaaggccgacgaggtgctggccgaggtgaccgtgagcgcccaggccagcgccaagatcaagaacgaggtgcaggaggtgaaggacaaggcccagaagatcgtggacgagatcgacagcgagaaggtgaaggccgagagcaagctggaggccgccaagcccgccctggaggaggccgaggccgccctgaacaccatcaagcccaacgacatcgccaccgtgagaaagctggccaagcccccccacctgatcatgagaatcatggactgcgtgctgctgctgttccagaagaagatcgaccccgtgaccatggaccccgagaagagctgctgcaagcccagctggggcgagagcctgaagctgatgagcgccaccggcttcctgtggagcctgcagcagttccccaaggacaccatcaacgaggagaccgtggagctgctgcagccctacttcaacatggacgactacaccttcgagagcgccaagaaggtgtgcggcaacgtggccggcctgctgagctggaccctggccatggccatcttctacggcatcaacagagaggtgctgcccctgaaggccaacctggccaagcaggagggcagactggccgtggccaacgccgagctgggcaaggcccaggccctgctggacgagaagcaggccgagctggacaaggtgcaggccaagttcgacgccgccatgaacgagaagatggacctgctgaacgacgccgacacctgcagaaagaagatgcaggccgccagcaccctgatcgacggcctgagcggcgagaagatcagatggacccagcagagcaaggagttcaaggcccagatcaacagactggtgggcgacatcctgctgtgcaccggcttcctgagctacctgggccccttcaaccagatcttcagaaactacctgctgaaggaccagtgggagatggagctgagagccagaaagatccccttcaccgagaacctgaacctgatcagcatgctggtggacccccccaccatcggcgagtggggcctgcagggcctgcccggcgacgacctgagcatccagaacggcatcatcgtgaccaaggccaccagataccccctgctgatcgacccccagacccagggcaagacctggatcaagagcaaggagaaggagaacgacctgcaggtgaccagcctgaaccacaagtacttcagaacccacctggaggacagcctgagcctgggcagacccctgctgatcgaggacatccacgaggagctggaccccgccctggacaacgtgctggagaagaacttcatcaagagcggcaccaccttcaaggtgaaggtgggcgacaaggagtgcgacatcatggacaccttcaagctgtacatcaccaccaagctgcccaaccccgccttcacccccgagatcaacgccaagaccagcgtgatcgacttcaccgtgaccatgaagggcctggagaaccagctgctgagaagagtgatcctgaccgagaagcaggagctggaggccgagagagtgaagctgctggaggacgtgaccttcaacaagagaaagatgaaggagctggaggacaacctgctgtacaagctgagcgccaccaagggcagcctggtggacgacgagagcctgatcggcgtgctgagaaccaccaagcagaccgccgccgaggtgagcgagaagctgcacgtggccgccgagaccgagatcaagatcaacgccgcccaggaggagttcagacccgccgccaccagaggcagcatcctgtacttcctgatcaccgagatgagcatggtgaacatcatgtaccagaccagcctggcccagttcctgaagctgttcgaccagagcatggccagaagcgagaagagccccctgccccagaagagaatcaccaacatcatcgagtacctgacctacgaggtgttcacctacagcgtgagaggcctgtacgagaaccacaagttcctgttcgtgctgctgatgaccctgaagatcgacctgcagagaggcaccgtgaagcacagagagttccaggccctgatcaagggcggcgccgccctggacctgaaggcctgcccccccaagccctacagatggatcctggacatgacctggctgaacctggtggagctgagcaagctgccccagttcgccgagatcatgaaccagatcagcagaaacgagaagggctggaagagctggttcgacaaggacgcccccgaggaggagatcatccccgacggctacaacgacagcctggacacctgccacaagctgctgctgatcagaagctggtgccccgacagaaccgtgttccaggccagaaagtacatcgccgacagcctggaggagaagtacaccgagcccgtgatcctgaacctggagaagacctgggaggagagcgacaccagaacccccctgatctgcttcctgagcatgggcagcgaccccaccaaccagatcgacgccctggccaagaagctgaagctggagtgcagaaccatcagcatgggccagggccaggaggtgcacgccagaaagctgatccagatgagcatgcagcagggcggctgggtgctgctgcagaactgccacctgggcctggagttcatggaggagctgctggagaccctgatcaccaccgaggccagcgacgacagcttcagagtgtggatcaccaccgagccccacgacagattccccatcaccctgctgcagaccagcctgaagttcaccaacgagcccccccagggcgtgagagccggcctgaagagaaccttcgccggcatcaaccaggacctgctggacatcagcaacctgcccatgtggaagcccatgctgtacaccgtggccttcctgcacagcaccgtgcaggagagaagaaagttcggccccctgggctggaacatcccctacgagttcaacagcgccgacttcagcgccagcgtgcagttcatccagaaccacctggacgagtgcgacatcaagaagggcgtgagctggaacaccgtgagatacatgatcggcgaggtgcagtacggcggcagagtgaccgacgacttcgacaagagactgctgaactgcttcgccagagtgtggttcagcgagaagatgttcgagcccagcttctgcttctacaccggctacaagatccccctgtgcaagaccctggaccagtacttcgagtacatccagagcctgcccagcctggacaaccccgaggtgttcggcctgcaccccaacgccgacatcacctaccagagcaacaccgccagcgccgtgctggagaccatcaccaacatccagcccaaggagagcggcggcggcgtgggcgagaccagagaggccatcgtgtacagactgagcgaggacatgctgagcaagctgccccccgactacatcccccacgaggtgaagagcagactgatcaagatgggccacctgaacagcatgaacatcttcctgagacaggagatcgacagaatgcagagagtgatcagcatcctgagaagcagcctgagcgacctgaagctggccatcgagggcaccatcatcatgagcgagaacctgagagacgccctggacaacatgtacgacgccagaatcccccagctgtggaagagagtgagctgggacagcagcaccctgggcttctggttcaccgagctgctggagagaaacgcccagttcagcacctggatcttcgagggcagacccaacgtgttctggatgaccggcttcttcaacccccagggcttcctgaccgccatgagacaggaggtgaccagagcccacaagggctgggccctggacaccgtgaccatccacaacgaggtgctgagacagaccaaggaggagatcaccagcccccccggcgagggcgtgtacatctacggcctgtacatggacggcgccgcctgggacagaagaaacggcaagctgatggagagcacccccaaggtgctgttcacccagctgcccgtgctgcacatcttcgccatcaacagcaccgcccccaaggaccccaagctgtacgtgtgccccatctacaagaagcccagaagaaccgacctgaccttcatcaccgtggtgtacctgagaaccgtgctgagccccgaccactggatcctgagaggcgtggccctgctgtgcgacatcaagtag

SEQ ID NO: 79854 - DNA, 12567 bp, Artificial Sequence
  Description of Artificial Sequence: Synthetic coding sequence
atggagaaggacgccgaggacggcgcccccagcgagggcgccgaggccccccccagcaccgaggaggccgccccccccagaagcgaggaggaggaggcccccagaccccccaccgtggaggcccccgccgaggacggcttcagccccagcgccgaggacgccgtgagcagcgtggtggactacagagacctgatccccagcgaggagggcatcgtgctgcccgacgaccacgaggccgacctgaacagagtgagacagagactggcccccagacccgtgcagagcgtgatcagcgaggtgctgagcctgcccagcagcagaagaagcagcagatacagaagaagcatgagcggcctgcccaacctgcaggagaccctgaaggagagacaggccagattcagagaggccagagagagcagaagactgaagatcgaccccagctacaagtacatcttcgagatcctggccgagaacctgggcctggacatcgtgaccgtggaggagctgatcctggactgccccagcctggaggccttcaccaacttcttcgccaaggacggctgcaagaccctgaagttcctgtaccaggagggcgacgtgcccggcatcgagtgcggcagaaccatcgccggcgccaccaagggcgccaagatgatgaagctgtacatcgacaacgccgcccccgacaagctgaagggcctgtgcatcttcttcgtgagatgcagaaacgacgtggccatcaacgtgaagaccatccaggaggaggccctgttcaccgtgctggacgccagcaagggcctgctgaacggcatcagagacatgctggccaacatcttcctgcccgccgtgctggccaccaacaactggggcgccctgaaccagagcaagcagggcgagagcgagaagcacatcttcaccgagaccatcaacagatacctgagcttcctggacggcgccagaatcagcatcgagggcaccgtgaagctgaagaccatcgacaacgtgaacttcagcaagctgcacaccttcgaggaggtgaccgccgccgccagcaacagcgagaccgtgcaccagctggaggaggtgctgatggtgtggtacaagcagatcgagcaggtgctgatcgagagcgagcagatgagaaaggaggccggcgacagcggccccctgaccgagctggagcactggaagagaatgagcgccaagttcaactacatcatcgagcagatcaagggccccagctgcaaggccgtgatcaacgtgctgaacgtggcccacagcaagctgctgaagaactggagagacctggacgccagaatcaccgacaccgccaacgagagcaaggacaacgtgagatacctgtacaccctggagaaggtgtgccagcccctgtacaaccacgacctggtgagcatggcccacggcatccagaacctgatcaacgccatcagaatgatccacggcgtgagcagatactacaacaccagcgagagaatgaccagcctgttcatcaaggtgaccaaccagatggtgaccgcctgcaaggcctacatcaccgacggcggcctgaaccacgtgtgggaccaggagacccccgtggtgctgaagaagatccaggactgcatcttcctgttcaaggagtaccaggccagcttccacaagaccagaaagctgatcagcgagagcagcggcgagaagagcttcgaggtgagcgagatgtacatcttcggcaagttcgaggccttctgcaagagactggagaagatcaccgagatgatcaccgtggtgcagacctacagcaccctgagcaacagcaccatcgagggcatcgacatcatggccatcaagttcagaaacatctaccagggcgtgaagaagaagcagtacgacatcctggaccccagaagaaccgagttcgacaccgacttcctggacttcatgaccaagatcaacggcctggaggtgcagatccaggccttcatgaacagcagcttcggcaagatcctgagcagccagcaggccctgcagctgctgcagagattccagaagctgaacatcccctgcctgggcctggagatcaaccacaccatcgagagaatcctgcagtactacgtggccgagctggacgccaccaagaagctgtaccacagccagaaggacgacccccccctggccagaaacatgccccccatcgccggcaagatcctgtgggtgagacagctgtacagaagaatcagcgagcccatcaactacttcttcaagaacagcgacatcctgagcagccccgacggcaaggccgtgatcagacagtacaacaagatcagctacgtgctggtggagttcgaggtggtgtaccacaccgcctggatcagagagatcagccagctgcactacgccctgcaggccaccctgttcgtgagacaccccgagaccggcaagctgctggtgaacttcgaccccaagatcctggaggtggtgagagagaccaagtgcatgatcaagatgaagctggacgtgcccgagcaggccaagagactgctgaagctggagagcaagctgaaggccgacaagctgtacctgcagggcctgctgcagtactacgacgagctgtgccaggaggtgcccagcgtgttcgtgaacctgatgacccccaagatgaagaaggtggagagcgtgctgagacagggcctgaccgtgctgacctggagcagcctgaccctggagagcttcttccaggaggtggagctggtgctggacatgttcaaccagctgctgaagaagatcagcgacctgtgcgagatgcacatcgacaccgtgctgaaggagatcgccaagaccgtgctgatcagcctgcccgagagcggcgccaccaaggtggaggacatgctgaccctgaacgagacctacaccaaggagtgggccgacatcctgaaccacaagagcaagcacgtggaggaggccgtgagagagctgatcagcatcttcgagcagatctacgaggtgaagtacaccggcaaggtgggcaagcagagcgagcagagaaagcacgtggtgttcggcagcgagaccggcgagggcgagaacaacgactacgaggccaacatcgtgaacgagttcgacacccacgacaaggaggacgagttcaagaaggagtgcaaggaggtgttcgccttcttcagccaccagctgctggacagcctgcagaaggccaccagactgagcctggacaccatgaagagaagaatcttcgtggccagcctgtacggcagaaagcagagcgaggacatcatcagcttcatcaagagcgaggtgcacctggccatccccaacgtggtgatgatccccagcctggacgacatccagcaggccatcaacagaatgatccagctgaccctggaggtgagcagaggcgtggcccactggggccagcagcagatcagacccatcaagagcgtgatccccagccccaccaccaccgacgtgacccaccagaacaccggcaagctgctgaagaaggaggagagaagcttcgaggaggccatccccgccagaaagctgaagaacttctaccccggcgtggccgagcacaaggacatcagcaagctggtgctgctgctgagcagcagcgtgaacagcctgagaaaggccgcccacgaggccctgcaggacttccagaagtacaagaccctgtggaccgaggacagagacgtgaaggtgaaggagttcctggccaacaaccccagcctgaccgagatcagaagcgagatcctgcactacgccaccttcgagcaggagatcgacgagctgaagcccatcatcgtggtgggcgccctggagctgcacaccgagcccatgaagctggccctgagcatcgaggccaaggcctggaagatgctgctgtgcagatacctgaacgaggagtacaagaagaagatgagctacatgatcgccttcatcaacgagtacctgaagaagctgagcagacccatcagagacctggacgacgtgagattcgccatggaggccctgagctgcatcagagacaacgagatccagatggacatgaccctgggccccatcgaggaggcctacgccatcctgaacagattcgaggtggaggtgaccaaggaggagagcgaggccgtggacaccctgagatacagcttcaacaagctgcagagcaaggccgtgagcgtgcaggaggacctggtgcaggtgcagcccaagttcaagagcaacctgctggagagcgtggaggtgttcagagaggacgtgatcaacttcgccgaggcctacgagctggagggccccatggtgcccaacatccccccccaggaggccagcaacagactgcagatcttccaggccagcttcgacgacctgtggagaaagttcgtgacctacagcagcggcgagcagctgttcggcctgcccgtgaccgactacgaggtgctgcacaagaccagaaaggagctgaacctgctgcagaagctgtacggcctgtacgacaccgtgatgagcagcatcagcggctactacgagatcctgtggggcgacgtggacatcgagaagatcaacgccgagctgctggagttccagaacagatgcagaaagctgcccaagggcctgaaggactggcaggccttcctggacctgaagaagagaatcgacgacttcagcgagagctgccccctgctggagatgatgaccaacaaggccatgaagcagagacactgggacagaatcagcgagctgaccggcacccccttcgacgtggagagcgacagcttctgcctgagaaacatcatggaggcccccctgctgaagcacaaggacgacatcgaggacatctgcatcagcgccatcaaggagaaggacatcgaggccaagctgacccaggtgatcgagaactggaccaaccagaacctgagcttcgccgccttcaagggcaagggcgagctgctgctgaagggcaccgagagcggcgagatcatcaccctgatggaggacagcctgatggtgctgggcagcctgctgagcaacagatacaacgcccccttcaagaagaacatccagaactgggtgtacaagctgagcaccagcagcgacatcatcgaggagtggctggtggtgcagaacctgtgggtgtacctggaggccgtgttcgtgggcggcgacatcgccaagcagctgccccaggaggccaagagattccagaacatcgacaagagctggatcaagatcatgcagagagcccacgagaaccccaacgtgatcaactgctgcgtgggcgacgagaccatgggccagctgctgccccacctgcacgagcagctggaggtgtgccagaagagcctgaccggctacctggagaagaagagactgctgttccccagattcttcttcgtgagcgaccccgtgctgctggagatcctgggccaggccagcgacagccacaccatccagccccacctgcccgccgtgagcgacaacatcaacgaggtgaccttccacgccaaggactacgacagaatcatggccgtgatcagcagagagggcgagaagatcgtgctggacaacagcgtgatggccaagggccccgtggagatctggctgctggacctgctgaagatgcagatgagcagcctgcacaacatcatcagaagcgccttctaccagatcagcgacagcggcttccagctgctgcccttcctgagccacttccccgcccaggtgggcctgctgggcatccagatgctgtggacccacgacagcgaggaggccctgagaaacgccaaggacgacagaaagatcatgcaggtgaccaaccagaagttcctggacatcctgaacaccctgatcagccagaccacccacgacctgagcaagttcgacagagtgaagttcgagaccctgatcaccatccacgtgcaccagagagacatcttcgacgacctggtgaagatgcacatcaagagccccaccgacttcgagtggctgaagcagagcagattctacttcaaggaggacctggaccagaccgtggtgagcatcaccgacgtggacttcatctaccagaacgagttcctgggctgcaccgacagactggtgatcacccccctgaccgacagatgctacatcaccctggcccaggccctgggcatgaacatgggcggcgcccccgccggccccgccggcaccggcaagaccgagaccaccaaggacatgggcagatgcctgggcaagtacgtggtggtgttcaactgcagcgaccagatggacttcagaggcctgggcagaatcttcaagggcctggcccagagcggcagctggggctgcttcgacgagttcaacagaatcgagctgcccgtgctgagcgtggccgcccagcagatctacatcgtgctgaccgccagaaaggagagaaagaagcagttcatcttcagcgacggcgactgcgtggacctgaaccccgagttcggcatcttcctgaccatgaaccccggctacgccggcagacaggagctgcccgagaacctgaagatccagttcagaaccgtggccatgatggtgcccgacagacagatcatcatgagagtgaagctggccagctgcggcttcctggagaacgtgatcctggcccagaagttctacgtgctgtacaagctgtgcgaggagcagctgaccaagcaggtgcactacgacttcggcctgagaaacatcctgagcgtgctgagaaccctgggcagccagaagagagccagacccgaggacagcgagctgagcatcgtgatgagaggcctgagagacatgaacctgagcaagctggtggacgaggacgagcccctgttcctgagcctgatcaacgacctgttccccggcctgcagctggacagcaacacctacgccgagctgcagaacgccgtggcccaccaggtgcagatcgagggcctgatcaaccaccccccctggaacctgaagctggtgcagctgtacgagaccagcctggtgagacacggcctgatgaccctgggccccagcggcagcggcaagaccaccgtgatcaccatcctgatgaaggcccagaccgagtgcggcagaccccacagagagatgagaatgaaccccaaggccatcaccgccccccagatgttcggcagactggacaccgccaccaacgactggaccgacggcatcttcagcaccctgtggagaaagaccctgaaggccaagaagggcgagaacatcttcctgatcctggacggccccgtggacgccatctggatcgagaacctgaacagcgtgctggacgacaacaagaccctgaccctggccaacggcgacagaatccccatggcccccagctgcaagctgctgttcgaggtgcacaacatcgagaacgccagccccgccaccgtgagcagaatgggcatggtgtacatcagcagcagcgccctgagctggagacccatcctgcaggcctggctgaagaagagaaccgcccaggaggccgccgtgttcctgaccctgtacgagaaggtgttcgaggacacctacacctacatgaagctgaacctgaaccccaagatgcagctgctggagtgcaactacatcgtgcagagcctgaacctgctggagggcctgatccccagcaaggaggagggcggcgtgagctgcgtggagcacctgcacaagctgttcgtgttcggcctgatgtggagcctgggcgccctgctggagctggagagcagagagaagctggaggccttcctgagacagcacgagagcaagctggacctgcccgagatccccaagggcagcaaccagaccatgtacgagttctacgtgaccgactacggcgactgggagcactggaacaagaagctgcagccctactactaccccaccgacagcatccccgagtacagcagcatcctggtgcccaacgtggacaacatcagaaccaacttcctgatcgacaccatcgccaagcagcacaaggccgtgctgctgaccggcgagcagggcaccgccaagaccgtgatggtgaaggcctacctgaagaagtacgaccccgaggtgcagctgagcaagagcctgaacttcagcagcgccaccgagcccatgatgttccagagaaccatcgagagctacgtggacaagagaatcggcagcacctacggcccccccggcggcagaaagatgaccgtgttcatcgacgacatcaacatgcccgtgatcaacgagtggggcgaccagatcaccaacgagatcgtgagacagatgatggagatggagggcatgtacagcctggacaagcccggcgacttcaccaccatcgtggacgtgcagctgatcgccgccatgatccaccccggcggcggcagaaacgacatcccccagagactgaagagacagttcaccgtgttcaactgcaccctgcccagcaacgccagcatcgacaagatcttcggcatcatcggctgcggctacttcgacccctgcagaagcttcaagccccagatctgcgagatgatcgtgaacctggtgagcgtgggcagagtgctgtggcagtggaccaaggtgaagatgctgcccacccccagcaagttccactacatcttcaacctgagagacctgagcagaatctggcagggcatgctgaccatcaaggccgaggagtgcgccagcatccccaccctgctgagcctgttcaagcacgagtgcagcagagtgatcgccgacagattcatcacccccgaggacgagcagtggttcaacgcccacctgaccagagccgtggaggagaacatcggcagcgacgccgccagctgcatcctgcccgagccctacttcgtggacttcctgagagagatgcccgagcccaccggcgacgagcccgaggacagcgtgttcgaggtgcccaagatctacgagctgatgcccagcttcgacttcctggccgagaagctgcagttctaccagagacagttcaacgagatcatcagaggcaccagcctggacctggtgttcttcaaggacgccatgacccacctgatcaagatcagcagaatcatcagaaccagctgcggcaacgccctgctggtgggcgtgggcggcagcggcaagcagagcctgagcagactggccagcttcatcgccggctaccagatcttccagatcaccctgaccagaagctacaacgtgaccaacctgaccgacgacctgaaggccctgtacaaggtggccggcgccgacggcaagggcatcaccttcatcttcaccgacagcgagatcaaggacgaggccttcctggagtacctgaacaacctgctgagcagcggcgagatcagcaacctgttcgccagagacgagatggacgagatcacccagggcctgatcagcgtgatgaagagagagctgcccagacacccccccaccttcgacaacctgtacgagtacttcatcagcagaagcagaaagaacctgcacgtggtgctgtgcttcagccccgtgggcgagaagttcagagccagaagcctgaagttccccggcctgatcagcggctgcaccatggactggttcagcagatggcccagagaggccctgatcgccgtggccagctacttcctgagcgactacaacatcgtgtgcagcagcgagatcaagagacaggtggtggagaccatgggcctgttccacgacatggtgagcgagagctgcgagagctacttccagagatacagaagaagagcccacgtgacccccaagagctacctgagcttcatcaacggctacaagaacatctacgccgagaaggtgaagttcatcaacgagcaggccgagagaatgaacatcggcctggacaagctgatggaggccagcgagagcgtggccaagctgagccaggacctggccgtgaaggagaaggagctggccgtggccagcatcaaggccgacgaggtgctggccgaggtgaccgtgagcgcccaggccagcgccaagatcaagaacgaggtgcaggaggtgaaggacaaggcccagaagatcgtggacgagatcgacagcgagaaggtgaaggccgagagcaagctggaggccgccaagcccgccctggaggaggccgaggccgccctgaacaccatcaagcccaacgacatcgccaccgtgagaaagctggccaagcccccccacctgatcatgagaatcatggactgcgtgctgctgctgttccagaagaagatcgaccccgtgaccatggaccccgagaagagctgctgcaagcccagctggggcgagagcctgaagctgatgagcgccaccggcttcctgtggagcctgcagcagttccccaaggacaccatcaacgaggagaccgtggagctgctgcagccctacttcaacatggacgactacaccttcgagagcgccaagaaggtgtgcggcaacgtggccggcctgctgagctggaccctggccatggccatcttctacggcatcaacagagaggtgctgcccctgaaggccaacctggccaagcaggagggcagactggccgtggccaacgccgagctgggcaaggcccaggccctgctggacgagaagcaggccgagctggacaaggtgcaggccaagttcgacgccgccatgaacgagaagatggacctgctgaacgacgccgacacctgcagaaagaagatgcaggccgccagcaccctgatcgacggcctgagcggcgagaagatcagatggacccagcagagcaaggagttcaaggcccagatcaacagactggtgggcgacatcctgctgtgcaccggcttcctgagctacctgggccccttcaaccagatcttcagaaactacctgctgaaggaccagtgggagatggagctgagagccagaaagatccccttcaccgagaacctgaacctgatcagcatgctggtggacccccccaccatcggcgagtggggcctgcagggcctgcccggcgacgacctgagcatccagaacggcatcatcgtgaccaaggccaccagataccccctgctgatcgacccccagacccagggcaagacctggatcaagagcaaggagaaggagaacgacctgcaggtgaccagcctgaaccacaagtacttcagaacccacctggaggacagcctgagcctgggcagacccctgctgatcgaggacatccacgaggagctggaccccgccctggacaacgtgctggagaagaacttcatcaagagcggcaccaccttcaaggtgaaggtgggcgacaaggagtgcgacatcatggacaccttcaagctgtacatcaccaccaagctgcccaaccccgccttcacccccgagatcaacgccaagaccagcgtgatcgacttcaccgtgaccatgaagggcctggagaaccagctgctgagaagagtgatcctgaccgagaagcaggagctggaggccgagagagtgaagctgctggaggacgtgaccttcaacaagagaaagatgaaggagctggaggacaacctgctgtacaagctgagcgccaccaagggcagcctggtggacgacgagagcctgatcggcgtgctgagaaccaccaagcagaccgccgccgaggtgagcgagaagctgcacgtggccgccgagaccgagatcaagatcaacgccgcccaggaggagttcagacccgccgccaccagaggcagcatcctgtacttcctgatcaccgagatgagcatggtgaacatcatgtaccagaccagcctggcccagttcctgaagctgttcgaccagagcatggccagaagcgagaagagccccctgccccagaagagaatcaccaacatcatcgagtacctgacctacgaggtgttcacctacagcgtgagaggcctgtacgagaaccacaagttcctgttcgtgctgctgatgaccctgaagatcgacctgcagagaggcaccgtgaagcacagagagttccaggccctgatcaagggcggcgccgccctggacctgaaggcctgcccccccaagccctacagatggatcctggacatgacctggctgaacctggtggagctgagcaagctgccccagttcgccgagatcatgaaccagatcagcagaaacgagaagggctggaagagctggttcgacaaggacgcccccgaggaggagatcatccccgacggctacaacgacagcctggacacctgccacaagctgctgctgatcagaagctggtgccccgacagaaccgtgttccaggccagaaagtacatcgccgacagcctggaggagaagtacaccgagcccgtgatcctgaacctggagaagacctgggaggagagcgacaccagaacccccctgatctgcttcctgagcatgggcagcgaccccaccaaccagatcgacgccctggccaagaagctgaagctggagtgcagaaccatcagcatgggccagggccaggaggtgcacgccagaaagctgatccagatgagcatgcagcaggtgtgcgacaagagactgctgctgctgcagcactactgctag

SEQ ID NO: 79855 - DNA, 13461 bp, Artificial Sequence
  Description of Artificial Sequence: Synthetic coding sequence
atgagactggccgaggagagagccgccctggccgccgagaacgccgacggcgagcccggcgccgacagaagactgagactgctgggcacctacgtggccatgagcctgagacccgccgccggcgcctgggagagatgcgccggcagcgccgaggccgagcagctgctgcaggccttcctgggcagagacgccgccgagggccccagacccctgctggtggtgagacccggccccagaggcctggccatcagacccggcctggaggtgggccccgagagcggcctggccggcgccaaggccctgttcttcctgagaaccggccccgagccccccggccccgacagcttcagaggcgccgtggtgtgcggcgacctgcccgccgcccccctggagcacctggccgccctgttcagcgaggtggtgctgcccgtgctggccaacgagaagaacagactgaactggccccacatgatctgcgaggacgtgagaagacacgcccacagcctgcagtgcgacctgagcgtgatcctggagcaggtgaagggcaagaccctgctgcccctgcccgccggcagcgagaagatggagttcgccgacagcaagagcgagaccgtgctggacagcatcgacaagagcgtgatctacgccatcgagagcgccgtgatcaagtggagctaccaggtgcaggtggtgctgaagagagagagcagccagcccctgctgcagggcgagaaccccacccccaaggtggagctggagttctggaagagcagatacgaggacctgaagtacatctacaaccagctgagaaccatcaccgtgagaggcatggccaagctgctggacaagctgcagagcagctacttccccgccttcaaggccatgtacagagacgtggtggccgccctggccgaggcccaggacatccacgtgcacctgatccccctgcagagacacctggaggccctggagaacgccgagttccccgaggtgaagccccagctgagacccctgctgcacgtggtgtgcctgatctgggccacctgcaagagctacagaagccccggcagactgaccgtgctgctgcaggagatctgcaacctgctgatccagcaggccagcaactacctgagccccgaggacctgctgagaagcgaggtggaggagagccagagaaagctgcaggtggtgagcgacaccctgagcttcttcaagcaggagttccaggacagaagagagaacctgcacacctacttcaaggagaaccaggaggtgaaggagtgggacttccagagcagcctggtgttcgtgagactggacggcttcctgggccagctgcacgtggtggagggcctgctgaagaccgccctggacttccacaagctgggcaaggtggagttcagcggcgtgagaggcaacgccctgagccagcaggtgcagcagatgcacgaggagttccaggagatgtacagactgctgagcggcagcagcagcgactgcctgtacctgcagagcaccgacttcgagaacgacgtgagcgagttcaaccagaaggtggaggacctggacagaagactgggcaccatcttcatccaggccttcgacgacgcccccggcctggagcacgccttcaagctgctggacatcgccggcaacctgctggagagacccctggtggccagagacaccagcgacaagtacctggtgctgatccagatgttcaacaaggacctggacgccgtgagaatgatctacagccagcacgtgcaggaggaggccgagctgggcttcagccccgtgcacaagaacatgcccaccgtggccggcggcctgagatgggcccaggagctgagacagagaatccagggccccttcagcaacttcggcagaatcacccacccctgcatggagagcgccgagggcaagagaatgcagcagaagtacgaggacatgctgagcctgctggagaagtacgagaccagactgtacgaggactggtgcagaaccgtgagcgagaagagccagtacaacctgagccagcccctgctgaagagagaccccgagaccaaggagatcaccatcaacttcaacccccagctgatcagcgtgctgaaggagatgagctacctggagcccagagagatgaagcacatgcccgagaccgccgccgccatgttcagcagcagagacttctacagacagctggtggccaacctggagctgatggccaactggtacaacaaggtgatgaagaccctgctggaggtggagttccccctggtggaggaggagctgcagaacatcgacctgagactgagagccgccgaggagaccctgaactggaagaccgagggcatctgcgactacgtgaccgagatcaccagcagcatccacgacctggagcagagaatccagaagaccaaggacaacgtggaggagatccagaacatcatgaagacctgggtgacccccatcttcaagaccaaggacggcaagagagagagcctgctgagcctggacgacagacacgacagaatggagaagtactacaacctgatcaaggagagcggcctgaagatccacgccctggtgcaggagaacctgggcctgttcagcgccgaccccaccagcaacatctggaagacctacgtgaacagcatcgacaacctgctgctgaacggcttcttcctggccatcgagtgcagcctgaagtacctgctggagaacaccgagtgcaaggccggcctgacccccatcttcgaggcccagctgagcctggccatccccgagctggtgttctaccccagcctggagagcggcgtgaagggcggcttctgcgacatcgtggagggcctgatcaccagcatcttcagaatccccagcctggtgcccagactgagcccccagaacggcagcccccactaccaggtggacctggacggcatccccgacctggccaacatgagaagaaccctgatggagagagtgcagagaatgatgggcctgtgctgcggctaccagagcaccttcagccagtacagctacctgtacgtggaggacagaaaggaggtgctgggccagttcctgctgtacggccacatcctgacccccgaggagatcgaggaccacgtggaggacggcatccccgagaacccccccctgctgagccagttcaaggtgcagatcgacagctacgagaccctgtacgaggaggtgtgcagactggagcccatcaaggtgttcgacggctggatgaagatcgacatcagacccttcaaggccagcctgctgaacatcatcaagagatggagcctgctgttcaagcagcacctggtggaccacgtgacccacagcctggccaacctggacgccttcatcaagaagagcgagagcggcctgctgaagaaggtggagaagggcgacttccagggcctggtggagatcatgggccacctgatggccgtgaaggagagacagagcaacaccgacgagatgttcgagcccctgaagcagaccatcgagctgctgaagacctacgagcaggagctgcccgagaccgtgttcaagcagctggaggagctgcccgagaagtggaacaacatcaagaaggtggccatcaccgtgaagcagcaggtggcccccctgcaggccaacgaggtgaccctgctgagacagagatgcaccgccttcgacgccgagcagcagcagttctgggagcagttccacaaggaggcccccttcagattcgacagcatccacccccaccagatgctggacgccagacacatcgagatccagcagatggagagcaccatggccagcatcagcgagagcgccagcctgttcgaggtgaacgtgcccgactacaagcagctgagacagtgcagaaaggaggtgtgccagctgaaggagctgtgggacaccatcggcatggtgaccagcagcatccacgcctgggagaccaccccctggagaaacatcaacgtggaggccatggagctggagtgcaagcagttcgccagacacatcagaaacctggacaaggaggtgagagcctgggacgccttcaccggcctggagagcaccgtgtggaacaccctgagcagcctgagagccgtggccgagctgcagaaccccgccatcagagagagacactggagacagctgatgcaggccaccggcgtgagcttcaccatggaccaggacaccaccctggcccacctgctgcagctgcagctgcaccactacgaggacgaggtgagaggcatcgtggacaaggccgccaaggagatgggcatggagaagaccctgaaggagctgcagaccacctgggccggcatggagttccagtacgagccccaccccagaaccaacgtgcccctgctgtgcagcgacgaggacctgatcgaggtgctggaggacaaccaggtgcagctgcagaacctggtgatgagcaagtacgtggccttcttcctggaggaggtgagcggctggcagaagaagctgagcaccgtggacgccgtgatcagcatctggttcgaggtgcagagaacctggacccacctggagagcatcttcaccggcagcgaggacatcagagcccagctgccccaggacagcaagagattcgagggcatcgacatcgacttcaaggagctggcctacgacgcccagaagatccccaacgtggtgcagaccaccaacaagcccggcctgtacgagaagctggaggacatccagggcagactgtgcctgtgcgagaaggccctggccgagtacctggacaccaagagactggccttccccagattctacttcctgagcagcagcgacctgctggacatcctgagcaacggcaccgccccccagcaggtgcagagacacctgagcaagctgttcgacaacatggccaagatgagattccagctggacgccagcggcgagcccaccaagaccagcctgggcatgtacagcaaggaggaggagtacgtggccttcagcgagccctgcgactgcagcggccaggtggagatctggctgaaccacgtgctgggccacatgaaggccaccgtgagacacgagatgaccgagggcgtgaccgcctacgaggagaagcccagagagcagtggctgttcgaccaccccgcccaggtggccctgacctgcacccagatctggtggaccaccgaggtgggcatggccttcgccagactggaggagggctacgagagcgccatgaaggactactacaagaagcaggtggcccagctgaagaccctgatcaccatgctgatcggccagctgagcaagggcgacagacagaagatcatgaccatctgcaccatcgacgtgcacgccagagacgtggtggccaagatgatcgcccagaaggtggacaacgcccaggccttcctgtggctgagccagctgagacacagatgggacgacgaggtgaagcactgcttcgccaacatctgcgacgcccagttcctgtacagctacgagtacctgggcaacacccccagactggtgatcacccccctgaccgacagatgctacatcaccctgacccagagcctgcacctgaccatgagcggcgcccccgccggccccgccggcaccggcaagaccgagaccaccaaggacctgggcagagccctgggcatcctggtgtacgtgttcaactgcagcgagcagatggactacaagagctgcggcaacatctacaagggcctggcccagaccggcgcctggggctgcttcgacgagttcaacagaatcagcgtggaggtgctgagcgtggtggccgtgcaggtgaagagcatccaggacgccatcagagacaagaagcagtggttcagcttcctgggcgaggagatcagcctgaaccccagcgtgggcatcttcatcaccatgaaccccggctacgccggcagaaccgagctgcccgagaacctgaagagcctgttcagaccctgcgccatggtggtgcccgacttcgagctgatctgcgagatcatgctggtggccgagggcttcatcgaggcccagagcctggccagaaagttcatcaccctgtaccagctgtgcaaggagctgctgagcaagcaggaccactacgactggggcctgagagccatcaagagcgtgctggtggtggccggcagcctgaagagaggcgaccccgacagacccgaggaccaggtgctgatgagaagcctgagagacttcaacatccccaagatcgtgaccgacgacatgcccatcttcatgggcctgatcggcgacctgttccccgccctggacgtgcccagaagaagagaccccaacttcgaggccctggtgagaaaggccatcgtggacctgaagctgcaggccgaggacaacttcgtgctgaaggtggtgcagctggaggagctgctggccgtgagacacagcgtgttcgtggtgggcggcgccggcaccggcaagagccaggtgctgagaagcctgcacaagacctaccagatcatgaagagaagacccgtgtggaccgacctgaaccccaaggccgtgaccaacgacgagctgttcggcatcatcaaccccgccaccggcgagtggaaggacggcctgttcagcagcatcatgagagagctggccaacatcacccacgacggccccaagtggatcctgctggacggcgacatcgaccccatgtggatcgagagcctgaacaccgtgatggacgacaacaaggtgctgaccctggccagcaacgagagaatccccctgaaccccaccatgaagctgctgttcgagatcagccacctgagaaccgccacccccgccaccgtgagcagagccggcatcctgtacatcaaccccgccgacctgggctggaacccccccgtgagcagctggatcgagaagagagagatccagaccgagagagccaacctgaccatcctgttcgacaagtacctgcccacctgcctggacaccctgagaaccagattcaagaagatcatccccatccccgagcagagcatggtgcagatggtgtgccacctgctggagtgcctgctgaccaccgaggacatccccgccgactgccccaaggagatctacgagcactacttcgtgttcgccgccatctgggccttcggcggcgccatggtgcaggaccagctggtggactacagagccgagttcagcaagtggtggctgaccgagttcaagaccgtgaagttccccagccagggcaccatcttcgactactacatcgaccccgagaccaagaagttcgagccctggagcaagctggtgccccagttcgagttcgaccccgagatgcccctgcaggcctgcctggtgcacaccagcgagaccatcagagtgtgctacttcatggagagactgatggccagacagagacccgtgatgctggtgggcaccgccggcaccggcaagagcgtgctggtgggcgccaagctggccagcctggaccccgaggcctacctggtgaagaacgtgcccttcaactactacaccaccagcgccatgctgcaggccgtgctggagaagcccctggagaagaaggccggcagaaactacggcccccccggcaacaagaagctgatctacttcatcgacgacatgaacatgcccgaggtggacgcctacggcaccgtgcagccccacaccatcatcagacagcacctggactacggccactggtacgacagaagcaagctgagcctgaaggagatcaccaacgtgcagtacgtgagctgcatgaaccccaccgccggcagcttcaccatcaaccccagactgcagagacacttcagcgtgttcgtgctgagcttccccggcgccgacgccctgagcagcatctacagcatcatcctgacccagcacctgaagctgggcaacttccccgccagcctgcagaagagcatcccccccctgatcgacctggccctggccttccaccagaagatcgccaccaccttcctgcccaccggcatcaagttccactacatcttcaacctgagagacttcgccaacatcttccagggcatcctgttcagcagcgtggagtgcgtgaagagcacctgggacctgatcagactgtacctgcacgagagcaacagagtgtacagagacaagatggtggaggagaaggacttcgacctgttcgacaagatccagaccgaggtgctgaagaagaccttcgacgacatcgaggaccccgtggagcagacccagagccccaacctgtactgccacttcgccaacggcatcggcgagcccaagtacatgcccgtgcagagctgggagctgctgacccagaccctggtggaggccctggagaaccacaacgaggtgaacaccgtgatggacctggtgctgttcgaggacgccatgagacacgtgtgccacatcaacagaatcctggagagccccagaggcaacgccctgctggtgggcgtgggcggcagcggcaagcagagcctgaccagactggccgccttcatcagcagcatggacgtgttccagatcaccctgagaaagggctaccagatccaggacttcaagatggacctggccagcctgtgcctgaaggccggcgtgaagaacctgaacaccgtgttcctgatgaccgacgcccaggtggccgacgagagattcctggtgctgatcaacgacctgctggccagcggcgagatccccgacctgtacagcgacgacgaggtggagaacatcatcagcaacgtgagaaacgaggtgaagagccagggcctggtggacaacagagagaactgctggaagttcttcatcgacagaatcagaagacagctgaaggtgaccctgtgcttcagccccgtgggcaacaagctgagagtgagaagcagaaagttccccgccatcgtgaactgcaccgccatccactggttccacgagtggccccagcaggccctggagagcgtgagcctgagattcctgcagaacaccgagggcatcgagcccaccgtgaagcagagcatcagcaagttcatggccttcgtgcacaccagcgtgaaccagaccagccagagctacctgagcaacgagcagagatacaactacaccacccccaagagcttcctggagttcatcagactgtaccagagcctgctgcacagacacagaaaggagctgaagtgcaagaccgagagactggagaacggcctgctgaagctgcacagcaccagcgcccaggtggacgacctgaaggccaagctggccgcccaggaggtggagctgaagcagaagaacgaggacgccgacaagctgatccaggtggtgggcgtggagaccgacaaggtgagcagagagaaggccatggccgacgaggaggagcagaaggtggccgtgatcatgctggaggtgaagcagaagcagaaggactgcgaggaggacctggccaaggccgagcccgccctgaccgccgcccaggccgccctgaacaccctgaacaagaccaacctgaccgagctgaagagcttcggcagcccccccctggccgtgagcaacgtgagcgccgccgtgatggtgctgatggcccccagaggcagagtgcccaaggacagaagctggaaggccgccaaggtgaccatggccaaggtggacggcttcctggacagcctgatcaacttcaacaaggagaacatccacgagaactgcctgaaggccatcagaccctacctgcaggaccccgagttcaaccccgagttcgtggccaccaagagctacgccgccgccggcctgtgcagctgggtgatcaacatcgtgagattctacgaggtgttctgcgacgtggagcccaagagacaggccctgaacaaggccaccgccgacctgaccgccgcccaggagaagctggccgccatcaaggccaagatcgcccacctgaacgagaacctggccaagctgaccgccagattcgagaaggccaccgccgacaagctgaagtgccagcaggaggccgaggtgaccgccgtgaccatcagcctggccaacagactggtgggcggcctggccagcgagaacgtgagatgggccgacgccgtgcagaacttcaagcagcaggagagaaccctgtgcggcgacatcctgctgatcaccgccttcatcagctacctgggcttcttcaccaagaagtacagacagagcctgctggacagaacctggagaccctacctgagccagctgaagacccccatccccgtgacccccgccctggaccccctgagaatgctgatggacgacgccgacgtggccgcctggcagaacgagggcctgcccgccgacagaatgagcgtggagaacgccaccatcctgatcaactgcgagagatggcccctgatggtggacccccagctgcagggcatcaagtggatcaagaacaagtacggcgaggacctgagagtgacccagatcggccagaagggctacctgcagatcatcgagcaggccctggaggccggcgccgtggtgctgatcgagaacctggaggagagcatcgaccccgtgctgggccccctgctgggcagagaggtgatcaagaagggcagattcatcaagatcggcgacaaggagtgcgagtacaaccccaagttcagactgatcctgcacaccaagctggccaacccccactaccagcccgagctgcaggcccaggccaccctgatcaacttcaccgtgaccagagacggcctggaggaccagctgctggccgccgtggtgagcatggagagacccgacctggagcagctgaagagcgacctgaccaagcagcagaacggcttcaagatcaccctgaagaccctggaggacagcctgctgagcagactgagcagcgccagcggcaacttcctgggcgagaccgtgctggtggagaacctggagatcaccaagcagaccgccgccgaggtggagaagaaggtgcaggaggccaaggtgaccgaggtgaagatcaacgaggccagagagcactacagacccgccgccgccagagccagcctgctgtacttcatcatgaacgacctgagcaagatccaccccatgtaccagttcagcctgaaggccttcagcatcgtgttccagaaggccgtggagagagccgcccccgacgagagcctgagagagagagtggccaacctgatcgacagcatcaccttcagcgtgtaccagtacaccatcagaggcctgttcgagtgcgacaagctgacctacctggcccagctgaccttccagatcctgctgatgaacagagaggtgaacgccgtggagctggacttcctgctgagaagccccgtgcagaccggcaccgccagccccgtggagttcctgagccaccaggcctggggcgccgtgaaggtgctgagcagcatggaggagttcagcaacctggacagagacatcgagggcagcgccaagagctggaagaagttcgtggagagcgagtgccccgagaaggagaagctgccccaggagtggaagaacaagaccgccctgcagagactgtgcatgctgagagccatgagacccgacagaatgacctacgccctgagagacttcgtggaggagaagctgggcagcaagtacgtggtgggcagagccctggacttcgccaccagcttcgaggagagcggccccgccacccccatgttcttcatcctgagccccggcgtggaccccctgaaggacgtggagagccagggcagaaagctgggctacaccttcaacaaccagaacttccacaacgtgagcctgggccagggccaggaggtggtggccgaggccgccctggacctggccgccaagaagggccactgggtgatcctgcagaacatccacctggtggccaagtggctgagcaccctggagaagaagctggaggagcacagcgagaacagccaccccgagttcagagtgttcatgagcgccgagcccgcccccagccccgagggccacatcatcccccagggcatcctggagaacagcatcaagatcaccaacgagccccccaccggcatgcacgccaacctgcacaaggccctggacaacttcacccaggacaccctggagatgtgcagcagagagaccgagttcaagagcatcctgttcgccctgtgctacttccacgccgtggtggccgagagaagaaagttcggcccccagggctggaacagaagctaccccttcaacaccggcgacctgaccatcagcgtgaacgtgctgtacaacttcctggaggccaacgccaaggtgccctacgacgacctgagatacctgttcggcgagatcatgtacggcggccacatcaccgacgactgggacagaagactgtgcagaacctacctgggcgagttcatcagacccgagatgctggagggcgagctgagcctggcccccggcttccccctgcccggcaacatggactacaacggctaccaccagtacatcgacgccgagctgccccccgagagcccctacctgtacggcctgcaccccaacgccgagatcggcttcctgacccagaccagcgagaagctgttcagaaccgtgctggagctgcagcccagagacagccaggccagagacggcgccggcgccaccagagaggagaaggtgaaggccctgctggaggagatcctggagagagtgaccgacgagttcaacatccccgagctgatggccaaggtggaggagagaaccccctacatcgtggtggccttccaggagtgcggcagaatgaacatcctgaccagagagatccagagaagcctgagagagctggagctgggcctgaagggcgagctgaccatgaccagccacatggagaacctgcagaacgccctgtacttcgacatggtgcccgagagctgggccagaagagcctaccccagcaccgccggcctggccgcctggttccccgacctgctgaacagaatcaaggagctggaggcctggaccggcgacttcaccatgcccagcaccgtgtggctgaccggcttcttcaacccccagagcttcctgaccgccatcatgcagagcaccgccagaaagaacgagtggcccctggaccagatggccctgcagtgcgacatgaccaagaagaacagagaggagttcagaagcccccccagagagggcgcctacatccacggcctgttcatggagggcgcctgctgggacacccaggccggcatcatcaccgaggccaagctgaaggacctgaccccccccatgcccgtgatgttcatcaaggccatccccgccgacaagcaggactgcagaagcgtgtacagctgccccgtgtacaagaccagccagagaggccccacctacgtgtggaccttcaacctgaagaccaaggagaaccccagcaagtgggtgctggccggcgtggccctgctgctgcagatctag

SEQ ID NO: 79856 - DNA, 1002 bp, Artificial Sequence
  Description of Artificial Sequence: Synthetic coding sequence
atgaaggacttcgtgctgggcagagacaaggtgcaggaggccaaggtgaccgaggtgaagatcaacgaggccagagagcactacagacccgccgccgccagagccagcctgctgtacttcatcatgaacgacctgagcaagatccaccccatgtaccagttcagcctgaaggccttcagcatcgtgttccagaaggccgtggagagagccgcccccgacgagagcctgagagagagagtggccaacctgatcgacagcatcaccttcagcgtgtaccagtacaccatcagaggcctgttcgagtgcgacaagctgacctacctggcccagctgaccttccagatcctgctgatgaacagagaggtgaacgccgtggagctggacttcctgctgagaagccccgtgcagaccggcaccgccagccccgtggagttcctgagccaccaggcctggggcgccgtgaaggtgctgagcagcatggaggagttcagcaacctggacagagacatcgagggcagcgccaagagctggaagaagttcgtggagagcgagtgccccgagaaggagaagctgccccaggagtggaagaacaagaccgccctgcagagactgtgcatgctgagagccatgagacccgacagaatgacctacgccctgagagacttcgtggaggagaagctgggcagcaagtacgtggtgggcagagccctggacttcgccaccagcttcgaggagagcggccccgccacccccatgttcttcatcctgagccccggcgtggaccccctgaaggacgtggagagccagggcagaaagctgggctacaccttcaacaaccagaacttccacaacgtgagcctgggccagggccaggaggtggtggccgaggccgccctggacctggccgccaagaagggccactgggtgatcctgcaggtgaagagatgcagcttcttcaccttctaccaccccgcccactgcctggagcacagcagacactag

SEQ ID NO: 79857 - DNA, 2397 bp, Artificial Sequence
  Description of Artificial Sequence: Synthetic coding sequence
atgaacgacctgagcaagatccaccccatgtaccagttcagcctgaaggccttcagcatcgtgttccagaaggccgtggagagagccgcccccgacgagagcctgagagagagagtggccaacctgatcgacagcatcaccttcagcgtgtaccagtacaccatcagaggcctgttcgagtgcgacaagctgacctacctggcccagctgaccttccagatcctgctgatgaacagagaggtgaacgccgtggagctggacttcctgctgagaagccccgtgcagaccggcaccgccagccccgtggagttcctgagccaccaggcctggggcgccgtgaaggtgctgagcagcatggaggagttcagcaacctggacagagacatcgagggcagcgccaagagctggaagaagttcgtggagagcgagtgccccgagaaggagaagctgccccaggagtggaagaacaagaccgccctgcagagactgtgcatgctgagagccatgagacccgacagaatgacctacgccctgagagacttcgtggaggagaagctgggcagcaagtacgtggtgggcagagccctggacttcgccaccagcttcgaggagagcggccccgccacccccatgttcttcatcctgagccccggcgtggaccccctgaaggacgtggagagccagggcagaaagctgggctacaccttcaacaaccagaacttccacaacgtgagcctgggccagggccaggaggtggtggccgaggccgccctggacctggccgccaagaagggccactgggtgatcctgcagaacatccacctggtggccaagtggctgagcaccctggagaagaagctggaggagcacagcgagaacagccaccccgagttcagagtgttcatgagcgccgagcccgcccccagccccgagggccacatcatcccccagggcatcctggagaacagcatcaagatcaccaacgagccccccaccggcatgcacgccaacctgcacaaggccctggacaacttcacccaggacaccctggagatgtgcagcagagagaccgagttcaagagcatcctgttcgccctgtgctacttccacgccgtggtggccgagagaagaaagttcggcccccagggctggaacagaagctaccccttcaacaccggcgacctgaccatcagcgtgaacgtgctgtacaacttcctggaggccaacgccaaggtgccctacgacgacctgagatacctgttcggcgagatcatgtacggcggccacatcaccgacgactgggacagaagactgtgcagaacctacctgggcgagttcatcagacccgagatgctggagggcgagctgagcctggcccccggcttccccctgcccggcaacatggactacaacggctaccaccagtacatcgacgccgagctgccccccgagagcccctacctgtacggcctgcaccccaacgccgagatcggcttcctgacccagaccagcgagaagctgttcagaaccgtgctggagctgcagcccagagacagccaggccagagacggcgccggcgccaccagagaggagaaggtgaaggccctgctggaggagatcctggagagagtgaccgacgagttcaacatccccgagctgatggccaaggtggaggagagaaccccctacatcgtggtggccttccaggagtgcggcagaatgaacatcctgaccagagagatccagagaagcctgagagagctggagctgggcctgaagggcgagctgaccatgaccagccacatggagaacctgcagaacgccctgtacttcgacatggtgcccgagagctgggccagaagagcctaccccagcaccgccggcctggccgcctggttccccgacctgctgaacagaatcaaggagctggaggcctggaccggcgacttcaccatgcccagcaccgtgtggctgaccggcttcttcaacccccagagcttcctgaccgccatcatgcagagcaccgccagaaagaacgagtggcccctggaccagatggccctgcagtgcgacatgaccaagaagaacagagaggagttcagaagcccccccagagagggcgcctacatccacggcctgttcatggagggcgcctgctgggacacccaggccggcatcatcaccgaggccaagctgaaggacctgaccccccccatgcccgtgatgttcatcaaggccatccccgccgacaagcaggactgcagaagcgtgtacagctgccccgtgtacaagaccagccagagaggccccacctacgtgtggaccttcaacctgaagaccaaggagaaccccagcaagtgggtgctggccggcgtggccctgctgctgcagatctag

SEQ ID NO: 79858 - DNA, 8979 bp, Artificial Sequence
  Description of Artificial Sequence: Synthetic coding sequence
gaggtgagaggcatcgtggacaaggccgccaaggagatgggcatggagaagaccctgaaggagctgcagaccacctgggccggcatggagttccagtacgagccccaccccagaaccaacgtgcccctgctgtgcagcgacgaggacctgatcgaggtgctggaggacaaccaggtgcagctgcagaacctggtgatgagcaagtacgtggccttcttcctggaggaggtgagcggctggcagaagaagctgagcaccgtggacgccgtgatcagcatctggttcgaggtgcagagaacctggacccacctggagagcatcttcaccggcagcgaggacatcagagcccagctgccccaggacagcaagagattcgagggcatcgacatcgacttcaaggagctggcctacgacgcccagaagatccccaacgtggtgcagaccaccaacaagcccggcctgtacgagaagctggaggacatccagggcagactgtgcctgtgcgagaaggccctggccgagtacctggacaccaagagactggccttccccagattctacttcctgagcagcagcgacctgctggacatcctgagcaacggcaccgccccccagcaggtgcagagacacctgagcaagctgttcgacaacatggccaagatgagattccagctggacgccagcggcgagcccaccaagaccagcctgggcatgtacagcaaggaggaggagtacgtggccttcagcgagccctgcgactgcagcggccaggtggagatctggctgaaccacgtgctgggccacatgaaggccaccgtgagacacgagatgaccgagggcgtgaccgcctacgaggagaagcccagagagcagtggctgttcgaccaccccgcccaggtggccctgacctgcacccagatctggtggaccaccgaggtgggcatggccttcgccagactggaggagggctacgagagcgccatgaaggactactacaagaagcaggtggcccagctgaagaccctgatcaccatgctgatcggccagctgagcaagggcgacagacagaagatcatgaccatctgcaccatcgacgtgcacgccagagacgtggtggccaagatgatcgcccagaaggtggacaacgcccaggccttcctgtggctgagccagctgagacacagatgggacgacgaggtgaagcactgcttcgccaacatctgcgacgcccagttcctgtacagctacgagtacctgggcaacacccccagactggtgatcacccccctgaccgacagatgctacatcaccctgacccagagcctgcacctgaccatgagcggcgcccccgccggccccgccggcaccggcaagaccgagaccaccaaggacctgggcagagccctgggcatcctggtgtacgtgttcaactgcagcgagcagatggactacaagagctgcggcaacatctacaagggcctggcccagaccggcgcctggggctgcttcgacgagttcaacagaatcagcgtggaggtgctgagcgtggtggccgtgcaggtgaagagcatccaggacgccatcagagacaagaagcagtggttcagcttcctgggcgaggagatcagcctgaaccccagcgtgggcatcttcatcaccatgaaccccggctacgccggcagaaccgagctgcccgagaacctgaagagcctgttcagaccctgcgccatggtggtgcccgacttcgagctgatctgcgagatcatgctggtggccgagggcttcatcgaggcccagagcctggccagaaagttcatcaccctgtaccagctgtgcaaggagctgctgagcaagcaggaccactacgactggggcctgagagccatcaagagcgtgctggtggtggccggcagcctgaagagaggcgaccccgacagacccgaggaccaggtgctgatgagaagcctgagagacttcaacatccccaagatcgtgaccgacgacatgcccatcttcatgggcctgatcggcgacctgttccccgccctggacgtgcccagaagaagagaccccaacttcgaggccctggtgagaaaggccatcgtggacctgaagctgcaggccgaggacaacttcgtgctgaaggtggtgcagctggaggagctgctggccgtgagacacagcgtgttcgtggtgggcggcgccggcaccggcaagagccaggtgctgagaagcctgcacaagacctaccagatcatgaagagaagacccgtgtggaccgacctgaaccccaaggccgtgaccaacgacgagctgttcggcatcatcaaccccgccaccggcgagtggaaggacggcctgttcagcagcatcatgagagagctggccaacatcacccacgacggccccaagtggatcctgctggacggcgacatcgaccccatgtggatcgagagcctgaacaccgtgatggacgacaacaaggtgctgaccctggccagcaacgagagaatccccctgaaccccaccatgaagctgctgttcgagatcagccacctgagaaccgccacccccgccaccgtgagcagagccggcatcctgtacatcaaccccgccgacctgggctggaacccccccgtgagcagctggatcgagaagagagagatccagaccgagagagccaacctgaccatcctgttcgacaagtacctgcccacctgcctggacaccctgagaaccagattcaagaagatcatccccatccccgagcagagcatggtgcagatggtgtgccacctgctggagtgcctgctgaccaccgaggacatccccgccgactgccccaaggagatctacgagcactacttcgtgttcgccgccatctgggccttcggcggcgccatggtgcaggaccagctggtggactacagagccgagttcagcaagtggtggctgaccgagttcaagaccgtgaagttccccagccagggcaccatcttcgactactacatcgaccccgagaccaagaagttcgagccctggagcaagctggtgccccagttcgagttcgaccccgagatgcccctgcaggcctgcctggtgcacaccagcgagaccatcagagtgtgctacttcatggagagactgatggccagacagagacccgtgatgctggtgggcaccgccggcaccggcaagagcgtgctggtgggcgccaagctggccagcctggaccccgaggcctacctggtgaagaacgtgcccttcaactactacaccaccagcgccatgctgcaggccgtgctggagaagcccctggagaagaaggccggcagaaactacggcccccccggcaacaagaagctgatctacttcatcgacgacatgaacatgcccgaggtggacgcctacggcaccgtgcagccccacaccatcatcagacagcacctggactacggccactggtacgacagaagcaagctgagcctgaaggagatcaccaacgtgcagtacgtgagctgcatgaaccccaccgccggcagcttcaccatcaaccccagactgcagagacacttcagcgtgttcgtgctgagcttccccggcgccgacgccctgagcagcatctacagcatcatcctgacccagcacctgaagctgggcaacttccccgccagcctgcagaagagcatcccccccctgatcgacctggccctggccttccaccagaagatcgccaccaccttcctgcccaccggcatcaagttccactacatcttcaacctgagagacttcgccaacatcttccagggcatcctgttcagcagcgtggagtgcgtgaagagcacctgggacctgatcagactgtacctgcacgagagcaacagagtgtacagagacaagatggtggaggagaaggacttcgacctgttcgacaagatccagaccgaggtgctgaagaagaccttcgacgacatcgaggaccccgtggagcagacccagagccccaacctgtactgccacttcgccaacggcatcggcgagcccaagtacatgcccgtgcagagctgggagctgctgacccagaccctggtggaggccctggagaaccacaacgaggtgaacaccgtgatggacctggtgctgttcgaggacgccatgagacacgtgtgccacatcaacagaatcctggagagccccagaggcaacgccctgctggtgggcgtgggcggcagcggcaagcagagcctgaccagactggccgccttcatcagcagcatggacgtgttccagatcaccctgagaaagggctaccagatccaggacttcaagatggacctggccagcctgtgcctgaaggccggcgtgaagaacctgaacaccgtgttcctgatgaccgacgcccaggtggccgacgagagattcctggtgctgatcaacgacctgctggccagcggcgagatccccgacctgtacagcgacgacgaggtggagaacatcatcagcaacgtgagaaacgaggtgaagagccagggcctggtggacaacagagagaactgctggaagttcttcatcgacagaatcagaagacagctgaaggtgaccctgtgcttcagccccgtgggcaacaagctgagagtgagaagcagaaagttccccgccatcgtgaactgcaccgccatccactggttccacgagtggccccagcaggccctggagagcgtgagcctgagattcctgcagaacaccgagggcatcgagcccaccgtgaagcagagcatcagcaagttcatggccttcgtgcacaccagcgtgaaccagaccagccagagctacctgagcaacgagcagagatacaactacaccacccccaagagcttcctggagttcatcagactgtaccagagcctgctgcacagacacagaaaggagctgaagtgcaagaccgagagactggagaacggcctgctgaagctgcacagcaccagcgcccaggtggacgacctgaaggccaagctggccgcccaggaggtggagctgaagcagaagaacgaggacgccgacaagctgatccaggtggtgggcgtggagaccgacaaggtgagcagagagaaggccatggccgacgaggaggagcagaaggtggccgtgatcatgctggaggtgaagcagaagcagaaggactgcgaggaggacctggccaaggccgagcccgccctgaccgccgcccaggccgccctgaacaccctgaacaagaccaacctgaccgagctgaagagcttcggcagcccccccctggccgtgagcaacgtgagcgccgccgtgatggtgctgatggcccccagaggcagagtgcccaaggacagaagctggaaggccgccaaggtgaccatggccaaggtggacggcttcctggacagcctgatcaacttcaacaaggagaacatccacgagaactgcctgaaggccatcagaccctacctgcaggaccccgagttcaaccccgagttcgtggccaccaagagctacgccgccgccggcctgtgcagctgggtgatcaacatcgtgagattctacgaggtgttctgcgacgtggagcccaagagacaggccctgaacaaggccaccgccgacctgaccgccgcccaggagaagctggccgccatcaaggccaagatcgcccacctgaacgagaacctggccaagctgaccgccagattcgagaaggccaccgccgacaagctgaagtgccagcaggaggccgaggtgaccgccgtgaccatcagcctggccaacagactggtgggcggcctggccagcgagaacgtgagatgggccgacgccgtgcagaacttcaagcagcaggagagaaccctgtgcggcgacatcctgctgatcaccgccttcatcagctacctgggcttcttcaccaagaagtacagacagagcctgctggacagaacctggagaccctacctgagccagctgaagacccccatccccgtgacccccgccctggaccccctgagaatgctgatggacgacgccgacgtggccgcctggcagaacgagggcctgcccgccgacagaatgagcgtggagaacgccaccatcctgatcaactgcgagagatggcccctgatggtggacccccagctgcagggcatcaagtggatcaagaacaagtacggcgaggacctgagagtgacccagatcggccagaagggctacctgcagatcatcgagcaggccctggaggccggcgccgtggtgctgatcgagaacctggaggagagcatcgaccccgtgctgggccccctgctgggcagagaggtgatcaagaagggcagattcatcaagatcggcgacaaggagtgcgagtacaaccccaagttcagactgatcctgcacaccaagctggccaacccccactaccagcccgagctgcaggcccaggccaccctgatcaacttcaccgtgaccagagacggcctggaggaccagctgctggccgccgtggtgagcatggagagacccgacctggagcagctgaagagcgacctgaccaagcagcagaacggcttcaagatcaccctgaagaccctggaggacagcctgctgagcagactgagcagcgccagcggcaacttcctgggcgagaccgtgctggtggagaacctggagatcaccaagcagaccgccgccgaggtggagaagaaggtgcaggaggccaaggtgaccgaggtgaagatcaacgaggccagagagcactacagacccgccgccgccagagccagcctgctgtacttcatcatgaacgacctgagcaagatccaccccatgtaccagttcagcctgaaggccttcagcatcgtgttccagaaggccgtggagagagccgcccccgacgagagcctgagagagagagtggccaacctgatcgacagcatcaccttcagcgtgtaccagtacaccatcagaggcctgttcgagtgcgacaagctgacctacctggcccagctgaccttccagatcctgctgatgaacagagaggtgaacgccgtggagctggacttcctgctgagaagccccgtgcagaccggcaccgccagccccgtggagttcctgagccaccaggcctggggcgccgtgaaggtgctgagcagcatggaggagttcagcaacctggacagagacatcgagggcagcgccaagagctggaagaagttcgtggagagcgagtgccccgagaaggagaagctgccccaggagtggaagaacaagaccgccctgcagagactgtgcatgctgagagccatgagacccgacagaatgacctacgccctgagagacttcgtggaggagaagctgggcagcaagtacgtggtgggcagagccctggacttcgccaccagcttcgaggagagcggccccgccacccccatgttcttcatcctgagccccggcgtggaccccctgaaggacgtggagagccagggcagaaagctgggctacaccttcaacaaccagaacttccacaacgtgagcctgggccagggccaggaggtggtggccgaggccgccctggacctggccgccaagaagggccactgggtgatcctgcaggacaccctggagatgtgcagcagagagaccgagttcaagagcatcctgttcgccctgtgctacttccacgccgtggtggccgagagaagaaagttcggcccccagggctggaacagaagctaccccttcaacaccggcgacctgaccatcagcgtgaacgtgctgtacaacttcctggaggccaacgccaaggtgccctacgacgacctgagatacctgttcggcgagatcatgtacggcggccacatcaccgacgactgggacagaagactgtgcagaacctacctgggcgagttcatcagacccgagatgctggagggcgagctgagcctggcccccggcttccccctgcccggcaacatggactacaacggctaccaccagtacatcgacgccgagctgccccccgagagcccctacctgtacggcctgcaccccaacgccgagatcggcttcctgacccagaccagcgagaagctgttcagaaccgtgctggagctgcagcccagagacagccaggccagagacggcgccggcgccaccagagaggagaaggtgaaggccctgctggaggagatcctggagagagtgaccgacgagttcaacatccccgagctgatggccaaggtggaggagagaaccccctacatcgtggtggccttccaggagtgcggcagaatgaacatcctgaccagagagatccagagaagcctgagagagctggagctgggcctgaagggcgagctgaccatgaccagccacatggagaacctgcagaacgccctgtacttcgacatggtgcccgagagctgggccagaagagcctaccccagcaccgccggcctggccgcctggttccccgacctgctgaacagaatcaaggagctggaggcctggaccggcgacttcaccatgcccagcaccgtgtggctgaccggcttcttcaacccccagagcttcctgaccgccatcatgcagagcaccgccagaaagaacgagtggcccctggaccagatggccctgcagtgcgacatgaccaagaagaacagagaggagttcagaagcccccccagagagggcgcctacatccacggcctgttcatggagggcgcctgctgggacacccaggccggcatcatcaccgaggccaagctgaaggacctgaccccccccatgcccgtgatgttcatcaaggccatccccgccgacaagcaggactgcagaagcgtgtacagctgccccgtgtacaagaccagccagagaggccccacctacgtgtggaccttcaacctgaagaccaaggagaaccccagcaagtgggtgctggccggcgtggccctgctgctgcagatctag

SEQ ID NO: 79859 - DNA, 13233 bp, Artificial Sequence
  Description of Artificial Sequence: Synthetic coding sequence
atgagactggccgaggagagagccgccctggccgccgagaacgccgacggcgagcccggcgccgacagaagactgagactgctgggcacctacgtggccatgagcctgagacccgccgccggcgcctgggagagatgcgccggcagcgccgaggccgagcagctgctgcaggccttcctgggcagagacgccgccgagggccccagacccctgctggtggtgagacccggccccagaggcctggccatcagacccggcctggaggtgggccccgagagcggcctggccggcgccaaggccctgttcttcctgagaaccggccccgagccccccggccccgacagcttcagaggcgccgtggtgtgcggcgacctgcccgccgcccccctggagcacctggccgccctgttcagcgaggtggtgctgcccgtgctggccaacgagaagaacagactgaactggccccacatgatctgcgaggacgtgagaagacacgcccacagcctgcagtgcgacctgagcgtgatcctggagcaggtgaagggcaagaccctgctgcccctgcccgccggcagcgagaagatggagttcgccgacagcaagagcgagaccgtgctggacagcatcgacaagagcgtgatctacgccatcgagagcgccgtgatcaagtggagctaccaggtgcaggtggtgctgaagagagagagcagccagcccctgctgcagggcgagaaccccacccccaaggtggagctggagttctggaagagcagatacgaggacctgaagtacatctacaaccagctgagaaccatcaccgtgagaggcatggccaagctgctggacaagctgcagagcagctacttccccgccttcaaggccatgtacagagacgtggtggccgccctggccgaggcccaggacatccacgtgcacctgatccccctgcagagacacctggaggccctggagaacgccgagttccccgaggtgaagccccagctgagacccctgctgcacgtggtgtgcctgatctgggccacctgcaagagctacagaagccccggcagactgaccgtgctgctgcaggagatctgcaacctgctgatccagcaggccagcaactacctgagccccgaggacctgctgagaagcgaggtggaggagagccagagaaagctgcaggtggtgagcgacaccctgagcttcttcaagcaggagttccaggacagaagagagaacctgcacacctacttcaaggagaaccaggaggtgaaggagtgggacttccagagcagcctggtgttcgtgagactggacggcttcctgggccagctgcacgtggtggagggcctgctgaagaccgccctggacttccacaagctgggcaaggtggagttcagcggcgtgagaggcaacgccctgagccagcaggtgcagcagatgcacgaggagttccaggagatgtacagactgctgagcggcagcagcagcgactgcctgtacctgcagagcaccgacttcgagaacgacgtgagcgagttcaaccagaaggtggaggacctggacagaagactgggcaccatcttcatccaggccttcgacgacgcccccggcctggagcacgccttcaagctgctggacatcgccggcaacctgctggagagacccctggtggccagagacaccagcgacaagtacctggtgctgatccagatgttcaacaaggacctggacgccgtgagaatgatctacagccagcacgtgcaggaggaggccgagctgggcttcagccccgtgcacaagaacatgcccaccgtggccggcggcctgagatgggcccaggagctgagacagagaatccagggccccttcagcaacttcggcagaatcacccacccctgcatggagagcgccgagggcaagagaatgcagcagaagtacgaggacatgctgagcctgctggagaagtacgagaccagactgtacgaggactggtgcagaaccgtgagcgagaagagccagtacaacctgagccagcccctgctgaagagagaccccgagaccaaggagatcaccatcaacttcaacccccagctgatcagcgtgctgaaggagatgagctacctggagcccagagagatgaagcacatgcccgagaccgccgccgccatgttcagcagcagagacttctacagacagctggtggccaacctggagctgatggccaactggtacaacaaggtgatgaagaccctgctggaggtggagttccccctggtggaggaggagctgcagaacatcgacctgagactgagagccgccgaggagaccctgaactggaagaccgagggcatctgcgactacgtgaccgagatcaccagcagcatccacgacctggagcagagaatccagaagaccaaggacaacgtggaggagatccagaacatcatgaagacctgggtgacccccatcttcaagaccaaggacggcaagagagagagcctgctgagcctggacgacagacacgacagaatggagaagtactacaacctgatcaaggagagcggcctgaagatccacgccctggtgcaggagaacctgggcctgttcagcgccgaccccaccagcaacatctggaagacctacgtgaacagcatcgacaacctgctgctgaacggcttcttcctggccatcgagtgcagcctgaagtacctgctggagaacaccgagtgcaaggccggcctgacccccatcttcgaggcccagctgagcctggccatccccgagctggtgttctaccccagcctggagagcggcgtgaagggcggcttctgcgacatcgtggagggcctgatcaccagcatcttcagaatccccagcctggtgcccagactgagcccccagaacggcagcccccactaccaggtggacctggacggcatccccgacctggccaacatgagaagaaccctgatggagagagtgcagagaatgatgggcctgtgctgcggctaccagagcaccttcagccagtacagctacctgtacgtggaggacagaaaggaggtgctgggccagttcctgctgtacggccacatcctgacccccgaggagatcgaggaccacgtggaggacggcatccccgagaacccccccctgctgagccagttcaaggtgcagatcgacagctacgagaccctgtacgaggaggtgtgcagactggagcccatcaaggtgttcgacggctggatgaagatcgacatcagacccttcaaggccagcctgctgaacatcatcaagagatggagcctgctgttcaagcagcacctggtggaccacgtgacccacagcctggccaacctggacgccttcatcaagaagagcgagagcggcctgctgaagaaggtggagaagggcgacttccagggcctggtggagatcatgggccacctgatggccgtgaaggagagacagagcaacaccgacgagatgttcgagcccctgaagcagaccatcgagctgctgaagacctacgagcaggagctgcccgagaccgtgttcaagcagctggaggagctgcccgagaagtggaacaacatcaagaaggtggccatcaccgtgaagcagcaggtggcccccctgcaggccaacgaggtgaccctgctgagacagagatgcaccgccttcgacgccgagcagcagcagttctgggagcagttccacaaggaggcccccttcagattcgacagcatccacccccaccagatgctggacgccagacacatcgagatccagcagatggagagcaccatggccagcatcagcgagagcgccagcctgttcgaggtgaacgtgcccgactacaagcagctgagacagtgcagaaaggaggtgtgccagctgaaggagctgtgggacaccatcggcatggtgaccagcagcatccacgcctgggagaccaccccctggagaaacatcaacgtggaggccatggagctggagtgcaagcagttcgccagacacatcagaaacctggacaaggaggtgagagcctgggacgccttcaccggcctggagagcaccgtgtggaacaccctgagcagcctgagagccgtggccgagctgcagaaccccgccatcagagagagacactggagacagctgatgcaggccaccggcgtgagcttcaccatggaccaggacaccaccctggcccacctgctgcagctgcagctgcaccactacgaggacgaggtgagaggcatcgtggacaaggccgccaaggagatgggcatggagaagaccctgaaggagctgcagaccacctgggccggcatggagttccagtacgagccccaccccagaaccaacgtgcccctgctgtgcagcgacgaggacctgatcgaggtgctggaggacaaccaggtgcagctgcagaacctggtgatgagcaagtacgtggccttcttcctggaggaggtgagcggctggcagaagaagctgagcaccgtggacgccgtgatcagcatctggttcgaggtgcagagaacctggacccacctggagagcatcttcaccggcagcgaggacatcagagcccagctgccccaggacagcaagagattcgagggcatcgacatcgacttcaaggagctggcctacgacgcccagaagatccccaacgtggtgcagaccaccaacaagcccggcctgtacgagaagctggaggacatccagggcagactgtgcctgtgcgagaaggccctggccgagtacctggacaccaagagactggccttccccagattctacttcctgagcagcagcgacctgctggacatcctgagcaacggcaccgccccccagcaggtgcagagacacctgagcaagctgttcgacaacatggccaagatgagattccagctggacgccagcggcgagcccaccaagaccagcctgggcatgtacagcaaggaggaggagtacgtggccttcagcgagccctgcgactgcagcggccaggtggagatctggctgaaccacgtgctgggccacatgaaggccaccgtgagacacgagatgaccgagggcgtgaccgcctacgaggagaagcccagagagcagtggctgttcgaccaccccgcccaggtggccctgacctgcacccagatctggtggaccaccgaggtgggcatggccttcgccagactggaggagggctacgagagcgccatgaaggactactacaagaagcaggtggcccagctgaagaccctgatcaccatgctgatcggccagctgagcaagggcgacagacagaagatcatgaccatctgcaccatcgacgtgcacgccagagacgtggtggccaagatgatcgcccagaaggtggacaacgcccaggccttcctgtggctgagccagctgagacacagatgggacgacgaggtgaagcactgcttcgccaacatctgcgacgcccagttcctgtacagctacgagtacctgggcaacacccccagactggtgatcacccccctgaccgacagatgctacatcaccctgacccagagcctgcacctgaccatgagcggcgcccccgccggccccgccggcaccggcaagaccgagaccaccaaggacctgggcagagccctgggcatcctggtgtacgtgttcaactgcagcgagcagatggactacaagagctgcggcaacatctacaagggcctggcccagaccggcgcctggggctgcttcgacgagttcaacagaatcagcgtggaggtgctgagcgtggtggccgtgcaggtgaagagcatccaggacgccatcagagacaagaagcagtggttcagcttcctgggcgaggagatcagcctgaaccccagcgtgggcatcttcatcaccatgaaccccggctacgccggcagaaccgagctgcccgagaacctgaagagcctgttcagaccctgcgccatggtggtgcccgacttcgagctgatctgcgagatcatgctggtggccgagggcttcatcgaggcccagagcctggccagaaagttcatcaccctgtaccagctgtgcaaggagctgctgagcaagcaggaccactacgactggggcctgagagccatcaagagcgtgctggtggtggccggcagcctgaagagaggcgaccccgacagacccgaggaccaggtgctgatgagaagcctgagagacttcaacatccccaagatcgtgaccgacgacatgcccatcttcatgggcctgatcggcgacctgttccccgccctggacgtgcccagaagaagagaccccaacttcgaggccctggtgagaaaggccatcgtggacctgaagctgcaggccgaggacaacttcgtgctgaaggtggtgcagctggaggagctgctggccgtgagacacagcgtgttcgtggtgggcggcgccggcaccggcaagagccaggtgctgagaagcctgcacaagacctaccagatcatgaagagaagacccgtgtggaccgacctgaaccccaaggccgtgaccaacgacgagctgttcggcatcatcaaccccgccaccggcgagtggaaggacggcctgttcagcagcatcatgagagagctggccaacatcacccacgacggccccaagtggatcctgctggacggcgacatcgaccccatgtggatcgagagcctgaacaccgtgatggacgacaacaaggtgctgaccctggccagcaacgagagaatccccctgaaccccaccatgaagctgctgttcgagatcagccacctgagaaccgccacccccgccaccgtgagcagagccggcatcctgtacatcaaccccgccgacctgggctggaacccccccgtgagcagctggatcgagaagagagagatccagaccgagagagccaacctgaccatcctgttcgacaagtacctgcccacctgcctggacaccctgagaaccagattcaagaagatcatccccatccccgagcagagcatggtgcagatggtgtgccacctgctggagtgcctgctgaccaccgaggacatccccgccgactgccccaaggagatctacgagcactacttcgtgttcgccgccatctgggccttcggcggcgccatggtgcaggaccagctggtggactacagagccgagttcagcaagtggtggctgaccgagttcaagaccgtgaagttccccagccagggcaccatcttcgactactacatcgaccccgagaccaagaagttcgagccctggagcaagctggtgccccagttcgagttcgaccccgagatgcccctgcaggcctgcctggtgcacaccagcgagaccatcagagtgtgctacttcatggagagactgatggccagacagagacccgtgatgctggtgggcaccgccggcaccggcaagagcgtgctggtgggcgccaagctggccagcctggaccccgaggcctacctggtgaagaacgtgcccttcaactactacaccaccagcgccatgctgcaggccgtgctggagaagcccctggagaagaaggccggcagaaactacggcccccccggcaacaagaagctgatctacttcatcgacgacatgaacatgcccgaggtggacgcctacggcaccgtgcagccccacaccatcatcagacagcacctggactacggccactggtacgacagaagcaagctgagcctgaaggagatcaccaacgtgcagtacgtgagctgcatgaaccccaccgccggcagcttcaccatcaaccccagactgcagagacacttcagcgtgttcgtgctgagcttccccggcgccgacgccctgagcagcatctacagcatcatcctgacccagcacctgaagctgggcaacttccccgccagcctgcagaagagcatcccccccctgatcgacctggccctggccttccaccagaagatcgccaccaccttcctgcccaccggcatcaagttccactacatcttcaacctgagagacttcgccaacatcttccagggcatcctgttcagcagcgtggagtgcgtgaagagcacctgggacctgatcagactgtacctgcacgagagcaacagagtgtacagagacaagatggtggaggagaaggacttcgacctgttcgacaagatccagaccgaggtgctgaagaagaccttcgacgacatcgaggaccccgtggagcagacccagagccccaacctgtactgccacttcgccaacggcatcggcgagcccaagtacatgcccgtgcagagctgggagctgctgacccagaccctggtggaggccctggagaaccacaacgaggtgaacaccgtgatggacctggtgctgttcgaggacgccatgagacacgtgtgccacatcaacagaatcctggagagccccagaggcaacgccctgctggtgggcgtgggcggcagcggcaagcagagcctgaccagactggccgccttcatcagcagcatggacgtgttccagatcaccctgagaaagggctaccagatccaggacttcaagatggacctggccagcctgtgcctgaaggccggcgtgaagaacctgaacaccgtgttcctgatgaccgacgcccaggtggccgacgagagattcctggtgctgatcaacgacctgctggccagcggcgagatccccgacctgtacagcgacgacgaggtggagaacatcatcagcaacgtgagaaacgaggtgaagagccagggcctggtggacaacagagagaactgctggaagttcttcatcgacagaatcagaagacagctgaaggtgaccctgtgcttcagccccgtgggcaacaagctgagagtgagaagcagaaagttccccgccatcgtgaactgcaccgccatccactggttccacgagtggccccagcaggccctggagagcgtgagcctgagattcctgcagaacaccgagggcatcgagcccaccgtgaagcagagcatcagcaagttcatggccttcgtgcacaccagcgtgaaccagaccagccagagctacctgagcaacgagcagagatacaactacaccacccccaagagcttcctggagttcatcagactgtaccagagcctgctgcacagacacagaaaggagctgaagtgcaagaccgagagactggagaacggcctgctgaagctgcacagcaccagcgcccaggtggacgacctgaaggccaagctggccgcccaggaggtggagctgaagcagaagaacgaggacgccgacaagctgatccaggtggtgggcgtggagaccgacaaggtgagcagagagaaggccatggccgacgaggaggagcagaaggtggccgtgatcatgctggaggtgaagcagaagcagaaggactgcgaggaggacctggccaaggccgagcccgccctgaccgccgcccaggccgccctgaacaccctgaacaagaccaacctgaccgagctgaagagcttcggcagcccccccctggccgtgagcaacgtgagcgccgccgtgatggtgctgatggcccccagaggcagagtgcccaaggacagaagctggaaggccgccaaggtgaccatggccaaggtggacggcttcctggacagcctgatcaacttcaacaaggagaacatccacgagaactgcctgaaggccatcagaccctacctgcaggaccccgagttcaaccccgagttcgtggccaccaagagctacgccgccgccggcctgtgcagctgggtgatcaacatcgtgagattctacgaggtgttctgcgacgtggagcccaagagacaggccctgaacaaggccaccgccgacctgaccgccgcccaggagaagctggccgccatcaaggccaagatcgcccacctgaacgagaacctggccaagctgaccgccagattcgagaaggccaccgccgacaagctgaagtgccagcaggaggccgaggtgaccgccgtgaccatcagcctggccaacagactggtgggcggcctggccagcgagaacgtgagatgggccgacgccgtgcagaacttcaagcagcaggagagaaccctgtgcggcgacatcctgctgatcaccgccttcatcagctacctgggcttcttcaccaagaagtacagacagagcctgctggacagaacctggagaccctacctgagccagctgaagacccccatccccgtgacccccgccctggaccccctgagaatgctgatggacgacgccgacgtggccgcctggcagaacgagggcctgcccgccgacagaatgagcgtggagaacgccaccatcctgatcaactgcgagagatggcccctgatggtggacccccagctgcagggcatcaagtggatcaagaacaagtacggcgaggacctgagagtgacccagatcggccagaagggctacctgcagatcatcgagcaggccctggaggccggcgccgtggtgctgatcgagaacctggaggagagcatcgaccccgtgctgggccccctgctgggcagagaggtgatcaagaagggcagattcatcaagatcggcgacaaggagtgcgagtacaaccccaagttcagactgatcctgcacaccaagctggccaacccccactaccagcccgagctgcaggcccaggccaccctgatcaacttcaccgtgaccagagacggcctggaggaccagctgctggccgccgtggtgagcatggagagacccgacctggagcagctgaagagcgacctgaccaagcagcagaacggcttcaagatcaccctgaagaccctggaggacagcctgctgagcagactgagcagcgccagcggcaacttcctgggcgagaccgtgctggtggagaacctggagatcaccaagcagaccgccgccgaggtggagaagaaggtgcaggaggccaaggtgaccgaggtgaagatcaacgaggccagagagcactacagacccgccgccgccagagccagcctgctgtacttcatcatgaacgacctgagcaagatccaccccatgtaccagttcagcctgaaggccttcagcatcgtgttccagaaggccgtggagagagccgcccccgacgagagcctgagagagagagtggccaacctgatcgacagcatcaccttcagcgtgtaccagtacaccatcagaggcctgttcgagtgcgacaagctgacctacctggcccagctgaccttccagatcctgctgatgaacagagaggtgaacgccgtggagctggacttcctgctgagaagccccgtgcagaccggcaccgccagccccgtggagttcctgagccaccaggcctggggcgccgtgaaggtgctgagcagcatggaggagttcagcaacctggacagagacatcgagggcagcgccaagagctggaagaagttcgtggagagcgagtgccccgagaaggagaagctgccccaggagtggaagaacaagaccgccctgcagagactgtgcatgctgagagccatgagacccgacagaatgacctacgccctgagagacttcgtggaggagaagctgggcagcaagtacgtggtgggcagagccctggacttcgccaccagcttcgaggagagcggccccgccacccccatgttcttcatcctgagccccggcgtggaccccctgaaggacgtggagagccagggcagaaagctgggctacaccttcaacaaccagaacttccacaacgtgagcctgggccagggccaggaggtggtggccgaggccgccctggacctggccgccaagaagggccactgggtgatcctgcaggacaccctggagatgtgcagcagagagaccgagttcaagagcatcctgttcgccctgtgctacttccacgccgtggtggccgagagaagaaagttcggcccccagggctggaacagaagctaccccttcaacaccggcgacctgaccatcagcgtgaacgtgctgtacaacttcctggaggccaacgccaaggtgccctacgacgacctgagatacctgttcggcgagatcatgtacggcggccacatcaccgacgactgggacagaagactgtgcagaacctacctgggcgagttcatcagacccgagatgctggagggcgagctgagcctggcccccggcttccccctgcccggcaacatggactacaacggctaccaccagtacatcgacgccgagctgccccccgagagcccctacctgtacggcctgcaccccaacgccgagatcggcttcctgacccagaccagcgagaagctgttcagaaccgtgctggagctgcagcccagagacagccaggccagagacggcgccggcgccaccagagaggagaaggtgaaggccctgctggaggagatcctggagagagtgaccgacgagttcaacatccccgagctgatggccaaggtggaggagagaaccccctacatcgtggtggccttccaggagtgcggcagaatgaacatcctgaccagagagatccagagaagcctgagagagctggagctgggcctgaagggcgagctgaccatgaccagccacatggagaacctgcagaacgccctgtacttcgacatggtgcccgagagctgggccagaagagcctaccccagcaccgccggcctggccgcctggttccccgacctgctgaacagaatcaaggagctggaggcctggaccggcgacttcaccatgcccagcaccgtgtggctgaccggcttcttcaacccccagagcttcctgaccgccatcatgcagagcaccgccagaaagaacgagtggcccctggaccagatggccctgcagtgcgacatgaccaagaagaacagagaggagttcagaagcccccccagagagggcgcctacatccacggcctgttcatggagggcgcctgctgggacacccaggccggcatcatcaccgaggccaagctgaaggacctgaccccccccatgcccgtgatgttcatcaaggccatccccgccgacaagcaggactgcagaagcgtgtacagctgccccgtgtacaagaccagccagagaggccccacctacgtgtggaccttcaacctgaagaccaaggagaaccccagcaagtgggtgctggccggcgtggccctgctgctgcagatctag

SEQ ID NO: 79860 - DNA, 2100 bp, Artificial Sequence
  Description of Artificial Sequence: Synthetic coding sequence
atgatccccgccagcgccaaggccccccacaagcagccccacaagcagagcatcagcatcggcagaggcaccagaaagagagacgaggacagcggcaccgaggtgggcgagggcaccgacgagtgggcccagagcaaggccaccgtgagaccccccgaccagctggagctgaccgacgccgagctgaaggaggagttcaccagaatcctgaccgccaacaacccccacgccccccagaacatcgtgagatacagcttcaaggagggcacctacaagcccatcggcttcgtgaaccagctggccgtgcactacacccaggtgggcaacctgatccccaaggacagcgacgagggcagaagacagcactacagagacgagctggtggccggcagccaggagagcgtgaaggtgatcagcgagaccggcaacctggaggaggacgaggagcccaaggagctggagaccgagcccggcagccagaccgacgtgcccgccgccggcgccgccgagaaggtgaccgaggaggagctgatgacccccaagcagcccaaggagagaaagctgaccaaccagttcaacttcagcgagagagccagccagacctacaacaaccccgtgagagacagagagtgccagaccgagcccccccccagaaccaacttcagcgccaccgccaaccagtgggagatctacgacgcctacgtggaggagctggagaagcaggagaagaccaaggagaaggagaaggccaagacccccgtggccaagaagagcggcaagatggccatgagaaagctgaccagcatggagagccagaccgacgacctgatcaagctgagccaggccgccaagatcatggagagaatggtgaaccagaacacctacgacgacatcgcccaggacttcaagtactacgacgacgccgccgacgagtacagagaccaggtgggcaccctgctgcccctgtggaagttccagaacgacaaggccaagagactgagcgtgaccgccctgtgctggaaccccaagtacagagacctgttcgccgtgggctacggcagctacgacttcatgaagcagagcagaggcatgctgctgctgtacagcctgaagaaccccagcttccccgagtacatgttcagcagcaacagcggcgtgatgtgcctggacatccacgtggaccacccctacctggtggccgtgggccactacgacggcaacgtggccatctacaacctgaagaagccccacagccagcccagcttctgcagcagcgccaagagcggcaagcacagcgaccccgtgtggcaggtgaagtggcagaaggacgacatggaccagaacctgaacttcttcagcgtgagcagcgacggcagaatcgtgagctggaccctggtgaagagaaagctggtgcacatcgacgtgatcaagctgaaggtggagggcagcaccaccgaggtgcccgagggcctgcagctgcaccccgtgggctgcggcaccgccttcgacttccacaaggagatcgactacatgttcctggtgggcaccgaggagggcaagatctacaagtgcagcaagagctacagcagccagttcctggacacctacgacgcccacaacatgagcgtggacaccgtgagctggaacccctaccacaccaaggtgttcatgagctgcagcagcgactggaccgtgaagatctgggaccacaccatcaagacccccatgttcatctacgacctgaacagcgccgtgggcgacgtggcctgggccccctacagcagcaccgtgttcgccgccgtgaccaccgacggcaaggcccacatcttcgacctggccatcaacaagtacgaggccatctgcaaccagcccgtggccgccaagaagaacagactgacccacgtgcagttcaacctgatccaccccatcatcatcgtgggcgacgacagaggccacatcatcagcctgaagctgagccccaacctgagaaagatgcccaaggagaagaagggccaggaggtgcagaagggccccgccgtggagatcgccaagctggacaagctgctgaacctggtgagagaggtgaagatcaagacctag

SEQ ID NO: 79861 - DNA, 585 bp, Artificial Sequence
  Description of Artificial Sequence: Synthetic coding sequence
atggaccagaacctgaacttcttcagcgtgagcagcgacggcagaatcgtgagctggaccctggtgaagagaaagctggtgcacatcgacgtgatcaagctgaaggtggagggcagcaccaccgaggtgcccgagggcctgcagctgcaccccgtgggctgcggcaccgccttcgacttccacaaggagatcgactacatgttcctggtgggcaccgaggagggcaagatctacaagtgcagcaagagctacagcagccagttcctggacacctacgacgcccacaacatgagcgtggacaccgtgagctggaacccctaccacaccaaggtgttcatgagctgcagcagcgactggaccgtgaagatctgggaccacaccatcaagacccccatgttcatctacgacctgaacagcgccgtgggcgacgtggcctgggccccctacagcagcaccgtgttcgccgccgtgaccaccgacggcaaggagaagaagggccaggaggtgcagaagggccccgccgtggagatcgccaagctggacaagctgctgaacctggtgagagaggtgaagatcaagacctag

SEQ ID NO: 79862 - DNA, 870 bp, Artificial Sequence
  Description of Artificial Sequence: Synthetic coding sequence
atgatccccgccagcgccaaggccccccacaagcagccccacaagcaggacgaggacagcggcaccgaggtgggcgagggcaccgacgagtgggcccagagcaaggccaccgtgagaccccccgaccagctggagctgaccgacgccgagctgaaggaggagttcaccagaatcctgaccgccaacaacccccacgccccccagaacatcgtgagatacagcttcaaggagggcacctacaagcccatcggcttcgtgaaccagctggccgtgcactacacccaggtgggcaacctgatccccaaggacagcgacgagggcagaagacagcactacagagacgagctggtggccggcagccaggagagcgtgaaggtgatcagcgagaccggcaacctggaggaggacgaggagcccaaggagctggagaccgagcccggcagccagaccgacgtgcccgccgccggcgccgccgagaaggtgaccgaggaggagctgatgacccccaagcagcccaaggagagaaagctgaccaaccagttcaacttcagcgagagagccagccagacctacaacaaccccgtgagagacagagagtgccagaccgagcccccccccagaaccaacttcagcgccaccgccaaccagtgggagatctacgacgcctacgtggaggagctggagaagcaggagaagaccaaggagaaggagaaggccaagacccccgtggccaagaagagcggcaagatggccatgagaaagctgaccagcatggagagccagaccgacgacctgatcaagctgagccaggccgccaagatcatggagagaatggtgaaccagaacacctacgacgacatcgcccagtag

SEQ ID NO: 79863 - DNA, 870 bp, Artificial Sequence; identical to SEQ ID NO: 79862
  Description of Artificial Sequence: Synthetic coding sequence

SEQ ID NO: 79864 - DNA, 429 bp, Artificial Sequence
  Description of Artificial Sequence: Synthetic coding sequence
tgatgcggcaccgccttcgacttccacaaggagatcgactacatgttcctggtgggcaccgaggagggcaagatctacaagtgcagcaagagctacagcagccagttcctggacacctacgacgcccacaacatgagcgtggacaccgtgagctggaacccctaccacaccaaggtgttcatgagctgcagcagcgactggaccgtgaagatctgggaccacaccatcaagacccccatgttcatctacgacctgaacagcgccgtgggcgacgtggcctgggccccctacagcagcaccgtgttcgccgccgtgaccaccgacggcaaggagaagaagggccaggaggtgcagaagggccccgccgtggagatcgccaagctggacaagctgctgaacctggtgagagaggtgaagatcaagacctag

SEQ ID NO: 79865 - DNA, 507 bp, Artificial Sequence
  Description of Artificial Sequence: Synthetic coding sequence
atgatccccgccagcgccaaggccccccacaagcagccccacaagcagagcatcagcatcggcagaggcaccagaaagagagacgaggacagcggcaccgaggtgggcgagggcaccgacgagtgggcccagagcaaggccaccgtgagaccccccgaccagctggagctgaccgacgccgagctgaaggaggagttcaccagaatcctgaccgccaacaacccccacgccccccagaacatcgtgagatacagcttcaagaagcagtggagcctgggcttcatccccaagctgaagagaaagatccccgtgaactactggggccaggacgagggcgagatcagcaacgagaccgtgagagtgatctacagcctgggcatcttcatcatgaagatcgtgaccatcctgctgaacatcaacatcgagcacctgctgtgcgtgagacactgcgtgaacagactgttcctgctgttcctgatcctgatcatcatcatgcagatcagatag

SEQ ID NO: 79866 - DNA, 1209 bp, Artificial Sequence
  Description of Artificial Sequence: Synthetic coding sequence
atgagaaccaccctgacccccagctgcagcagcgccctggacccccaggagatcaagagagccgccacccacctgagctggcaccccgacggcaacagaaagctggccgtggcctacagctgcctggacttccagagagcccccgtgggcatgagcagcgacagctacatctgggacctggagaaccccaacaagcccgagctggccctgaagcccagcagccccctggtgaccctggagttcaaccccaaggacagccacgtgctgctgggcggctgctacaacggccagatcgcctgctgggacaccagaaagggcagcctggtggccgagctgagcaccatcgagagcagccacagagaccccgtgtacggcaccatctggctgcagagcaagaccggcaccgagtgcttcagcgccagcaccgacggccaggtgatgtggtgggacatcagaaagatgagcgagcccaccgaggtggtgatcctggacatcaccaagaaggagcagctggagaacgccctgggcgccatcagcctggagttcgagagcaccctgcccaccaagttcatggtgggcaccgagcagggcatcgtgatcagctgcaacagaaaggccaagaccagcgccgagaagatcgtgtgcaccttccccggccaccacggccccatctacgccctgcagagaaaccccttctaccccaagaacttcctgaccgtgggcgactggaccgccagaatctggagcgaggacagcagagagagcagcatcatgtggaccaagtaccacatggcctacctgaccgacgccgcctggagccccgtgagacccaccgtgttcttcaccaccagaatggacggcaccctggacatctgggacttcatgttcgagcagtgcgaccccaccctgagcctgaaggtgtgcgacgaggccctgttctgcctgagagtgcaggacaacggctgcctgatcgcctgcggcagccagctgggcaccaccaccctgctggaggtgagccccggcctgagcaccctgcagagaaacgagaagaacgtggccagcagcatgttcgagagagagaccagaagagagaagatcctggaggccagacacagagagatgagactgaaggagaaggccgccaccaagagcagaagaagacccggcggcggcggcggcagaggcagcagcggcggcagaagaggctag

SEQ ID NO: 79867 - DNA, 1818 bp, Artificial Sequence
  Description of Artificial Sequence: Synthetic coding sequence
atggagatcgtgtacgtgtacgtgaagaagagaagcgagttcggcaagcagtgcaacttcagcgacagacaggccgagctgaacatcgacatcatgcccaaccccgagctggccgagcagttcgtggagagaaaccccgtggacaccggcatccagtgcagcatcagcatgagcgagcacgaggccaacagcgagagattcgagatggagaccagaggcgtgaaccacgtggagggcggctggcccaaggacgtgaaccccctggagctggagcagaccatcagattcagaaagaaggtggagaaggacgagaactacgtgaacgccatcatgcagctgggcagcatcatggagcactgcatcaagcagaacaacgccatcgacatctacgaggagtacttcaacgacgaggaggccatggaggtgatggaggaggaccccagcgccaagaccatcaacgtgttcagagacccccaggagatcaagagagccgccacccacctgagctggcaccccgacggcaacagaaagctggccgtggcctacagctgcctggacttccagagagcccccgtgggcatgagcagcgacagctacatctgggacctggagaaccccaacaagcccgagctggccctgaagcccagcagccccctggtgaccctggagttcaaccccaaggacagccacgtgctgctgggcggctgctacaacggccagatcgcctgctgggacaccagaaagggcagcctggtggccgagctgagcaccatcgagagcagccacagagaccccgtgtacggcaccatctggctgcagagcaagaccggcaccgagtgcttcagcgccagcaccgacggccaggtgatgtggtgggacatcagaaagatgagcgagcccaccgaggtggtgatcctggacatcaccaagaaggagcagctggagaacgccctgggcgccatcagcctggagttcgagagcaccctgcccaccaagttcatggtgggcaccgagcagggcatcgtgatcagctgcaacagaaaggccaagaccagcgccgagaagatcgtgtgcaccttccccggccaccacggccccatctacgccctgcagagaaaccccttctaccccaagaacttcctgaccgtgggcgactggaccgccagaatctggagcgaggacagcagagagagcagcatcatgtggaccaagtaccacatggcctacctgaccgacgccgcctggagccccgtgagacccaccgtgttcttcaccaccagaatggacggcaccctggacatctgggacttcatgttcgagcagtgcgaccccaccctgagcctgaaggtgtgcgacgaggccctgttctgcctgagagtgcaggacaacggctgcctgatcgcctgcggcagccagctgggcaccaccaccctgctggaggtgagccccggcctgagcaccctgcagagaaacgagaagaacgtggccagcagcatgttcgagagagagaccagaagagagaagatcctggaggccagacacagagagatgagactgaaggagaagggcaaggccgagggcagagacgaggagcagaccgacgaggagctggccgtggacctggaggccctggtgagcaaggccgaggaggagttcttcgacatcatcttcgccgagctgaagaagaaggaggccgacgccatcaagctgacccccgtgccccagcagcccagccccgaggaggaccaggtggtggaggagggcgaggaggccgccggcgaggagggcgacgaggaggtggaggaggacctggcctag

SEQ ID NO: 79868 - DNA, 1818 bp, Artificial Sequence; identical to SEQ ID NO: 79867
  Description of Artificial Sequence: Synthetic coding sequence

SEQ ID NO: 79869 - DNA, 234 bp, Artificial Sequence
  Description of Artificial Sequence: Synthetic coding sequence
atgaagaagctgaagatcctgtacatgagcaacaacctggtgaaggactgggccgagttcgtgaagctggccgagctgccctgcctggaggacctggtgttcgtgggcaaccccctggaggagaagcacagcgccgagaacaactggatcgaggaggccaccaagagagtgcccaagctgaagaagctggacggcacccccgtgatcaagggcgacgaggaggaggacaactag

SEQ ID NO: 79870 - DNA, 456 bp, Artificial Sequence
  Description of Artificial Sequence: Synthetic coding sequence
atggacgccagcctgagcatgctggccaactgcgagaagctgagcctgagcaccaactgcatcgagaagatcgccaacctgaacggcctgaagaacctgagaatcctgagcctgggcagaaacaacatcaagaacctgaacggcctggaggccgtgggcgacaccctggaggagctgtggatcagctacaacttcatcgagaagctgaagggcatccacatcatgaagaagctgaagatcctgtacatgagcaacaacctggtgaaggactgggccgagttcgtgaagctggccgagctgccctgcctggaggacctggtgttcgtgggcaaccccctggaggagaagcacagcgccgagaacaactggatcgaggaggccaccaagagagtgcccaagctgaagaagctggacggcacccccgtgatcaagggcgacgaggaggaggacaactag

SEQ ID NO: 79871 - DNA, 573 bp, Artificial Sequence
  Description of Artificial Sequence: Synthetic coding sequence
atggccaaggccaccaccatcaaggaggccctggccagatgggaggagaagaccggccagagacccagcgaggccaaggagatcaagctgtacgcccagatcccccccatcgagaagatggacgccagcctgagcatgctggccaactgcgagaagctgagcctgagcaccaactgcatcgagaagatcgccaacctgaacggcctgaagaacctgagaatcctgagcctgggcagaaacaacatcaagaacctgaacggcctggaggccgtgggcgacaccctggaggagctgtggatcagctacaacttcatcgagaagctgaagggcatccacatcatgaagaagctgaagatcctgtacatgagcaacaacctggtgaaggactgggccgagttcgtgaagctggccgagctgccctgcctggaggacctggtgttcgtgggcaaccccctggaggagaagcacagcgccgagaacaactggatcgaggaggccaccaagagagtgcccaagctgaagaagctggacggcacccccgtgatcaagggcgacgaggaggaggacaactag

SEQ ID NO: 79872 - DNA, 174 bp, Artificial Sequence
  Description of Artificial Sequence: Synthetic coding sequence
atgaagaagctgaagatcctgtacatgagcaacaacctggtgaaggactgggccgagttcgtgaagctggccgagctgccctgcctggaggacctggtgttcgtgggcaaccccctggaggagaagcacagcgccgagaacaactggatcgaggaggccaccaagagagtgtag

SEQ ID NO: 79873 - DNA, 456 bp, Artificial Sequence; identical to SEQ ID NO: 79870
  Description of Artificial Sequence: Synthetic coding sequence

SEQ ID NO: 79874 - DNA, 195 bp, Artificial Sequence
  Description of Artificial Sequence: Synthetic coding sequence
atgaagaagctgaagatcctgtacatgagcaacaacctggtgaaggactgggccgagttcgtgaagctggccgagctgccctgcctggaggacctggtgttcgtgggcaaccccctggaggagaagcacagcgccgagaacaactggatcgaggaggccaccaagagagtgcccaagctgaagaagctggactag

SEQ ID NO: 79875 - DNA, 159 bp, Artificial Sequence
  Description of Artificial Sequence: Synthetic coding sequence
atggacgccagcctgagcatgctggccaactgcgagaagctgagcctgagcaccaactgcatcgagaagatcgccaacctgaacggcctgaagaacctgagaatcctgagcctgggcagaaacaacatcaagaacctgaacggcctggaggccgtgtag

SEQ ID NO: 79876 - DNA, 198 bp, Artificial Sequence
  Description of Artificial Sequence: Synthetic coding sequence
atgaagaagctgaagatcctgtacatgagcaacaacctggtgaaggactgggccgagttcgtgaagctggccgagctgccctgcctggaggacctggtgttcgtgggcaaccccctggaggagaagcacagcgccgagaacaactggatcgaggaggccaccaagagagtgcccaagctgaagaagctggacggctag

SEQ ID NO: 79877 - DNA, 843 bp, Artificial Sequence
  Description of Artificial Sequence: Synthetic coding sequence
atggtgaccgccaacaaggcccacaccggccagggcagctgctgggtggccaccctggccagcgccatgatcccccccgccgacagcctgctgaagtacgacacccccgtgctggtgagcagaaacaccgagaagagaagccccaaggccagactgctgaaggtgagcccccagcagcccggccccagcggcagcgccccccagccccccaagaccaagctgcccagcaccccctgcgtgcccgaccccaccaagcaggccgaggagatcctgaacgccatcctgccccccagagagtgggtggaggacacccagctgtggatccagcaggtgagcagcacccccagcaccagaatggacgtggtgcacctgcaggagcagctggacctgaagctgcagcagagacaggccagagagaccggcatctgccccgtgagaagagagctgtacagccagtgcttcgacgagctgatcagagaggtgaccatcaactgcgccgagagaggcctgctgctgctgagagtgagagacgagatcagaatgaccatcgccgcctaccagaccctgtacgagagcagcgtggccttcggcatgagaaaggccctgcaggccgagcagggcaagagcgacatggagagaaagatcgccgagctggagaccgagaagagagacctggagagacaggtgaacgagcagaaggccaagtgcgaggccaccgagaagagagagagcgagagaagacaggtggaggagaagaagcacaacgaggagatccagttcctgaagagaaccaaccagcagctgaaggcccagctggagggcatcatcgcccccaagaagtag

SEQ ID NO: 79878 - DNA, 399 bp, Artificial Sequence
  Description of Artificial Sequence: Synthetic coding sequence
atgccctactacccccaggacgagctgatcagagaggtgaccatcaactgcgccgagagaggcctgctgctgctgagagtgagagacgagatcagaatgaccatcgccgcctaccagaccctgtacgagagcagcgtggccttcggcatgagaaaggccctgcaggccgagcagggcaagagcgacatggagagaaagatcgccgagctggagaccgagaagagagacctggagagacaggtgaacgagcagaaggccaagtgcgaggccaccgagaagagagagagcgagagaagacaggtggaggagaagaagcacaacgaggagatccagttcctgaagagaaccaaccagcagctgaaggcccagctggagggcatcatcgcccccaagaagtag

SEQ ID NO: 79879 - DNA, 13941 bp, Artificial Sequence
  Description of Artificial Sequence: Synthetic coding sequence
atgagcgagcccggcggcggcggcggcgaggacggcagcgccggcctggaggtgagcgccgtgcagaacgtggccgacgtgagcgtgctgcagaagcacctgagaaagctggtgcccctgctgctggaggacggcggcgaggcccccgccgccctggaggccgccctggaggagaagagcgccctggagcagatgagaaagttcctgagcgacccccaggtgcacaccgtgctggtggagagaagcaccctgaaggaggacgtgggcgacgagggcgaggaggagaaggagttcatcagctacaacatcaacatcgacatccactacggcgtgaagagcaacagcctggccttcatcaagagaacccccgtgatcgacgccgacaagcccgtgagcagccagctgagagtgctgaccctgagcgaggacagcccctacgagaccctgcacagcttcatcagcaacgccgtggcccccttcttcaagagctacatcagagagagcggcaaggccgacagagacggcgacaagatggcccccagcgtggagaagaagatcgccgagctggagatgggcctgctgcacctgcagcagaacatcgagatccccgagatcagcctgcccatccaccccatgatcaccaacgtggccaagcagtgctacgagagaggcgagaagcccaaggtgaccgacttcggcgacaaggtggaggaccccaccttcctgaaccagctgcagagcggcgtgaacagatggatcagagagatccagaaggtgaccaagctggacagagaccccgccagcggcaccgccctgcaggagatcagcttctggctgaacctggagagagccctgtacagaatccaggagaagagagagagccccgaggtgctgctgaccctggacatcctgaagcacggcaagagattccacgccaccgtgagcttcgacaccgacaccggcctgaagcaggccctggagaccgtgaacgactacaaccccctgatgaaggacttccccctgaacgacctgctgagcgccaccgagctggacaagatcagacaggccctggtggccatcttcacccacctgagaaagatcagaaacaccaagtaccccatccagagagccctgagactggtggaggccatcagcagagacctgagcagccagctgctgaaggtgctgggcaccagaaagctgatgcacgtggcctacgaggagttcgagaaggtgatggtggcctgcttcgaggtgttccagacctgggacgacgagtacgagaagctgcaggtgctgctgagagacatcgtgaagagaaagagagaggagaacctgaagatggtgtggagaatcaaccccgcccacagaaagctgcaggccagactggaccagatgagaaagttcagaagacagcacgagcagctgagagccgtgatcgtgagagtgctgagaccccaggtgaccgccgtggcccagcagaaccagggcgaggtgcccgagccccaggacatgaaggtggccgaggtgctgttcgacgccgccgacgccaacgccatcgaggaggtgaacctggcctacgagaacgtgaaggaggtggacggcctggacgtgagcaaggagggcaccgaggcctgggaggccgccatgaagagatacgacgagagaatcgacagagtggagaccagaatcaccgccagactgagagaccagctgggcaccgccaagaacgccaacgagatgttcagaatcttcagcagattcaacgccctgttcgtgagaccccacatcagaggcgccatcagagagtaccagacccagctgatccagagagtgaaggacgacatcgagagcctgcacgacaagttcaaggtgcagtacccccagagccaggcctgcaagatgagccacgtgagagacctgccccccgtgagcggcagcatcatctgggccaagcagatcgacagacagctgaccgcctacatgaagagagtggaggacgtgctgggcaagggctgggagaaccacgtggagggccagaagctgaagcaggacggcgacagcttcagaatgaagctgaacacccaggagatcttcgacgactgggccagaaaggtgcagcagagaaacctgggcgtgagcggcagaatcttcaccatcgagagcaccagagtgagaggcagaaccggcaacgtgctgaagctgaaggtgaacttcctgcccgagatcatcaccctgagcaaggaggtgagaaacctgaagtggctgggcttcagagtgcccctggccatcgtgaacaaggcccaccaggccaaccagctgtaccccttcgccatcagcctgatcgagagcgtgagaacctacgagagaacctgcgagaaggtggaggagagaaacaccatcagcctgctggtggccggcctgaagaaggaggtgcaggccctgatcgccgagggcatcgccctggtgtgggagagctacaagctggacccctacgtgcagagactggccgagaccgtgttcaacttccaggagaaggtggacgacctgctgatcatcgaggagaagatcgacctggaggtgagaagcctggagacctgcatgtacgaccacaagaccttcagcgagatcctgaacagagtgcagaaggccgtggacgacctgaacctgcacagctacagcaacctgcccatctgggtgaacaagctggacatggagatcgagagaatcctgggcgtgagactgcaggccggcctgagagcctggacccaggtgctgctgggccaggccgaggacaaggccgaggtggacatggacaccgacgccccccaggtgagccacaagcccggcggcgagcccaagatcaagaacgtggtgcacgagctgagaatcaccaaccaggtgatctacctgaacccccccatcgaggagtgcagatacaagctgtaccaggagatgttcgcctggaagatggtggtgctgagcctgcccagaatccagagccagagataccaggtgggcgtgcactacgagctgaccgaggaggagaagttctacagaaacgccctgaccagaatgcccgacggccccgtggccctggaggagagctacagcgccgtgatgggcatcgtgagcgaggtggagcagtacgtgaaggtgtggctgcagtaccagtgcctgtgggacatgcaggccgagaacatctacaacagactgggcgaggacctgaacaagtggcaggccctgctggtgcagatcagaaaggccagaggcaccttcgacaacgccgagaccaagaaggagttcggccccgtggtgatcgactacggcaaggtgcagagcaaggtgaacctgaagtacgacagctggcacaaggaggtgctgagcaagttcggccagatgctgggcagcaacatgaccgagttccacagccagatcagcaagagcagacaggagctggagcagcacagcgtggacaccgccagcaccagcgacgccgtgaccttcatcacctacgtgcagagcctgaagagaaagatcaagcagttcgagaagcaggtggagctgtacagaaacggccagagactgctggagaagcagagattccagttcccccccagctggctgtacatcgacaacatcgagggcgagtggggcgccttcaacgacatcatgagaagaaaggacagcgccatccagcagcaggtggccaacctgcagatgaagatcgtgcaggaggacagagccgtggagagcagaaccaccgacctgctgaccgactgggagaagaccaagcccgtgaccggcaacctgagacccgaggaggccctgcaggccctgaccatctacgagggcaagttcggcagactgaaggacgacagagagaagtgcgccaaggccaaggaggccctggagctgaccgacaccggcctgctgagcggcagcgaggagagagtgcaggtggccctggaggagctgcaggacctgaagggcgtgtggagcgagctgagcaaggtgtgggagcagatcgaccagatgaaggagcagccctgggtgagcgtgcagcccagaaagctgagacagaacctggacgccctgctgaaccagctgaagagcttccccgccagactgagacagtacgccagctacgagttcgtgcagagactgctgaagggctacatgaagatcaacatgctggtgatcgagctgaagagcgaggccctgaaggacagacactggaagcagctgatgaagagactgcacgtgaactgggtggtgagcgagctgaccctgggccagatctgggacgtggacctgcagaagaacgaggccatcgtgaaggacgtgctgctggtggcccagggcgagatggccctggaggagttcctgaagcagatcagagaggtgtggaacacctacgagctggacctggtgaactaccagaacaagtgcagactgatcagaggctgggacgacctgttcaacaaggtgaaggagcacatcaacagcgtgagcgccatgaagctgagcccctactacaaggtgttcgaggaggacgccctgagctgggaggacaagctgaacagaatcatggccctgttcgacgtgtggatcgacgtgcagagaagatgggtgtacctggagggcatcttcaccggcagcgccgacatcaagcacctgctgcccgtggagacccagagattccagagcatcagcaccgagttcctggccctgatgaagaaggtgagcaagagccccctggtgatggacgtgctgaacatccagggcgtgcagagaagcctggagagactggccgacctgctgggcaagatccagaaggccctgggcgagtacctggagagagagagaagcagcttccccagattctacttcgtgggcgacgaggacctgctggagatcatcggcaacagcaagaacgtggccaagctgcagaagcacttcaagaagatgttcgccggcgtgagcagcatcatcctgaacgaggacaacagcgtggtgctgggcatcagcagcagagagggcgaggaggtgatgttcaagacccccgtgagcatcaccgagcaccccaagatcaacgagtggctgaccctggtggagaaggagatgagagtgaccctggccaagctgctggccgagagcgtgaccgaggtggagatcttcggcaaggccaccagcatcgaccccaacacctacatcacctggatcgacaagtaccaggcccagctggtggtgctgagcgcccagatcgcctggagcgagaacgtggagaccgccctgagcagcatgggcggcggcggcgacgccgcccccctgcacagcgtgctgagcaacgtggaggtgaccctgaacgtgctggccgacagcgtgctgatggagcagccccccctgagaagaagaaagctggagcacctgatcaccgagctggtgcaccagagagacgtgaccagaagcctgatcaagagcaagatcgacaacgccaagagcttcgagtggctgagccagatgagattctacttcgaccccaagcagaccgacgtgctgcagcagctgagcatccagatggccaacgccaagttcaactacggcttcgagtacctgggcgtgcaggacaagctggtgcagacccccctgaccgacagatgctacctgaccatgacccaggccctggaggccagactgggcggcagccccttcggccccgccggcaccggcaagaccgagagcgtgaaggccctgggccaccagctgggcagattcgtgctggtgttcaactgcgacgagaccttcgacttccaggccatgggcagaatcttcgtgggcctgtgccaggtgggcgcctggggctgcttcgacgagttcaacagactggaggagagaatgctgagcgccgtgagccagcaggtgcagtgcatccaggaggccctgagagagcacagcaaccccaactacgacaagaccagcgcccccatcacctgcgagctgctgaacaagcaggtgaaggtgagccccgacatggccatcttcatcaccatgaaccccggctacgccggcagaagcaacctgcccgacaacctgaagaagctgttcagaagcctggccatgaccaagcccgacagacagctgatcgcccaggtgatgctgtacagccagggcttcagaaccgccgaggtgctggccaacaagatcgtgcccttcttcaagctgtgcgacgagcagctgagcagccagagccactacgacttcggcctgagagccctgaagagcgtgctggtgagcgccggcaacgtgaagagagagagaatccagaagatcaagagagagaaggaggagagaggcgaggccgtggacgagggcgagatcgccgagaacctgcccgagcaggagatcctgatccagagcgtgtgcgagaccatggtgcccaagctggtggccgaggacatccccctgctgttcagcctgctgagcgacgtgttccccggcgtgcagtaccacagaggcgagatgaccgccctgagagaggagctgaagaaggtgtgccaggagatgtacctgacctacggcgacggcgaggaggtgggcggcatgtgggtggagaaggtgctgcagctgtaccagatcacccagatcaaccacggcctgatgatggtgggccccagcggcagcggcaagagcatggcctggagagtgctgctgaaggccctggagagactggagggcgtggagggcgtggcccacatcatcgaccccaaggccatcagcaaggaccacctgtacggcaccctggaccccaacaccagagagtggaccgacggcctgttcacccacgtgctgagaaagatcatcgacagcgtgagaggcgagctgcagaagagacagtggatcgtgttcgacggcgacgtggaccccgagtgggtggagaacctgaacagcgtgctggacgacaacaagctgctgaccctgcccaacggcgagagactgagcctgccccccaacgtgagaatcatgttcgaggtgcaggacctgaagtacgccaccctggccaccgtgagcagatgcggcatggtgtggttcagcgaggacgtgctgagcaccgacatgatcttcaacaacttcctggccagactgagaagcatccccctggacgagggcgaggacgaggcccagagaagaagaaagggcaaggaggacgagggcgaggaggccgccagccccatgctgcagatccagagagacgccgccaccatcatgcagccctacttcaccagcaacggcctggtgaccaaggccctggagcacgccttccagctggagcacatcatggacctgaccagactgagatgcctgggcagcctgttcagcatgctgcaccaggcctgcagaaacgtggcccagtacaacgccaaccaccccgacttccccatgcagatcgagcagctggagagatacatccagagatacctggtgtacgccatcctgtggagcctgagcggcgacagcagactgaagatgagagccgagctgggcgagtacatcagaagaatcaccaccgtgcccctgcccaccgcccccaacatccccatcatcgactacgaggtgagcatcagcggcgagtggagcccctggcaggccaaggtgccccagatcgaggtggagacccacaaggtggccgcccccgacgtggtggtgcccaccctggacaccgtgagacacgaggccctgctgtacacctggctggccgagcacaagcccctggtgctgtgcggcccccccggcagcggcaagaccatgaccctgttcagcgccctgagagccctgcccgacatggaggtggtgggcctgaacttcagcagcgccaccacccccgagctgctgctgaagaccttcgaccactactgcgagtacagaagaacccccaacggcgtggtgctggcccccgtgcagctgggcaagtggctggtgctgttctgcgacgagatcaacctgcccgacatggacaagtacggcacccagagagtgatcagcttcatcagacagatggtggagcacggcggcttctacagaaccagcgaccagacctgggtgaagctggagagaatccagttcgtgggcgcctgcaacccccccaccgaccccggcagaaagcccctgagccacagattcctgagacacgtgcccgtggtgtacgtggactaccccggccccgccagcctgacccagatctacggcaccttcaacagagccatgctgagactgatccccagcctgagaacctacgccgagcccctgaccgccgccatggtggagttctacaccatgagccaggagagattcacccaggacacccagccccactacatctacagccccagagagatgaccagatgggtgagaggcatcttcgaggccctgagacccctggagaccctgcccgtggagggcctgatcagaatctgggcccacgaggccctgagactgttccaggacagactggtggaggacgaggagagaagatggaccgacgagaacatcgacaccgtggccctgaagcacttccccaacatcgacagagagaaggccatgagcagacccatcctgtacagcaactggctgagcaaggactacatccccgtggaccaggaggagctgagagactacgtgaaggccagactgaaggtgttctacgaggaggagctggacgtgcccctggtgctgttcaacgaggtgctggaccacgtgctgagaatcgacagaatcttcagacagccccagggccacctgctgctgatcggcgtgagcggcgccggcaagaccaccctgagcagattcgtggcctggatgaacggcctgagcgtgtaccagatcaaggtgcacagaaagtacaccggcgaggacttcgacgaggacctgagaaccgtgctgagaagaagcggctgcaagaacgagaagatcgccttcatcatggacgagagcaacgtgctggacagcggcttcctggagagaatgaacaccctgctggccaacggcgaggtgcccggcctgttcgagggcgacgagtacgccaccctgatgacccagtgcaaggagggcgcccagaaggagggcctgatgctggacagccacgaggagctgtacaagtggttcaccagccaggtgatcagaaacctgcacgtggtgttcaccatgaaccccagcagcgagggcctgaaggacagagccgccaccagccccgccctgttcaacagatgcgtgctgaactggttcggcgactggagcaccgaggccctgtaccaggtgggcaaggagttcaccagcaagatggacctggagaagcccaactacatcgtgcccgactacatgcccgtggtgtacgacaagctgccccagccccccagccacagagaggccatcgtgaacagctgcgtgttcgtgcaccagaccctgcaccaggccaacgccagactggccaagagaggcggcagaaccatggccatcacccccagacactacctggacttcatcaaccactacgccaacctgttccacgagaagagaagcgagctggaggagcagcagatgcacctgaacgtgggcctgagaaagatcaaggagaccgtggaccaggtggaggagctgagaagagacctgagaatcaagagccaggagctggaggtgaagaacgccgccgccaacgacaagctgaagaagatggtgaaggaccagcaggaggccgagaagaagaaggtgatgagccaggagatccaggagcagctgcacaagcagcaggaggtgatcgccgacaagcagatgagcgtgaaggaggacctggacaaggtggagcccgccgtgatcgaggcccagaacgccgtgaagagcatcaagaagcagcacctggtggaggtgagaagcatggccaacccccccgccgccgtgaagctggccctggagagcatctgcctgctgctgggcgagagcaccaccgactggaagcagatcagaagcatcatcatgagagagaacttcatccccaccatcgtgaacttcagcgccgaggagatcagcgacgccatcagagagaagatgaagaagaactacatgagcaaccccagctacaactacgagatcgtgaacagagccagcctggcctgcggccccatggtgaagtgggccatcgcccagctgaactacgccgacatgctgaagagagtggagcccctgagaaacgagctgcagaagctggaggacgacgccaaggacaaccagcagaaggccaacgaggtggagcagatgatcagagacctggaggccagcatcgccagatacaaggaggagtacgccgtgctgatcagcgaggcccaggccatcaaggccgacctggccgccgtggaggccaaggtgaacagaagcaccgccctgctgaagagcctgagcgccgagagagagagatgggagaagaccagcgagaccttcaagaaccagatgagcaccatcgccggcgactgcctgctgagcgccgccttcatcgcctacgccggctacttcgaccagcagatgagacagaacctgttcaccacctggagccaccacctgcagcaggccaacatccagttcagaaccgacatcgccagaaccgagtacctgagcaacgccgacgagagactgagatggcaggccagcagcctgcccgccgacgacctgtgcaccgagaacgccatcatgctgaagagattcaacagataccccctgatcatcgaccccagcggccaggccaccgagttcatcatgaacgagtacaaggacagaaagatcaccagaaccagcttcctggacgacgccttcagaaagaacctggagagcgccctgagattcggcaaccccctgctggtgcaggacgtggagagctacgaccccgtgctgaaccccgtgctgaacagagaggtgagaagaaccggcggcagagtgctgatcaccctgggcgaccaggacatcgacctgagccccagcttcgtgatcttcctgagcaccagagaccccaccgtggagttcccccccgacctgtgcagcagagtgaccttcgtgaacttcaccgtgaccagaagcagcctgcagagccagtgcctgaacgaggtgctgaaggccgagagacccgacgtggacgagaagagaagcgacctgctgaagctgcagggcgagttccagctgagactgagacagctggagaagagcctgctgcaggccctgaacgaggtgaagggcagaatcctggacgacgacaccatcatcaccaccctggagaacctgaagagagaggccgccgaggtgaccagaaaggtggaggagaccgacatcgtgatgcaggaggtggagaccgtgagccagcagtacctgcccctgagcaccgcctgcagcagcatctacttcaccatggagagcctgaagcagatccacttcctgtaccagtacagcctgcagttcttcctggacatctaccacaacgtgctgtacgagaaccccaacctgaagggcgtgaccgaccacacccagagactgagcatcatcaccaaggacctgttccaggtggccttcaacagagtggccagaggcatgctgcaccaggaccacatcaccttcgccatgctgctggccagaatcaagctgaagggcaccgtgggcgagcccacctacgacgccgagttccagcacttcctgagaggcaacgagatcgtgctgagcgccggcagcacccccagaatccagggcctgaccgtggagcaggccgaggccgtggtgagactgagctgcctgcccgccttcaaggacctgatcgccaaggtgcaggccgacgagcagttcggcatctggctggacagcagcagccccgagcagaccgtgccctacctgtggagcgaggagacccccgccacccccatcggccaggccatccacagactgctgctgatccaggccttcagacccgacagactgctggccatggcccacatgttcgtgagcaccaacctgggcgagagcttcatgagcatcatggagcagcccctggacctgacccacatcgtgggcaccgaggtgaagcccaacacccccgtgctgatgtgcagcgtgcccggctacgacgccagcggccacgtggaggacctggccgccgagcagaacacccagatcaccagcatcgccatcggcagcgccgagggcttcaaccaggccgacaaggccatcaacaccgccgtgaagagcggcagatgggtgatgctgaagaacgtgcacctggcccccggctggctgatgcagctggagaagaagctgcacagcctgcagccccacgcctgcttcagactgttcctgaccatggagatcaaccccaaggtgcccgtgaacctgctgagagccggcagaatcttcgtgttcgagcccccccccggcgtgaaggccaacatgctgagaaccttcagcagcatccccgtgagcagaatctgcaagagccccaacgagagagccagactgtacttcctgctggcctggttccacgccatcatccaggagagactgagatacgcccccctgggctggagcaagaagtacgagttcggcgagagcgacctgagaagcgcctgcgacaccgtggacacctggctggacgacaccgccaagggcagacagaacatcagccccgacaagatcccctggagcgccctgaagaccctgatggcccagagcatctacggcggcagagtggacaacgagttcgaccagagactgctgaacaccttcctggagagactgttcaccaccagaagcttcgacagcgagttcaagctggcctgcaaggtggacggccacaaggacatccagatgcccgacggcatcagaagagaggagttcgtgcagtgggtggagctgctgcccgacacccagacccccagctggctgggcctgcccaacaacgccgagagagtgctgctgaccacccagggcgtggacatgatcagcaagatgctgaagatgcagatgctggaggacgaggacgacctggcctacgccgagaccgagaagaagaccagaaccgacagcaccagcgacggcagacccgcctggatgagaaccctgcacaccaccgccagcaactggctgcacctgatcccccagaccctgagccacctgaagagaaccgtggagaacatcaaggaccccctgttcagattcttcgagagagaggtgaagatgggcgccaagctgctgcaggacgtgagacaggacctggccgacgtggtgcaggtgtgcgagggcaagaagaagcagaccaactacctgagaaccctgatcaacgagctggtgaagggcatcctgcccagaagctggagccactacaccgtgcccgccggcatgaccgtgatccagtgggtgagcgacttcagcgagagaatcaagcagctgcagaacatcagcctggccgccgccagcggcggcgccaaggagctgaagaacatccacgtgtgcctgggcggcctgttcgtgcccgaggcctacatcaccgccaccagacagtacgtggcccaggccaacagctggagcctggaggagctgtgcctggaggtgaacgtgaccaccagccagggcgccaccctggacgcctgcagcttcggcgtgaccggcctgaagctgcagggcgccacctgcaacaacaacaagctgagcctgagcaacgccatcagcaccgccctgcccctgacccagctgagatgggtgaagcagaccaacaccgagaagaaggccagcgtggtgaccctgcccgtgtacctgaacttcaccagagccgacctgatcttcaccgtggacttcgagatcgccaccaaggaggaccccagaagcttctacgagagaggcgtggccgtgctgtgcaccgagtag

SEQ ID NO: 79880 - DNA, 1899 bp, Artificial Sequence
  Description of Artificial Sequence: Synthetic coding sequence
atgagcgacaagagcgagctgaaggccgagctggagagaaagaagcagagactggcccagatcagagaggagaagaagagaaaggaggaggagagaaagaagaaggagaccgaccagaagaaggaggccgtggcccccgtgcaggaggagagcgacctggagaagaagagaagagaggccgaggccctgctgcagagcatgggcctgacccccgagagccccatcgtgcccccccccatgagccccagcagcaagagcgtgagcacccccagcgaggccggcagccaggacagcggcgacggcgccgtgggcagcagaaccctgcactgggacaccgaccccagcgtgctgcagctgcacagcgacagcgacctgggcagaggccccatcaagctgggcatggccaagatcacccaggtggacttcccccccagagagatcgtgacctacaccaaggagacccagacccccgtgatggcccagcccaaggaggacgaggaggaggacgacgacgtggtggcccccaagccccccatcgagcccgaggaggagaagaccctgaagaaggacgaggagaacgacagcaaggcccccccccacgagctgaccgaggaggagaagcagcagatcctgcacagcgaggagttcctgagcttcttcgaccacagcaccagaatcgtggagagagccctgagcgagcagatcaacatcttcttcgactacagcggcagagacctggaggacaaggagggcgagatccaggccggcgccaagctgagcctgaacagacagttcttcgacgagagatggagcaagcacagagtggtgagctgcctggactggagcagccagtaccccgagctgctggtggccagctacaacaacaacgaggacgccccccacgagcccgacggcgtggccctggtgtggaacatgaagtacaagaagaccacccccgagtacgtgttccactgccagagcgccgtgatgagcgccaccttcgccaagttccaccccaacctggtggtgggcggcacctacagcggccagatcgtgctgtgggacaacagaagcaacaagagaacccccgtgcagagaacccccctgagcgccgccgcccacacccaccccgtgtactgcgtgaacgtggtgggcacccagaacgcccacaacctgatcagcatcagcaccgacggcaagatctgcagctggagcctggacatgctgagccacccccaggacagcatggagctggtgcacaagcagagcaaggccgtggccgtgaccagcatgagcttccccgtgggcgacgtgaacaacttcgtggtgggcagcgaggagggcagcgtgtacaccgcctgcagacacggcagcaaggccggcatcagcgagatgttcgagggccaccagggccccatcaccggcatccactgccacgccgccgtgggcgccgtggacttcagccacctgttcgtgaccagcagcttcgactggaccgtgaagctgtggaccaccaagaacaacaagcccctgtacagcttcgaggacaacgccgactacgtgtacgacgtgatgtggagccccacccaccccgccctgttcgcctgcgtggacggcatgggcagactggacctgtggaacctgaacaacgacaccgaggtgcccaccgccagcatcagcgtggagggcaaccccgccctgaacagagtgagatggacccacagcggcagagagatcgccgtgggcgacagcgagggccagatcgtgatctacgacgtgggcgagcagatcgccgtgcccagaaacgacgagtgggccagattcggcagaaccctggccgagatcaacgccaacagagccgacgccgaggaggaggccgccaccagaatccccgcctag

SEQ ID NO: 79881 - DNA, 1839 bp, Artificial Sequence
  Description of Artificial Sequence: Synthetic coding sequence
atgagcgacaagagcgagctgaaggccgagctggagagaaagaagcagagactggcccagatcagagaggagaagaagagaaaggaggaggagagaaagaagaaggagaccgaccagaagaaggaggccgtggcccccgtgcaggaggagagcgacctggagaagaagagaagagaggccgaggccctgctgcagagcatgggcctgacccccgagagccccatcgtgcccccccccatgagccccagcagcaagagcgtgagcacccccagcgaggccggcagccaggacagcggcgacggcgccgtgggcagcagaagaggccccatcaagctgggcatggccaagatcacccaggtggacttcccccccagagagatcgtgacctacaccaaggagacccagacccccgtgatggcccagcccaaggaggacgaggaggaggacgacgacgtggtggcccccaagccccccatcgagcccgaggaggagaagaccctgaagaaggacgaggagaacgacagcaaggcccccccccacgagctgaccgaggaggagaagcagcagatcctgcacagcgaggagttcctgagcttcttcgaccacagcaccagaatcgtggagagagccctgagcgagcagatcaacatcttcttcgactacagcggcagagacctggaggacaaggagggcgagatccaggccggcgccaagctgagcctgaacagacagttcttcgacgagagatggagcaagcacagagtggtgagctgcctggactggagcagccagtaccccgagctgctggtggccagctacaacaacaacgaggacgccccccacgagcccgacggcgtggccctggtgtggaacatgaagtacaagaagaccacccccgagtacgtgttccactgccagagcgccgtgatgagcgccaccttcgccaagttccaccccaacctggtggtgggcggcacctacagcggccagatcgtgctgtgggacaacagaagcaacaagagaacccccgtgcagagaacccccctgagcgccgccgcccacacccaccccgtgtactgcgtgaacgtggtgggcacccagaacgcccacaacctgatcagcatcagcaccgacggcaagatctgcagctggagcctggacatgctgagccacccccaggacagcatggagctggtgcacaagcagagcaaggccgtggccgtgaccagcatgagcttccccgtgggcgacgtgaacaacttcgtggtgggcagcgaggagggcagcgtgtacaccgcctgcagacacggcagcaaggccggcatcagcgagatgttcgagggccaccagggccccatcaccggcatccactgccacgccgccgtgggcgccgtggacttcagccacctgttcgtgaccagcagcttcgactggaccgtgaagctgtggaccaccaagaacaacaagcccctgtacagcttcgaggacaacgccgactacgtgtacgacgtgatgtggagccccacccaccccgccctgttcgcctgcgtggacggcatgggcagactggacctgtggaacctgaacaacgacaccgaggtgcccaccgccagcatcagcgtggagggcaaccccgccctgaacagagtgagatggacccacagcggcagagagatcgccgtgggcgacagcgagggccagatcgtgatctacgacgtgggcgagcagatcgccgtgcccagaaacgacgagtgggccagattcggcagaaccctggccgagatcaacgccaacagagccgacgccgaggaggaggccgccaccagaatccccgcctag

SEQ ID NO: 79882 - DNA, 1893 bp, Artificial Sequence
  Description of Artificial Sequence: Synthetic coding sequence
atgagcgacaagagcgagctgaaggccgagctggagagaaagaagcagagactggcccagatcagagaggagaagaagagaaaggaggaggagagaaagaagaaggagaccgaccagaagaaggaggccgtggcccccgtgcaggaggagagcgacctggagaagaagagaagagaggccgaggccctgctgcagagcatgggcctgacccccgagagccccatcgccgagcagcccctgagagtggtgaccgccgacacctgcctgttccactacctggtgcccccccccatgagccccagcagcaagagcgtgagcacccccagcgaggccggcagccaggacagcggcgacggcgccgtgggcagcagaagaggccccatcaagctgggcatggccaagatcacccaggtggacttcccccccagagagatcgtgacctacaccaaggagacccagacccccgtgatggcccagcccaaggaggacgaggaggaggacgacgacgtggtggcccccaagccccccatcgagcccgaggaggagaagaccctgaagaaggacgaggagaacgacagcaaggcccccccccacgagctgaccgaggaggagaagcagcagatcctgcacagcgaggagttcctgagcttcttcgaccacagcaccagaatcgtggagagagccctgagcgagcagatcaacatcttcttcgactacagcggcagagacctggaggacaaggagggcgagatccaggccggcgccaagctgagcctgaacagacagttcttcgacgagagatggagcaagcacagagtggtgagctgcctggactggagcagccagtaccccgagctgctggtggccagctacaacaacaacgaggacgccccccacgagcccgacggcgtggccctggtgtggaacatgaagtacaagaagaccacccccgagtacgtgttccactgccagagcgccgtgatgagcgccaccttcgccaagttccaccccaacctggtggtgggcggcacctacagcggccagatcgtgctgtgggacaacagaagcaacaagagaacccccgtgcagagaacccccctgagcgccgccgcccacacccaccccgtgtactgcgtgaacgtggtgggcacccagaacgcccacaacctgatcagcatcagcaccgacggcaagatctgcagctggagcctggacatgctgagccacccccaggacagcatggagctggtgcacaagcagagcaaggccgtggccgtgaccagcatgagcttccccgtgggcgacgtgaacaacttcgtggtgggcagcgaggagggcagcgtgtacaccgcctgcagacacggcagcaaggccggcatcagcgagatgttcgagggccaccagggccccatcaccggcatccactgccacgccgccgtgggcgccgtggacttcagccacctgttcgtgaccagcagcttcgactggaccgtgaagctgtggaccaccaagaacaacaagcccctgtacagcttcgaggacaacgccgactacgtgtacgacgtgatgtggagccccacccaccccgccctgttcgcctgcgtggacggcatgggcagactggacctgtggaacctgaacaacgacaccgaggtgcccaccgccagcatcagcgtggagggcaaccccgccctgaacagagtgagatggacccacagcggcagagagatcgccgtgggcgacagcgagggccagatcgtgatctacgacgtgggcgagcagatcgccgtgcccagaaacgacgagtgggccagattcggcagaaccctggccgagatcaacgccaacagagccgacgccgaggaggaggccgccaccagaatccccgcctag

SEQ ID NO: 79883 - DNA, 1917 bp, Artificial Sequence
  Description of Artificial Sequence: Synthetic coding sequence
atgagcgacaagagcgagctgaaggccgagctggagagaaagaagcagagactggcccagatcagagaggagaagaagagaaaggaggaggagagaaagaagaaggagaccgaccagaagaaggaggccgtggcccccgtgcaggaggagagcgacctggagaagaagagaagagaggccgaggccctgctgcagagcatgggcctgacccccgagagccccatcgtgttcagcgagtactgggtgcccccccccatgagccccagcagcaagagcgtgagcacccccagcgaggccggcagccaggacagcggcgacggcgccgtgggcagcagaaccctgcactgggacaccgaccccagcgtgctgcagctgcacagcgacagcgacctgggcagaggccccatcaagctgggcatggccaagatcacccaggtggacttcccccccagagagatcgtgacctacaccaaggagacccagacccccgtgatggcccagcccaaggaggacgaggaggaggacgacgacgtggtggcccccaagccccccatcgagcccgaggaggagaagaccctgaagaaggacgaggagaacgacagcaaggcccccccccacgagctgaccgaggaggagaagcagcagatcctgcacagcgaggagttcctgagcttcttcgaccacagcaccagaatcgtggagagagccctgagcgagcagatcaacatcttcttcgactacagcggcagagacctggaggacaaggagggcgagatccaggccggcgccaagctgagcctgaacagacagttcttcgacgagagatggagcaagcacagagtggtgagctgcctggactggagcagccagtaccccgagctgctggtggccagctacaacaacaacgaggacgccccccacgagcccgacggcgtggccctggtgtggaacatgaagtacaagaagaccacccccgagtacgtgttccactgccagagcgccgtgatgagcgccaccttcgccaagttccaccccaacctggtggtgggcggcacctacagcggccagatcgtgctgtgggacaacagaagcaacaagagaacccccgtgcagagaacccccctgagcgccgccgcccacacccaccccgtgtactgcgtgaacgtggtgggcacccagaacgcccacaacctgatcagcatcagcaccgacggcaagatctgcagctggagcctggacatgctgagccacccccaggacagcatggagctggtgcacaagcagagcaaggccgtggccgtgaccagcatgagcttccccgtgggcgacgtgaacaacttcgtggtgggcagcgaggagggcagcgtgtacaccgcctgcagacacggcagcaaggccggcatcagcgagatgttcgagggccaccagggccccatcaccggcatccactgccacgccgccgtgggcgccgtggacttcagccacctgttcgtgaccagcagcttcgactggaccgtgaagctgtggaccaccaagaacaacaagcccctgtacagcttcgaggacaacgccgactacgtgtacgacgtgatgtggagccccacccaccccgccctgttcgcctgcgtggacggcatgggcagactggacctgtggaacctgaacaacgacaccgaggtgcccaccgccagcatcagcgtggagggcaaccccgccctgaacagagtgagatggacccacagcggcagagagatcgccgtgggcgacagcgagggccagatcgtgatctacgacgtgggcgagcagatcgccgtgcccagaaacgacgagtgggccagattcggcagaaccctggccgagatcaacgccaacagagccgacgccgaggaggaggccgccaccagaatccccgcctag

SEQ ID NO: 79884 - DNA, 1839 bp, Artificial Sequence; identical to SEQ ID NO: 79881
  Description of Artificial Sequence: Synthetic coding sequence

SEQ ID NO: 79885 - DNA, 1899 bp, Artificial Sequence; identical to SEQ ID NO: 79880
  Description of Artificial Sequence: Synthetic coding sequence

SEQ ID NO: 79886 - DNA, 1914 bp, Artificial Sequence
  Description of Artificial Sequence: Synthetic coding sequence
atgagcgacaagagcgagctgaaggccgagctggagagaaagaagcagagactggcccagatcagagaggagaagaagagaaaggaggaggagagaaagaagaaggagaccgaccagaagaaggaggccgtggcccccgtgcaggaggagagcgacctggagaagaagagaagagaggccgaggccctgctgcagagcatgggcctgacccccgagagccccatcgtgttcagcgagtactgggtgcccccccccatgagccccagcagcaagagcgtgagcacccccagcgaggccggcagccaggacagcggcgacggcgccgtgggcagcagaaccctgcactgggacaccgaccccagcgtgctgcagctgcacagcgacagcgacctgggcagaggccccatcaagctgggcatggccaagatcacccaggtggacttcccccccagagagatcgtgacctacaccaaggagacccagacccccgtgatggcccagcccaaggaggacgaggaggaggacgacgacgtggtggcccccaagccccccatcgagcccgaggaggagaagaccctgaagaaggacgaggagaacgacagcaaggcccccccccacgagctgaccgaggaggagaagcagcagatcctgcacagcgaggagttcctgagcttcttcgaccacagcaccagaatcgtggagagagccctgagcgagcagatcaacatcttcttcgactacagcggcagagacctggaggacaaggagggcgagatccaggccggcgccaagctgagcctgaacagacagttcttcgacgagagatggagcaagcacagagtggtgagctgcctggactggagcagccagtaccccgagctgctggtggccagctacaacaacaacgaggacgccccccacgagcccgacggcgtggccctggtgtggaacatgaagtacaagaagaccacccccgagtacgtgttccactgccagagcgccgtgatgagcgccaccttcgccaagttccaccccaacctggtggtgggcggcacctacagcggccagatcgtgctgtgggacaacagaagcaacaagagaacccccgtgcagagaacccccctgagcgccgccgcccacacccaccccgtgtactgcgtgaacgtggtgggcacccagaacgcccacaacctgatcagcatcagcaccgacggcaagatctgcagctggagcctggacatgctgagccacccccaggacagcatggagctggtgcacaagcagagcaaggccgtggccgtgaccagcatgagcttccccgtgggcgacgtgaacaacttcgtggtgggcagcgaggagggcagcgtgtacaccgcctgcagacacggcagcaaggccggcatcagcgagatgttcgagggccaccagggccccatcaccggcatccactgccacgccgccgtgggcgccgtggacttcagccacctgttcgtgaccagcagcttcgactggaccgtgaagctgtggaccaccaagaacaacaagcccctgtacagcttcgaggacaacgccgactacgtgtacgacgtgatgtggagccccacccaccccgccctgttcgcctgcgtggacggcatgggcagactggacctgtggaacctgaacaacgacaccgaggtgcccaccgccagcatcagcgtggagggcaaccccgccctgaacagagtgagatggacccacagcggcagagagatcgccgtgggcgacagcgagggccagatcgtgatctacgacgtgggcgagatcgccgtgcccagaaacgacgagtgggccagattcggcagaaccctggccgagatcaacgccaacagagccgacgccgaggaggaggccgccaccagaatccccgcctag

SEQ ID NO: 79887 - DNA, 1917 bp, Artificial Sequence; identical to SEQ ID NO: 79883
  Description of Artificial Sequence: Synthetic coding sequence

SEQ ID NO: 79888 - DNA, 1836 bp, Artificial Sequence
  Description of Artificial Sequence: Synthetic coding sequence
atgagcgacaagagcgagctgaaggccgagctggagagaaagaagcagagactggcccagatcagagaggagaagaagagaaaggaggaggagagaaagaagaaggagaccgaccagaagaaggaggccgtggcccccgtgcaggaggagagcgacctggagaagaagagaagagaggccgaggccctgctgcagagcatgggcctgacccccgagagccccatcgtgcccccccccatgagccccagcagcaagagcgtgagcacccccagcgaggccggcagccaggacagcggcgacggcgccgtgggcagcagaagaggccccatcaagctgggcatggccaagatcacccaggtggacttcccccccagagagatcgtgacctacaccaaggagacccagacccccgtgatggcccagcccaaggaggacgaggaggaggacgacgacgtggtggcccccaagccccccatcgagcccgaggaggagaagaccctgaagaaggacgaggagaacgacagcaaggcccccccccacgagctgaccgaggaggagaagcagcagatcctgcacagcgaggagttcctgagcttcttcgaccacagcaccagaatcgtggagagagccctgagcgagcagatcaacatcttcttcgactacagcggcagagacctggaggacaaggagggcgagatccaggccggcgccaagctgagcctgaacagacagttcttcgacgagagatggagcaagcacagagtggtgagctgcctggactggagcagccagtaccccgagctgctggtggccagctacaacaacaacgaggacgccccccacgagcccgacggcgtggccctggtgtggaacatgaagtacaagaagaccacccccgagtacgtgttccactgccagagcgccgtgatgagcgccaccttcgccaagttccaccccaacctggtggtgggcggcacctacagcggccagatcgtgctgtgggacaacagaagcaacaagagaacccccgtgcagagaacccccctgagcgccgccgcccacacccaccccgtgtactgcgtgaacgtggtgggcacccagaacgcccacaacctgatcagcatcagcaccgacggcaagatctgcagctggagcctggacatgctgagccacccccaggacagcatggagctggtgcacaagcagagcaaggccgtggccgtgaccagcatgagcttccccgtgggcgacgtgaacaacttcgtggtgggcagcgaggagggcagcgtgtacaccgcctgcagacacggcagcaaggccggcatcagcgagatgttcgagggccaccagggccccatcaccggcatccactgccacgccgccgtgggcgccgtggacttcagccacctgttcgtgaccagcagcttcgactggaccgtgaagctgtggaccaccaagaacaacaagcccctgtacagcttcgaggacaacgccgactacgtgtacgacgtgatgtggagccccacccaccccgccctgttcgcctgcgtggacggcatgggcagactggacctgtggaacctgaacaacgacaccgaggtgcccaccgccagcatcagcgtggagggcaaccccgccctgaacagagtgagatggacccacagcggcagagagatcgccgtgggcgacagcgagggccagatcgtgatctacgacgtgggcgagatcgccgtgcccagaaacgacgagtgggccagattcggcagaaccctggccgagatcaacgccaacagagccgacgccgaggaggaggccgccaccagaatccccgcctag

SEQ ID NO: 79889 - DNA, 1917 bp, Artificial Sequence
  Description of Artificial Sequence: Synthetic coding sequence
atgagcgacaagagcgagctgaaggccgagctggagagaaagaagcagagactggcccagatcagagaggagaagaagagaaaggaggaggagagaaagaagaaggagaccgaccagaagaaggaggccgtggcccccgtgcaggaggagagcgacctggagaagaagagaagagaggccgaggccctgctgcagagcatgggcctgacccccgagagccccatcgacatcgccgagtacctggtgcccccccccatgagccccagcagcaagagcgtgagcacccccagcgaggccggcagccaggacagcggcgacggcgccgtgggcagcagaaccctgcactgggacaccgaccccagcgtgctgcagctgcacagcgacagcgacctgggcagaggccccatcaagctgggcatggccaagatcacccaggtggacttcccccccagagagatcgtgacctacaccaaggagacccagacccccgtgatggcccagcccaaggaggacgaggaggaggacgacgacgtggtggcccccaagccccccatcgagcccgaggaggagaagaccctgaagaaggacgaggagaacgacagcaaggcccccccccacgagctgaccgaggaggagaagcagcagatcctgcacagcgaggagttcctgagcttcttcgaccacagcaccagaatcgtggagagagccctgagcgagcagatcaacatcttcttcgactacagcggcagagacctggaggacaaggagggcgagatccaggccggcgccaagctgagcctgaacagacagttcttcgacgagagatggagcaagcacagagtggtgagctgcctggactggagcagccagtaccccgagctgctggtggccagctacaacaacaacgaggacgccccccacgagcccgacggcgtggccctggtgtggaacatgaagtacaagaagaccacccccgagtacgtgttccactgccagagcgccgtgatgagcgccaccttcgccaagttccaccccaacctggtggtgggcggcacctacagcggccagatcgtgctgtgggacaacagaagcaacaagagaacccccgtgcagagaacccccctgagcgccgccgcccacacccaccccgtgtactgcgtgaacgtggtgggcacccagaacgcccacaacctgatcagcatcagcaccgacggcaagatctgcagctggagcctggacatgctgagccacccccaggacagcatggagctggtgcacaagcagagcaaggccgtggccgtgaccagcatgagcttccccgtgggcgacgtgaacaacttcgtggtgggcagcgaggagggcagcgtgtacaccgcctgcagacacggcagcaaggccggcatcagcgagatgttcgagggccaccagggccccatcaccggcatccactgccacgccgccgtgggcgccgtggacttcagccacctgttcgtgaccagcagcttcgactggaccgtgaagctgtggaccaccaagaacaacaagcccctgtacagcttcgaggacaacgccgactacgtgtacgacgtgatgtggagccccacccaccccgccctgttcgcctgcgtggacggcatgggcagactggacctgtggaacctgaacaacgacaccgaggtgcccaccgccagcatcagcgtggagggcaaccccgccctgaacagagtgagatggacccacagcggcagagagatcgccgtgggcgacagcgagggccagatcgtgatctacgacgtgggcgagcagatcgccgtgcccagaaacgacgagtgggccagattcggcagaaccctggccgagatcaacgccaacagagccgacgccgaggaggaggccgccaccagaatccccgcctag

SEQ ID NO: 79890 - DNA, 2763 bp, Artificial Sequence
  Description of Artificial Sequence: Synthetic coding sequence
atggccaacggcaccgccgacgtgagaaagctgttcatcttcaccaccacccagaactacttcggcctgatgagcgagctgtgggaccagcccctgctgtgcaactgcctggagatcaacaacttcctggacgacggcaaccagatgctgctgagagtgcagagaagcgacgccggcatcagcttcagcaacaccatcgagttcggcgacaccaaggacaaggtgctggtgttcttcaagctgagacccgaggtgatcaccgacgagaacctgcacgacaacatcctggtgagcagcatgctggagagccccatcagcagcctgtaccaggccgtgagacaggtgttcgcccccatgctgctgaaggaccaggagtggagcagaaacttcgaccccaagctgcagaacctgctgagcgagctggaggccggcctgggcatcgtgctgagaagaagcgacaccaacctgaccaagctgaagttcaaggaggacgacaccagaggcatcctgacccccagcgacgagttccagttctggatcgagcaggcccacagaggcaacaagcagatcagcaaggagagagccaactacttcaaggagctgttcgagaccatcgccagagagttctacaacctggacagcctgagcctgctggaggtggtggacctggtggagaccacccaggacgtggtggacgacgtgtggagacagaccgagcacgaccactaccccgagagcagaatgctgcacctgctggacatcatcggcggcagcttcggcagattcgtgcagaagaagctgggcaccctgaacctgtgggaggacccctactacctggtgaaggagagcctgaaggccggcatcagcatctgcgagcagtgggtgatcgtgtgcaaccacctgaccggccaggtgtggcagagatacgtgccccacccctggaagaacgagaagtacttccccgagaccctggacaagctgggcaagagactggaggaggtgctggccatcagaaccatccacgagaagttcctgtacttcctgcccgccagcgaggagaagatcatctgcctgaccagagtgttcgagcccttcaccggcctgaaccccgtgcagtacaacccctacaccgagcccctgtggaaggccgccgtgagccagtacgagaagatcatcgcccccgccgagcagaagatcgccggcaagctgaagaactacatcagcgagatccaggacagcccccagcagctgctgcaggccttcctgaagtacaaggagctggtgaagagacccaccatcagcaaggagctgatgctggagagagagaccctgctggccagactggtggacagcatcaaggacttcagactggacttcgagaacagatgcagaggcatccccggcgacgccagcggccccctgagcggcaagaacctgagcgaggtggtgaacagcatcgtgtgggtgagacagctggagctgaaggtggacgacaccatcaagatcgccgaggccctgctgagcgacctgcccggcttcagatgcttccaccagagcgccaaggacctgctggaccagctgaagctgtacgagcaggagcagttcgacgactggagcagagacatccagagcggcctgagcgacagcagaagcggcctgtgcatcgaggccagcagcagaatcatggagctggacagcaacgacggcctgctgaaggtgcactacagcgacagactggtgatcctgctgagagaggtgagacagctgagcgccctgggcttcgtgatccccgccaagatccagcaggtggccaacatcgcccagaagttctgcaagcaggccatcatcctgaagcaggtggcccacttctacaacagcatcgaccagcagatgatccagagccagagacccatgatgctgcagagcgccctggccttcgagcagatcatcaagaacagcaaggccggcagcggcggcaagagccagatcacctgggacaaccccaaggagctggagggctacatccagaagctgcagaacgccgccgagagactggccaccgagaacagaaagctgagaaagtggcacaccaccttctgcgagaaggtggtggtgctgatgaacatcgacctgctgagacagcagcagagatggaaggacggcctgcaggagctgagaaccggcctggccaccgtggaggcccagtgccccctggcctggcagagcaagtgggagggccccgaggaccccctgcagtacctgagaggcctggtggccagagccctggccatccagaactgggtggacaaggccgagaagcaggccctgctgagcgagaccctggacctgagcgagctgttccaccccgacaccttcctgaacgccctgagacaggagaccgccagagccgtgggcagaagcgtggacagcctgaagttcgtggccagctggaagggcagactgcaggaggccaagctgcagatcaagatcagcggcctgctgctggagggctgcagcttcgacggcaaccagctgagcgagaaccagctggacagccccagcgtgagcagcgtgctgccctgcttcatgggctggatcccccaggacgcctgcggcccctacagccccgacgagtgcatcagcctgcccgtgtacaccagcgccgagagagacagagtggtgaccaacatcgacgtgccctgcggcggcaaccaggaccagtggatccagtgcggcgccgccctgttcctgaagaaccagtag

SEQ ID NO: 79891 - DNA, 12924 bp, Artificial Sequence
  Description of Artificial Sequence: Synthetic coding sequence
atggccaacggcaccgccgacgtgagaaagctgttcatcttcaccaccacccagaactacttcggcctgatgagcgagctgtgggaccagcccctgctgtgcaactgcctggagatcaacaacttcctggacgacggcaaccagatgctgctgagagtgcagagaagcgacgccggcatcagcttcagcaacaccatcgagttcggcgacaccaaggacaaggtgctggtgttcttcaagctgagacccgaggtgatcaccgacgagaacctgcacgacaacatcctggtgagcagcatgctggagagccccatcagcagcctgtaccaggccgtgagacaggtgttcgcccccatgctgctgaaggaccaggagtggagcagaaacttcgaccccaagctgcagaacctgctgagcgagctggaggccggcctgggcatcgtgctgagaagaagcgacaccaacctgaccaagctgaagttcaaggaggacgacaccagaggcatcctgacccccagcgacgagttccagttctggatcgagcaggcccacagaggcaacaagcagatcagcaaggagagagccaactacttcaaggagctgttcgagaccatcgccagagagttctacaacctggacagcctgagcctgctggaggtggtggacctggtggagaccacccaggacgtggtggacgacgtgtggagacagaccgagcacgaccactaccccgagagcagaatgctgcacctgctggacatcatcggcggcagcttcggcagattcgtgcagaagaagctgggcaccctgaacctgtgggaggacccctactacctggtgaaggagagcctgaaggccggcatcagcatctgcgagcagtgggtgatcgtgtgcaaccacctgaccggccaggtgtggcagagatacgtgccccacccctggaagaacgagaagtacttccccgagaccctggacaagctgggcaagagactggaggaggtgctggccatcagaaccatccacgagaagttcctgtacttcctgcccgccagcgaggagaagatcatctgcctgaccagagtgttcgagcccttcaccggcctgaaccccgtgcagtacaacccctacaccgagcccctgtggaaggccgccgtgagccagtacgagaagatcatcgcccccgccgagcagaagatcgccggcaagctgaagaactacatcagcgagatccaggacagcccccagcagctgctgcaggccttcctgaagtacaaggagctggtgaagagacccaccatcagcaaggagctgatgctggagagagagaccctgctggccagactggtggacagcatcaaggacttcagactggacttcgagaacagatgcagaggcatccccggcgacgccagcggccccctgagcggcaagaacctgagcgaggtggtgaacagcatcgtgtgggtgagacagctggagctgaaggtggacgacaccatcaagatcgccgaggccctgctgagcgacctgcccggcttcagatgcttccaccagagcgccaaggacctgctggaccagctgaagctgtacgagcaggagcagttcgacgactggagcagagacatccagagcggcctgagcgacagcagaagcggcctgtgcatcgaggccagcagcagaatcatggagctggacagcaacgacggcctgctgaaggtgcactacagcgacagactggtgatcctgctgagagaggtgagacagctgagcgccctgggcttcgtgatccccgccaagatccagcaggtggccaacatcgcccagaagttctgcaagcaggccatcatcctgaagcaggtggcccacttctacaacagcatcgaccagcagatgatccagagccagagacccatgatgctgcagagcgccctggccttcgagcagatcatcaagaacagcaaggccggcagcggcggcaagagccagatcacctgggacaaccccaaggagctggagggctacatccagaagctgcagaacgccgccgagagactggccaccgagaacagaaagctgagaaagtggcacaccaccttctgcgagaaggtggtggtgctgatgaacatcgacctgctgagacagcagcagagatggaaggacggcctgcaggagctgagaaccggcctggccaccgtggaggcccagggcttccaggccagcgacatgcacgcctggaagcagcactggaaccaccagctgtacaaggccctggagcaccagtaccagatgggcctggaggccctgaacgagaacctgcccgagatcaacatcgacctgacctacaagcagggcagactgcagttcagaccccccttcgaggagatcagagccaagtactacagagagatgaagagattcatcggcatccccaaccagttcaagggcgtgggcgaggccggcgacgagagcatcttcagcatcatgatcgacagaaacgccagcggcttcctgaccatcttcagcaaggccgaggacctgttcagaagactgagcgccgtgctgcaccagcacaaggagtggatcgtgatcggccaggtggacatggaggccctggtggagaagcacctgttcaccgtgcacgactgggagaagaacttcaaggccctgaagatcaagggcaaggaggtggagagactgcccagcgccgtgaaggtggactgcctgaacatcaactgcaaccccgtgaagaccgtgatcgacgacctgatccagaagctgttcgacctgctggtgctgagcctgaagaagagcatccaggcccacctgcacgagatcgacaccttcgtgaccgaggccatggaggtgctgaccatcatgccccagagcgtggaggagatcggcgacgccaacctgcagtacagcaagctgcaggagagaaagcccgagatcctgcccctgttccaggaggccgaggacaagaacagactgctgagaaccgtggccggcggcggcctggagaccatcagcaacctgaaggccaagtgggacaagttcgagctgatgatggagagccaccagctgatgatcaaggaccagatcgaggtgatgaagggcaacgtgaagagcagactgcagatctactaccaggagctggagaagttcaaggccagatgggaccagctgaagcccggcgacgacgtgatcgagaccggccagcacaacaccctggacaagagcgccaagctgatcaaggagaagaagatcgagttcgacgacctggaggtgaccagaaagaagctggtggacgactgccaccacttcagactggaggagcccaacttcagcctggccagcagcatcagcaaggacatcgagagctgcgcccagatctgggccttctacgaggagttccagcagggcttccaggagatggccaacgaggactggatcaccttcagaaccaagacctacctgttcgaggagttcctgatgaactggcacgacagactgagaaaggtggaggagcacagcgtgatgaccgtgaagctgcagagcgaggtggacaagtacaagatcgtgatccccatcctgaagtacgtgagaggcgagcacctgagccccgaccactggctggacctgttcagactgctgggcctgcccagaggcaccagcctggagaagctgctgttcggcgacctgctgagagtggccgacaccatcgtggccaaggccgccgacctgaaggacctgaacagcagagcccagggcgaggtgaccatcagagaggccctgagagagctggacctgtggggcgtgggcgccgtgttcaccctgatcgactacgaggacagccagagcagaaccatgaagctgatcaaggactggaaggacatcgtgaaccaggtgggcgacaacagatgcctgctgcagagcctgaaggacagcccctactacaagggcttcgaggacaaggtgagcatctgggagagaaagctggccgagctggacgagtacctgcagaacctgaaccacatccagagaaagtgggtgtacctggagcccatcttcggcagaggcgccctgcccaaggagcagaccagattcaacagagtggacgaggacttcagaagcatcatgaccgacatcaagaaggacaacagagtgaccaccctgaccacccacgccggcatcagaaacagcctgctgaccatcctggaccagctgcagagatgccagaagagcctgaacgagttcctggaggagaagagaagcgccttccccagattctacttcatcggcgacgacgacctgctggagatcctgggccagagcaccaaccccagcgtgatccagagccacctgaagaagctgttcgccggcatcaacagcgtgtgcttcgacgagaagagcaagcacatcaccgccatgaagagcctggagggcgaggtggtgcccttcaagaacaaggtgcccctgagcaacaacgtggagacctggctgaacgacctggccctggagatgaagaagaccctggagcagctgctgaaggagtgcgtgaccaccggcagaagcagccagggcgccgtggaccccagcctgttccccagccagatcctgtgcctggccgagcagatcaagttcaccgaggacgtggagaacgccatcaaggaccacagcctgcaccagatcgagacccagctggtgaacaagctggagcagtacaccaacatcgacaccagcagcgaggaccccggcaacaccgagagcggcatcctggagctgaagctgaaggccctgatcctggacatcatccacaacatcgacgtggtgaagcagctgaaccagatccaggtgcacaccaccgaggactgggcctggaagaagcagctgagattctacatgaagagcgaccacacctgctgcgtgcagatggtggacagcgagttccagtacacctacgagtaccagggcaacgccagcaagctggtgtacacccccctgaccgacaagtgctacctgaccctgacccaggccatgaagatgggcctgggcggcaacccctacggccccgccggcaccggcaagaccgagagcgtgaaggccctgggcggcctgctgggcagacaggtgctggtgttcaactgcgacgagggcatcgacgtgaagagcatgggcagaatcttcgtgggcctggtgaagtgcggcgcctggggctgcttcgacgagttcaacagactggaggagagcgtgctgagcgccgtgagcatgcagatccagaccatccaggacgccctgaagaaccacagaaccgtgtgcgagctgctgggcaaggaggtggaggtgaacagcaacagcggcatcttcatcaccatgaaccccgccggcaagggctacggcggcagacagaagctgcccgacaacctgaagcagctgttcagacccgtggccatgagccaccccgacaacgagctgatcgccgaggtgatcctgtacagcgagggcttcaaggacgccaaggtgctgagcagaaagctggtggccatcttcaacctgagcagagagctgctgaccccccagcagcactacgactggggcctgagagccctgaagaccgtgctgagaggcagcggcaacctgctgagacagctgaacaagagcggcaccacccagaacgccaacgagagccacatcgtggtgcaggccctgagactgaacaccatgagcaagttcaccttcaccgactgcaccagattcgacgccctgatcaaggacgtgttccccggcatcgagctgaaggaggtggagtacgacgagctgagcgccgccctgaagcaggtgttcgaggaggccaactacgagatcatccccaaccagatcaagaaggccctggagctgtacgagcagctgtgccagagaatgggcgtggtgatcgtgggccccagcggcgccggcaagagcaccctgtggagaatgctgagagccgccctgtgcaagaccggcaaggtggtgaagcagtacaccatgaaccccaaggccatgcccagataccagctgctgggccacatcgacatggacaccagagagtggagcgacggcgtgctgaccaacagcgccagacaggtggtgagagagccccaggacgtgagcagctggatcatctgcgacggcgacatcgaccccgagtggatcgagagcctgaacagcgtgctggacgacaacagactgctgaccatgcccagcggcgagagaatccagttcggccccaacgtgaacttcgtgttcgagacccacgacctgagctgcgccagccccgccaccatcagcagaatgggcatgatcttcctgagcgacgaggagaccgacctgaacagcctgatcaagagctggctgagaaaccagcccgccgagtacagaaacaacctggagaactggatcggcgactacttcgagaaggccctgcagtgggtgctgaagcagaacgactacgtggtggagaccagcctggtgggcaccgtgatgaacggcctgagccacctgcacggctgcagagaccacgacgagttcatcatcaacctgatcagaggcctgggcggcaacctgaacatgaagagcagactggagttcaccaaggaggtgttccactgggccagagagagcccccccgacttccacaagcccatggacacctactacgacagcaccagaggcagactggccacctacgtgctgaagaagcccgaggacctgaccgccgacgacttcagcaacggcctgaccctgcccgtgatccagacccccgacatgcagagaggcctggactacttcaagccctggctgagcagcgacaccaagcagcccttcatcctggtgggccccgagggctgcggcaagggcatgctgctgagatacgccttcagccagctgagaagcacccagatcgccaccgtgcactgcagcgcccagaccaccagcagacacctgctgcagaagctgagccagacctgcatggtgatcagcaccaacaccggcagagtgtacagacccaaggactgcgagagactggtgctgtacctgaaggacatcaacctgcccaagctggacaagtggggcaccagcaccctggtggccttcctgcagcaggtgctgacctaccagggcttctacgacgagaacctggagtgggtgggcctggagaacatccagatcgtggccagcatgagcgccggcggcagactgggcagacacaagctgaccaccagattcaccagcatcgtgagactgtgcagcatcgactaccccgagagagagcagctgcagaccatctacggcgcctacctggagcccgtgctgcacaagaacctgaagaaccacagcatctggggcagcagcagcaagatctacctgctggccggcagcatggtgcaggtgtacgagcaggtgagagccaagttcaccgtggacgactacagccactacttcttcaccccctgcatcctgacccagtgggtgctgggcctgttcagatacgacctggagggcggcagcagcaaccaccccctggactacgtgctggagatcgtggcctacgaggccagaagactgttcagagacaagatcgtgggcgccaaggagctgcacctgttcgacatcatcctgaccagcgtgttccagggcgactggggcagcgacatcctggacaacatgagcgacagcttctacgtgacctggggcgccagacacaacagcggcgccagagccgcccccggccagcccctgcccccccacggcaagcccctgggcaagctgaacagcaccgacctgaaggacgtgatcaagaagggcctgatccactacggcagagacaaccagaacctggacatcctgctgttccacgaggtgctggagtacatgagcagaatcgacagagtgctgagcttccccggcggcagcctgctgctggccggcagaagcggcgtgggcagaagaaccatcaccagcctggtgagccacatgcacggcgccgtgctgttcagccccaagatcagcagaggctacgagctgaagcagttcaagaacgacctgaagcacgtgctgcagctggccggcatcgaggcccagcaggtggtgctgctgctggaggactaccagttcgtgcaccccaccttcctggagatgatcaacagcctgctgagcagcggcgaggtgcccggcctgtacaccctggaggagctggagcccctgctgctgcccctgaaggaccaggccagccaggacggcttcttcggccccgtgttcaactacttcacctacagaatccagcagaacctgcacatcgtgctgatcatggacagcgccaacagcaacttcatgatcaactgcgagagcaaccccgccctgcacaagaagtgccaggtgctgtggatggagggctggagcaacagcagcatgaagaagatccccgagatgctgttcagcgagaccggcggcggcgagaagtacaacgacaagaagagaaaggaggagaagaagaagaacagcgtggaccccgacttcctgaagagcttcctgctgatccacgagagctgcaaggcctacggcgccacccccagcagatacatgaccttcctgcacgtgtacagcgccatcagcagcagcaagaagaaggagctgctgaagagacagagccacctgcaggccggcgtgagcaagctgaacgaggccaaggccctggtggacgagctgaacagaaaggccggcgagcagagcgtgctgctgaagaccaagcaggacgaggccgacgccgccctgcagatgatcaccgtgagcatgcaggacgccagcgagcagaagaccgagctggagagactgaagcacagaatcgccgaggaggtggtgaagatcgaggagagaaagaacaagatcgacgacgagctgaaggaggtgcagcccctggtgaacgaggccaagctggccgtgggcaacatcaagcccgagagcctgagcgagatcagaagcctgagaatgccccccgacgtgatcagagacatcctggagggcgtgctgagactgatgggcatcttcgacaccagctgggtgagcatgaagagcttcctggccaagagaggcgtgagagaggacatcgccaccttcgacgccagaaacatcagcaaggagatcagagagagcgtggaggagctgctgttcaagaacaagggcagcttcgaccccaagaacgccaagagagccagcaccgccgccgcccccctggccgcctgggtgaaggccaacatccagtacagccacgtgctggagagaatccaccccctggagaccgagcaggccggcctggagagcaacctgaagaagaccgaggacagaaagagaaagctggaggagctgctgaacagcgtgggccagaaggtgagcgagctgaaggagaagttccagagcagaaccagcgaggccgccaagctggaggccgaggtgagcaaggcccaggagaccatcaaggccgccgaggtgctgatcaaccagctggacagagagcacaagagatggaacgcccaggtggtggagatcaccgaggagctggccaccctgcccaagagagcccagctggccgccgccttcatcacctacctgagcgccgcccccgagagcctgagaaagacctgcctggaggagtggaccaagagcgccggcctggagaagttcgacctgagaagattcctgtgcaccgagagcgagcagctgatctggaagagcgagggcctgcccagcgacgacctgagcatcgagaacgccctggtgatcctgcagagcagagtgtgccccttcctgatcgaccccagcagccaggccaccgagtggctgaagacccacctgaaggacagcagactggaggtgatcaaccagcaggacagcaacttcatcaccgccctggagctggccgtgagattcggcaagaccctgatcatccaggagatggacggcgtggagcccgtgctgtaccccctgctgagaagagacctggtggcccagggccccagatacgtggtgcagatcggcgacaagatcatcgactacaacgaggagttcagactgttcctgagcaccagaaaccccaaccccttcatcccccccgacgccgccagcatcgtgaccgaggtgaacttcaccaccaccagaagcggcctgagaggccagctgctggccctgaccatccagcacgagaagcccgacctggaggagcagaagaccaagctgctgcagcaggaggaggacaagaagatccagctggccaagctggaggagagcctgctggagaccctggccaccagccagggcaacatcctggagaacaaggacctgatcgagagcctgaaccagaccaaggccagcagcgccctgatccaggagagcctgaaggagagctacaagctgcagatcagcctggaccaggagagagacgcctacctgcccctggccgagagcgccagcaagatgtacttcatcatcagcgacctgagcaagatcaacaacatgtacagattcagcctggccgccttcctgagactgttccagagagccctgcagaacaagcaggacagcgagaacaccgagcagagaatccagagcctgatcagcagcctgcagcacatggtgtacgagtacatctgcagatgcctgttcaaggccgaccagctgatgttcgccctgcacttcgtgagaggcatgcaccccgagctgttccaggagaacgagtgggacaccttcaccggcgtggtggtgggcgacatgctgagaaaggccgacagccagcagaagatcagagaccagctgcccagctggatcgaccaggagagaagctgggccgtggccaccctgaagatcgccctgcccagcctgtaccagaccctgtgcttcgaggacgccgccctgtggagaacctactacaacaacagcatgtgcgagcaggagttccccagcatcctggccaagaaggtgagcctgttccagcagatcctggtggtgcaggccctgagacccgacagactgcagagcgccatggccctgttcgcctgcaagaccctgggcctgaaggaggtgagccccctgcccctgaacctgaagagactgtacaaggagaccctggagatcgagcccatcctgatcatcatcagccccggcgccgaccccagccaggagctgcaggagctggccaacgccgagagaagcggcgagtgctaccaccaggtggccatgggccagggccaggccgacctggccatccagatgctgaaggagtgcgccagaaacggcgactggctgtgcctgaagaacctgcacctggtggtgagctggctgcccgtgctggagaaggagctgaacaccctgcagcccaaggacaccttcagactgtggctgaccgccgaggtgcaccccaacttcacccccatcctgctgcagagcagcctgaagatcacctacgagagcccccccggcctgaagaagaacctgatgagaacctacgagagctggacccccgagcagatcagcaagaaggacaacacccacagagcccacgccctgttcagcctggcctggttccacgccgcctgccaggagagaagaaactacatcccccagggctggaccaagttctacgagttcagcctgagcgacctgagagccggctacaacatcatcgacagactgttcgacggcgccaaggacgtgcagtgggagttcgtgcacggcctgctggagaacgccatctacggcggcagaatcgacaactacttcgacctgagagtgctgcagagctacctgaagcagttcttcaacagcagcgtgatcgacgtgttcaaccagagaaacaagaagagcatcttcccctacagcgtgagcctgccccagagctgcagcatcctggactacagagccgtgatcgagaagatccccgaggacgacaagcccagcttcttcggcctgcccgccaacatcgccagaagcagccagagaatgatcagcagccaggtgatcagccagctgagaatcctgggcagaagcatcaccgccggcagcaagttcgacagagagatctggagcaacgagctgagccccgtgctgaacctgtggaagaagctgaaccagaacagcaacctgatccaccagaaggtgcccccccccaacgacagacagggcagccccatcctgagcttcatcatcctggagcagttcaacgccatcagactggtgcagagcgtgcaccagagcctggccgccctgagcaaggtgatcagaggcaccaccctgctgagcagcgaggtgcagaagctggccagcgccctgctgaaccagaagtgccccctggcctggcagagcaagtgggagggccccgaggaccccctgcagtacctgagaggcctggtggccagagccctggccatccagaactgggtggacaaggccgagaagcaggccctgctgagcgagaccctggacctgagcgagctgttccaccccgacaccttcctgaacgccctgagacaggagaccgccagagccgtgggcagaagcgtggacagcctgaagttcgtggccagctggaagggcagactgcaggaggccaagctgcagatcaagatcagcggcctgctgctggagggctgcagcttcgacggcaaccagctgagcgagaaccagctggacagccccagcgtgagcagcgtgctgccctgcttcatgggctggatcccccaggacgcctgcggcccctacagccccgacgagtgcatcagcctgcccgtgtacaccagcgccgagagagacagagtggtgaccaacatcgacgtgccctgcggcggcaaccaggaccagtggatccagtgcggcgccgccctgttcctgaagaaccagtag

SEQ ID NO: 79892 - DNA, 12945 bp, Artificial Sequence
  Description of Artificial Sequence: Synthetic coding sequence
atggccaacggcaccgccgacgtgagaaagctgttcatcttcaccaccacccagaactacttcggcctgatgagcgagctgtgggaccagcccctgctgtgcaactgcctggagatcaacaacttcctggacgacggcaaccagatgctgctgagagtgcagagaagcgacgccggcatcagcttcagcaacaccatcgagttcggcgacaccaaggacaaggtgctggtgttcttcaagctgagacccgaggtgatcaccgacgagaacctgcacgacaacatcctggtgagcagcatgctggagagccccatcagcagcctgtaccaggccgtgagacaggtgttcgcccccatgctgctgaaggaccaggagtggagcagaaacttcgaccccaagctgcagaacctgctgagcgagctggaggccggcctgggcatcgtgctgagaagaagcgacaccaacctgaccaagctgaagttcaaggaggacgacaccagaggcatcctgacccccagcgacgagttccagttctggatcgagcaggcccacagaggcaacaagcagatcagcaaggagagagccaactacttcaaggagctgttcgagaccatcgccagagagttctacaacctggacagcctgagcctgctggaggtggtggacctggtggagaccacccaggacgtggtggacgacgtgtggagacagaccgagcacgaccactaccccgagagcagaatgctgcacctgctggacatcatcggcggcagcttcggcagattcgtgcagaagaagctgggcaccctgaacctgtgggaggacccctactacctggtgaaggagagcctgaaggccggcatcagcatctgcgagcagtgggtgatcgtgtgcaaccacctgaccggccaggtgtggcagagatacgtgccccacccctggaagaacgagaagtacttccccgagaccctggacaagctgggcaagagactggaggaggtgctggccatcagaaccatccacgagaagttcctgtacttcctgcccgccagcgaggagaagatcatctgcctgaccagagtgttcgagcccttcaccggcctgaaccccgtgcagtacaacccctacaccgagcccctgtggaaggccgccgtgagccagtacgagaagatcatcgcccccgccgagcagaagatcgccggcaagctgaagaactacatcagcgagatccaggacagcccccagcagctgctgcaggccttcctgaagtacaaggagctggtgaagagacccaccatcagcaaggagctgatgctggagagagagaccctgctggccagactggtggacagcatcaaggacttcagactggacttcgagaacagatgcagaggcatccccggcgacgccagcggccccctgagcggcaagaacctgagcgaggtggtgaacagcatcgtgtgggtgagacagctggagctgaaggtggacgacaccatcaagatcgccgaggccctgctgagcgacctgcccggcttcagatgcttccaccagagcgccaaggacctgctggaccagctgaagctgtacgagcaggagcagttcgacgactggagcagagacatccagagcggcctgagcgacagcagaagcggcctgtgcatcgaggccagcagcagaatcatggagctggacagcaacgacggcctgctgaaggtgcactacagcgacagactggtgatcctgctgagagaggtgagacagctgagcgccctgggcttcgtgatccccgccaagatccagcaggtggccaacatcgcccagaagttctgcaagcaggccatcatcctgaagcaggtggcccacttctacaacagcatcgaccagcagatgatccagagccagagacccatgatgctgcagagcgccctggccttcgagcagatcatcaagaacagcaaggccggcagcggcggcaagagccagatcacctgggacaaccccaaggagctggagggctacatccagaagctgcagaacgccgccgagagactggccaccgagaacagaaagctgagaaagtggcacaccaccttctgcgagaaggtggtggtgctgatgaacatcgacctgctgagacagcagcagagatggaaggacggcctgcaggagctgagaaccggcctggccaccgtggaggcccagggcttccaggccagcgacatgcacgcctggaagcagcactggaaccaccagctgtacaaggccctggagcaccagtaccagatgggcctggaggccctgaacgagaacctgcccgagatcaacatcgacctgacctacaagcagggcagactgcagttcagaccccccttcgaggagatcagagccaagtactacagagagatgaagagattcatcggcatccccaaccagttcaagggcgtgggcgaggccggcgacgagagcatcttcagcatcatgatcgacagaaacgccagcggcttcctgaccatcttcagcaaggccgaggacctgttcagaagactgagcgccgtgctgcaccagcacaaggagtggatcgtgatcggccaggtggacatggaggccctggtggagaagcacctgttcaccgtgcacgactgggagaagaacttcaaggccctgaagatcaagggcaaggaggtggagagactgcccagcgccgtgaaggtggactgcctgaacatcaactgcaaccccgtgaagaccgtgatcgacgacctgatccagaagctgttcgacctgctggtgctgagcctgaagaagagcatccaggcccacctgcacgagatcgacaccttcgtgaccgaggccatggaggtgctgaccatcatgccccagagcgtggaggagatcggcgacgccaacctgcagtacagcaagctgcaggagagaaagcccgagatcctgcccctgttccaggaggccgaggacaagaacagactgctgagaaccgtggccggcggcggcctggagaccatcagcaacctgaaggccaagtgggacaagttcgagctgatgatggagagccaccagctgatgatcaaggaccagatcgaggtgatgaagggcaacgtgaagagcagactgcagatctactaccaggagctggagaagttcaaggccagatgggaccagctgaagcccggcgacgacgtgatcgagaccggccagcacaacaccctggacaagagcgccaagctgatcaaggagaagaagatcgagttcgacgacctggaggtgaccagaaagaagctggtggacgactgccaccacttcagactggaggagcccaacttcagcctggccagcagcatcagcaaggacatcgagagctgcgcccagatctgggccttctacgaggagttccagcagggcttccaggagatggccaacgaggactggatcaccttcagaaccaagacctacctgttcgaggagttcctgatgaactggcacgacagactgagaaaggtggaggagcacagcgtgatgaccgtgaagctgcagagcgaggtggacaagtacaagatcgtgatccccatcctgaagtacgtgagaggcgagcacctgagccccgaccactggctggacctgttcagactgctgggcctgcccagaggcaccagcctggagaagctgctgttcggcgacctgctgagagtggccgacaccatcgtggccaaggccgccgacctgaaggacctgaacagcagagcccagggcgaggtgaccatcagagaggccctgagagagctggacctgtggggcgtgggcgccgtgttcaccctgatcgactacgaggacagccagagcagaaccatgaagctgatcaaggactggaaggacatcgtgaaccaggtgggcgacaacagatgcctgctgcagagcctgaaggacagcccctactacaagggcttcgaggacaaggtgagcatctgggagagaaagctggccgagctggacgagtacctgcagaacctgaaccacatccagagaaagtgggtgtacctggagcccatcttcggcagaggcgccctgcccaaggagcagaccagattcaacagagtggacgaggacttcagaagcatcatgaccgacatcaagaaggacaacagagtgaccaccctgaccacccacgccggcatcagaaacagcctgctgaccatcctggaccagctgcagagatgccagaagagcctgaacgagttcctggaggagaagagaagcgccttccccagattctacttcatcggcgacgacgacctgctggagatcctgggccagagcaccaaccccagcgtgatccagagccacctgaagaagctgttcgccggcatcaacagcgtgtgcttcgacgagaagagcaagcacatcaccgccatgaagagcctggagggcgaggtggtgcccttcaagaacaaggtgcccctgagcaacaacgtggagacctggctgaacgacctggccctggagatgaagaagaccctggagcagctgctgaaggagtgcgtgaccaccggcagaagcagccagggcgccgtggaccccagcctgttccccagccagatcctgtgcctggccgagcagatcaagttcaccgaggacgtggagaacgccatcaaggaccacagcctgcaccagatcgagacccagctggtgaacaagctggagcagtacaccaacatcgacaccagcagcgaggaccccggcaacaccgagagcggcatcctggagctgaagctgaaggccctgatcctggacatcatccacaacatcgacgtggtgaagcagctgaaccagatccaggtgcacaccaccgaggactgggcctggaagaagcagctgagattctacatgaagagcgaccacacctgctgcgtgcagatggtggacagcgagttccagtacacctacgagtaccagggcaacgccagcaagctggtgtacacccccctgaccgacaagtgctacctgaccctgacccaggccatgaagatgggcctgggcggcaacccctacggccccgccggcaccggcaagaccgagagcgtgaaggccctgggcggcctgctgggcagacaggtgctggtgttcaactgcgacgagggcatcgacgtgaagagcatgggcagaatcttcgtgggcctggtgaagtgcggcgcctggggctgcttcgacgagttcaacagactggaggagagcgtgctgagcgccgtgagcatgcagatccagaccatccaggacgccctgaagaaccacagaaccgtgtgcgagctgctgggcaaggaggtggaggtgaacagcaacagcggcatcttcatcaccatgaaccccgccggcaagggctacggcggcagacagaagctgcccgacaacctgaagcagctgttcagacccgtggccatgagccaccccgacaacgagctgatcgccgaggtgatcctgtacagcgagggcttcaaggacgccaaggtgctgagcagaaagctggtggccatcttcaacctgagcagagagctgctgaccccccagcagcactacgactggggcctgagagccctgaagaccgtgctgagaggcagcggcaacctgctgagacagctgaacaagagcggcaccacccagaacgccaacgagagccacatcgtggtgcaggccctgagactgaacaccatgagcaagttcaccttcaccgactgcaccagattcgacgccctgatcaaggacgtgttccccggcatcgagctgaaggaggtggagtacgacgagctgagcgccgccctgaagcaggtgttcgaggaggccaactacgagatcatccccaaccagatcaagaaggccctggagctgtacgagcagctgtgccagagaatgggcgtggtgatcgtgggccccagcggcgccggcaagagcaccctgtggagaatgctgagagccgccctgtgcaagaccggcaaggtggtgaagcagtacaccatgaaccccaaggccatgcccagataccagctgctgggccacatcgacatggacaccagagagtggagcgacggcgtgctgaccaacagcgccagacaggtggtgagagagccccaggacgtgagcagctggatcatctgcgacggcgacatcgaccccgagtggatcgagagcctgaacagcgtgctggacgacaacagactgctgaccatgcccagcggcgagagaatccagttcggccccaacgtgaacttcgtgttcgagacccacgacctgagctgcgccagccccgccaccatcagcagaatgggcatgatcttcctgagcgacgaggagaccgacctgaacagcctgatcaagagctggctgagaaaccagcccgccgagtacagaaacaacctggagaactggatcggcgactacttcgagaaggccctgcagtgggtgctgaagcagaacgactacgtggtggagaccagcctggtgggcaccgtgatgaacggcctgagccacctgcacggctgcagagaccacgacgagttcatcatcaacctgatcagaggcctgggcggcaacctgaacatgaagagcagactggagttcaccaaggaggtgttccactgggccagagagagcccccccgacttccacaagcccatggacacctactacgacagcaccagaggcagactggccacctacgtgctgaagaagcccgaggacctgaccgccgacgacttcagcaacggcctgaccctgcccgtgatccagacccccgacatgcagagaggcctggactacttcaagccctggctgagcagcgacaccaagcagcccttcatcctggtgggccccgagggctgcggcaagggcatgctgctgagatacgccttcagccagctgagaagcacccagatcgccaccgtgcactgcagcgcccagaccaccagcagacacctgctgcagaagctgagccagacctgcatggtgatcagcaccaacaccggcagagtgtacagacccaaggactgcgagagactggtgctgtacctgaaggacatcaacctgcccaagctggacaagtggggcaccagcaccctggtggccttcctgcagcaggtgctgacctaccagggcttctacgacgagaacctggagtgggtgggcctggagaacatccagatcgtggccagcatgagcgccggcggcagactgggcagacacaagctgaccaccagattcaccagcatcgtgagactgtgcagcatcgactaccccgagagagagcagctgcagaccatctacggcgcctacctggagcccgtgctgcacaagaacctgaagaaccacagcatctggggcagcagcagcaagatctacctgctggccggcagcatggtgcaggtgtacgagcaggtgagagccaagttcaccgtggacgactacagccactacttcttcaccccctgcatcctgacccagtgggtgctgggcctgttcagatacgacctggagggcggcagcagcaaccaccccctggactacgtgctggagatcgtggcctacgaggccagaagactgttcagagacaagatcgtgggcgccaaggagctgcacctgttcgacatcatcctgaccagcgtgttccagggcgactggggcagcgacatcctggacaacatgagcgacagcttctacgtgacctggggcgccagacacaacagcggcgccagagccgcccccggccagcccctgcccccccacggcaagcccctgggcaagctgaacagcaccgacctgaaggacgtgatcaagaagggcctgatccactacggcagagacaaccagaacctggacatcctgctgttccacgaggtgctggagtacatgagcagaatcgacagagtgctgagcttccccggcggcagcctgctgctggccggcagaagcggcgtgggcagaagaaccatcaccagcctggtgagccacatgcacggcgccgtgctgttcagccccaagatcagcagaggctacgagctgaagcagttcaagaacgacctgaagcacgtgctgcagctggccggcatcgaggcccagcaggtggtgctgctgctggaggactaccagttcgtgcaccccaccttcctggagatgatcaacagcctgctgagcagcggcgaggtgcccggcctgtacaccctggaggagctggagcccctgctgctgcccctgaaggaccaggccagccaggacggcttcttcggccccgtgttcaactacttcacctacagaatccagcagaacctgcacatcgtgctgatcatggacagcgccaacagcaacttcatgatcaactgcgagagcaaccccgccctgcacaagaagtgccaggtgctgtggatggagggctggagcaacagcagcatgaagaagatccccgagatgctgttcagcgagaccggcggcggcgagaagtacaacgacaagaagagaaaggaggagaagaagaagaacagcgtggaccccgacttcctgaagagcttcctgctgatccacgagagctgcaaggcctacggcgccacccccagcagatacatgaccttcctgcacgtgtacagcgccatcagcagcagcaagaagaaggagctgctgaagagacagagccacctgcaggccggcgtgagcaagctgaacgaggccaaggccctggtggacgagctgaacagaaaggccggcgagcagagcgtgctgctgaagaccaagcaggacgaggccgacgccgccctgcagatgatcaccgtgagcatgcaggacgccagcgagcagaagaccgagctggagagactgaagcacagaatcgccgaggaggtggtgaagatcgaggagagaaagaacaagatcgacgacgagctgaaggaggtgcagcccctggtgaacgaggccaagctggccgtgggcaacatcaagcccgagagcctgagcgagatcagaagcctgagaatgccccccgacgtgatcagagacatcctggagggcgtgctgagactgatgggcatcttcgacaccagctgggtgagcatgaagagcttcctggccaagagaggcgtgagagaggacatcgccaccttcgacgccagaaacatcagcaaggagatcagagagagcgtggaggagctgctgttcaagaacaagggcagcttcgaccccaagaacgccaagagagccagcaccgccgccgcccccctggccgcctgggtgaaggccaacatccagtacagccacgtgctggagagaatccaccccctggagaccgagcaggccggcctggagagcaacctgaagaagaccgaggacagaaagagaaagctggaggagctgctgaacagcgtgggccagaaggtgagcgagctgaaggagaagttccagagcagaaccagcgaggccgccaagctggaggccgaggtgagcaaggcccaggagaccatcaaggccgccgaggtgctgatcaaccagctggacagagagcacaagagatggaacgcccaggtggtggagatcaccgaggagctggccaccctgcccaagagagcccagctggccgccgccttcatcacctacctgagcgccgcccccgagagcctgagaaagacctgcctggaggagtggaccaagagcgccggcctggagaagttcgacctgagaagattcctgtgcaccgagagcgagcagctgatctggaagagcgagggcctgcccagcgacgacctgagcatcgagaacgccctggtgatcctgcagatcatcggcctgaagagctggagcagagtgtgccccttcctgatcgaccccagcagccaggccaccgagtggctgaagacccacctgaaggacagcagactggaggtgatcaaccagcaggacagcaacttcatcaccgccctggagctggccgtgagattcggcaagaccctgatcatccaggagatggacggcgtggagcccgtgctgtaccccctgctgagaagagacctggtggcccagggccccagatacgtggtgcagatcggcgacaagatcatcgactacaacgaggagttcagactgttcctgagcaccagaaaccccaaccccttcatcccccccgacgccgccagcatcgtgaccgaggtgaacttcaccaccaccagaagcggcctgagaggccagctgctggccctgaccatccagcacgagaagcccgacctggaggagcagaagaccaagctgctgcagcaggaggaggacaagaagatccagctggccaagctggaggagagcctgctggagaccctggccaccagccagggcaacatcctggagaacaaggacctgatcgagagcctgaaccagaccaaggccagcagcgccctgatccaggagagcctgaaggagagctacaagctgcagatcagcctggaccaggagagagacgcctacctgcccctggccgagagcgccagcaagatgtacttcatcatcagcgacctgagcaagatcaacaacatgtacagattcagcctggccgccttcctgagactgttccagagagccctgcagaacaagcaggacagcgagaacaccgagcagagaatccagagcctgatcagcagcctgcagcacatggtgtacgagtacatctgcagatgcctgttcaaggccgaccagctgatgttcgccctgcacttcgtgagaggcatgcaccccgagctgttccaggagaacgagtgggacaccttcaccggcgtggtggtgggcgacatgctgagaaaggccgacagccagcagaagatcagagaccagctgcccagctggatcgaccaggagagaagctgggccgtggccaccctgaagatcgccctgcccagcctgtaccagaccctgtgcttcgaggacgccgccctgtggagaacctactacaacaacagcatgtgcgagcaggagttccccagcatcctggccaagaaggtgagcctgttccagcagatcctggtggtgcaggccctgagacccgacagactgcagagcgccatggccctgttcgcctgcaagaccctgggcctgaaggaggtgagccccctgcccctgaacctgaagagactgtacaaggagaccctggagatcgagcccatcctgatcatcatcagccccggcgccgaccccagccaggagctgcaggagctggccaacgccgagagaagcggcgagtgctaccaccaggtggccatgggccagggccaggccgacctggccatccagatgctgaaggagtgcgccagaaacggcgactggctgtgcctgaagaacctgcacctggtggtgagctggctgcccgtgctggagaaggagctgaacaccctgcagcccaaggacaccttcagactgtggctgaccgccgaggtgcaccccaacttcacccccatcctgctgcagagcagcctgaagatcacctacgagagcccccccggcctgaagaagaacctgatgagaacctacgagagctggacccccgagcagatcagcaagaaggacaacacccacagagcccacgccctgttcagcctggcctggttccacgccgcctgccaggagagaagaaactacatcccccagggctggaccaagttctacgagttcagcctgagcgacctgagagccggctacaacatcatcgacagactgttcgacggcgccaaggacgtgcagtgggagttcgtgcacggcctgctggagaacgccatctacggcggcagaatcgacaactacttcgacctgagagtgctgcagagctacctgaagcagttcttcaacagcagcgtgatcgacgtgttcaaccagagaaacaagaagagcatcttcccctacagcgtgagcctgccccagagctgcagcatcctggactacagagccgtgatcgagaagatccccgaggacgacaagcccagcttcttcggcctgcccgccaacatcgccagaagcagccagagaatgatcagcagccaggtgatcagccagctgagaatcctgggcagaagcatcaccgccggcagcaagttcgacagagagatctggagcaacgagctgagccccgtgctgaacctgtggaagaagctgaaccagaacagcaacctgatccaccagaaggtgcccccccccaacgacagacagggcagccccatcctgagcttcatcatcctggagcagttcaacgccatcagactggtgcagagcgtgcaccagagcctggccgccctgagcaaggtgatcagaggcaccaccctgctgagcagcgaggtgcagaagctggccagcgccctgctgaaccagaagtgccccctggcctggcagagcaagtgggagggccccgaggaccccctgcagtacctgagaggcctggtggccagagccctggccatccagaactgggtggacaaggccgagaagcaggccctgctgagcgagaccctggacctgagcgagctgttccaccccgacaccttcctgaacgccctgagacaggagaccgccagagccgtgggcagaagcgtggacagcctgaagttcgtggccagctggaagggcagactgcaggaggccaagctgcagatcaagatcagcggcctgctgctggagggctgcagcttcgacggcaaccagctgagcgagaaccagctggacagccccagcgtgagcagcgtgctgccctgcttcatgggctggatcccccaggacgcctgcggcccctacagccccgacgagtgcatcagcctgcccgtgtacaccagcgccgagagagacagagtggtgaccaacatcgacgtgccctgcggcggcaaccaggaccagtggatccagtgcggcgccgccctgttcctgaagaaccagtag

SEQ ID NO: 79893 - DNA, 1515 bp, Artificial Sequence
  Description of Artificial Sequence: Synthetic coding sequence
atgggccagggccaggccgacctggccatccagatgctgaaggagtgcgccagaaacggcgactggctgtgcctgaagaacctgcacctggtggtgagctggctgcccgtgctggagaaggagctgaacaccctgcagcccaaggacaccttcagactgtggctgaccgccgaggtgcaccccaacttcacccccatcctgctgcagagcagcctgaagatcacctacgagagcccccccggcctgaagaagaacctgatgagaacctacgagagctggacccccgagcagatcagcaagaaggacaacacccacagagcccacgccctgttcagcctggcctggttccacgccgcctgccaggagagaagaaactacatcccccagggctggaccaagttctacgagttcagcctgagcgacctgagagccggctacaacatcatcgacagactgttcgacggcgccaaggacgtgcagtgggagttcgtgcacggcctgctggagaacgccatctacggcggcagaatcgacaactacttcgacctgagagtgctgcagagctacctgaagcagttcttcaacagcagcgtgatcgacgtgttcaaccagagaaacaagaagagcatcttcccctacagcgtgagcctgccccagagctgcagcatcctggactacagagccgtgatcgagaagatccccgaggacgacaagcccagcttcttcggcctgcccgccaacatcgccagaagcagccagagaatgatcagcagccaggtgatcagccagctgagaatcctgggcagaagcatcaccgccggcagcaagttcgacagagagatctggagcaacgagctgagccccgtgctgaacctgtggaagaagctgaaccagaacagcaacctgatccaccagaaggtgcccccccccaacgacagacagggcagccccatcctgagcttcatcatcctggagcagttcaacgccatcagactggtgcagagcgtgcaccagagcctggccgccctgagcaaggtgatcagaggcaccaccctgctgagcagcgaggtgcagaagctggccagcgccctgctgaaccagaagtgccccctggcctggcagagcaagtgggagggccccgaggaccccctgcagtacctgagaggcctggtggccagagccctggccatccagaactgggtggacaaggccgagaagcaggccctgctgagcgagaccctggacctgagcgagctgttccaccccgacaccttcctgaacgccctgagacaggagaccgccagagccgtgggcagaagcgtggacagcctgaagttcgtggccagctggaagggcagactgcaggaggccaagctgcagatcaagatcagcggcctgctgctggagggctgcagcttcgacggcaaccagctgagcgagaaccagctggacagccccagcgtgagcagcgtgctgccctgcttcatgggctggatcccccaggacctgctgtag

SEQ ID NO: 79894 - DNA, 270 bp, Artificial Sequence
  Description of Artificial Sequence: Synthetic coding sequence
atgtgcgacagaaaggccgtgatcaagaacgccgacatgagcgaggagatgcagcaggacagcgtggagtgcgccacccaggccctggagaagtacaacatcgagaaggacatcgccgcccacatcaagaaggagttcgacaagaagtacaaccccacctggcactgcatcgtgggcagaaacttcggcagctacgtgacccacgagaccaagcacttcatctacttctacctgggccaggtggccatcctgctgttcaagagcggctag

SEQ ID NO: 79895 - DNA, 270 bp, Artificial Sequence; identical to SEQ ID NO: 79894
  Description of Artificial Sequence: Synthetic coding sequence

SEQ ID NO: 79896 - DNA, 270 bp, Artificial Sequence; identical to SEQ ID NO: 79894
  Description of Artificial Sequence: Synthetic coding sequence

SEQ ID NO: 79897 - DNA, 270 bp, Artificial Sequence; identical to SEQ ID NO: 79894
  Description of Artificial Sequence: Synthetic coding sequence

SEQ ID NO: 79898 - DNA, 129 bp, Artificial Sequence
  Description of Artificial Sequence: Synthetic coding sequence
atgtgcgacagaaaggccgtgatcaagaacgccgacatgagcgaggagatgcagcaggacagcgtggagtgcgccacccaggccctggagaagtacaacatcgagaaggacatcgccgcccacatctag

SEQ ID NO: 79899 - DNA, 270 bp, Artificial Sequence; identical to SEQ ID NO: 79894
  Description of Artificial Sequence: Synthetic coding sequence

SEQ ID NO: 79900 - DNA, 270 bp, Artificial Sequence
  Description of Artificial Sequence: Synthetic coding sequence
atgagcgacagaaaggccgtgatcaagaacgccgacatgagcgaggacatgcagcaggacgccgtggactgcgccacccaggccatggagaagtacaacatcgagaaggacatcgccgcctacatcaagaaggagttcgacaagaagtacaaccccacctggcactgcatcgtgggcagaaacttcggcagctacgtgacccacgagaccaagcacttcatctacttctacctgggccaggtggccatcctgctgttcaagagcggctag

SEQ ID NO: 79901 - DNA, 144 bp, Artificial Sequence
  Description of Artificial Sequence: Synthetic coding sequence
atggccgaggtggaggagaccctgaagagactgcagagccagaagggcgtgcagggcatcatcgtggtgaacaccgagggcggctgggagcccctgggccactgcggcgacagaagcagaccccccgcccagggctgcccctag

SEQ ID NO: 79902 - DNA, 291 bp, Artificial Sequence
  Description of Artificial Sequence: Synthetic coding sequence
atggccgaggtggaggagaccctgaagagactgcagagccagaagggcgtgcagggcatcatcgtggtgaacaccgagggcatccccatcaagagcaccatggacaaccccaccaccacccagtacgccagcctgatgcacagcttcatcctgaaggccagaagcaccgtgagagacatcgacccccagaacgacctgaccttcctgagaatcagaagcaagaagaacgagatcatggtggcccccgacaaggactacttcctgatcgtgatccagaaccccaccgagtag

SEQ ID NO: 79903 - DNA, 366 bp, Artificial Sequence
  Description of Artificial Sequence: Synthetic coding sequence
atggccgaggtggaggagaccctgaagagactgcagagccagaagggcgtgcagggcatcatcgtggtgaacaccgagggcatccccatcaagagcaccatggacaaccccaccaccacccagtacgccagcctgatgcacagcttcatcctgaaggccagaagcaccgtgagagacatcgacccccagaacgacctgaccttcctgagaatcagaagcaagaagaacgagatcatggtggcccccggcaagggcagcagcaccagcccctgcagaaacagaccccacggcaccttcagcgtggcccaccaggagagctggcacagcggcgtgagcagaggcagcaagcagggccccagaagctag

SEQ ID NO: 79904 - DNA, 291 bp, Artificial Sequence
  Description of Artificial Sequence: Synthetic coding sequence
atggccgaggtggaggagaccctgaagagaatccagagccacaagggcgtgatcggcaccatggtggtgaacgccgagggcatccccatcagaaccaccctggacaacagcaccaccgtgcagtacgccggcctgctgcaccacctgaccatgaaggccaagagcaccgtgagagacatcgacccccagaacgacctgaccttcctgagaatcagaagcaagaagcacgagatcatggtggcccccgacaaggagtacctgctgatcgtgatccagaacccctgcgagtag

SEQ ID NO: 79905 - DNA, 165 bp, Artificial Sequence
  Description of Artificial Sequence: Synthetic coding sequence
atggccgaggtggaggagaccctgaagagaatccagagccacaagggcgtgatcggcaccatggtggtgaacgccgaggaccccagattcgtgaccttcaagtacgccagacagctgaccgccttccagagaaagagcggccagcagatcaccatcaaggactag

SEQ ID NO: 79906 - DNA, 486 bp, Artificial Sequence
  Description of Artificial Sequence: Synthetic coding sequence
atggaccccaaccccagagccgccctggagagacagcagctgagactgagagagagacagaagttcttcgaggacatcctgcagcccgagaccgagttcgtgttccccctgagccacctgcacctggagagccagagaccccccatcggcagcatcagcagcatggaggtgaacgtggacaccctggagcaggtggagctgatcgacctgggcgaccccgacgccgccgacgtgttcctgccctgcgaggaccccccccccaccccccagagcagcggcatggacaaccacctggaggagctgagcctgcccgtgcccaccagcgacagaaccaccagcagaaccagcagcagcagcagcagcgacagcagcaccaacctgcacagccccaaccccagcgacgacggcgccgacacccccctggcccagagcgacgaggaggaggagagaggcgacggcggcgccgagcccggcgcctgcagctag

SEQ ID NO: 79907 - DNA, 486 bp, Artificial Sequence; identical to SEQ ID NO: 79906
  Description of Artificial Sequence: Synthetic coding sequence

SEQ ID NO: 79908 - DNA, 792 bp, Artificial Sequence
  Description of Artificial Sequence: Synthetic coding sequence
atggagagctgggccctggccgtgttccccgagtacagagtgagcctgctgtggtgcctggagctggccagccccctgtggagcctgggccaggccccccccctgcacgagacctggttcgtgggccacacctggttccagggcagaggcaagagaagccccagagccgaggtgagcagacccgagcccggcgcccccctgctgggctgctggctgcagtggggcgcccccagccccggccccctgtgcctgctgttcagactgtgcagctgcacctgcttcgcccccctgcccgccggcgccgacatggaccccaaccccagagccgccctggagagacagcagctgagactgagagagagacagaagttcttcgaggacatcctgcagcccgagaccgagttcgtgttccccctgagccacctgcacctggagagccagagaccccccatcggcagcatcagcagcatggaggtgaacgtggacaccctggagcaggtggagctgatcgacctgggcgaccccgacgccgccgacgtgttcctgccctgcgaggaccccccccccaccccccagagcagcggcatggacaaccacctggaggagctgagcctgcccgtgcccaccagcgacagaaccaccagcagaaccagcagcagcagcagcagcgacagcagcaccaacctgcacagccccaaccccagcgacgacggcgccgacacccccctggcccagagcgacgaggaggaggagagaggcgacggcggcgccgagcccggcgcctgcagctag

SEQ ID NO: 79909 - DNA, 486 bp, Artificial Sequence; identical to SEQ ID NO: 79906
  Description of Artificial Sequence: Synthetic coding sequence

SEQ ID NO: 79910 - DNA, 339 bp, Artificial Sequence
  Description of Artificial Sequence: Synthetic coding sequence
atggaccccaaccccagagccgccctggagagacagcagctgagactgagagagagacagaagttcttcgaggacatcctgcagcccgagaccgagttcgtgttccccctgagccacctgcacctggagagccagagaccccccatcggcagcatcagcagcatggaggtgaacgtggacaccctggagcaggtggagctgatcgacctgggcgaccccgacgccgccgacgtgttcctgccctgcgaggaccccccccccaccccccagagcagcggcatgcccctgtgcttcggcgacttcagcgccagccagcccgagcccgacgtgagactgtag

SEQ ID NO: 79911 - DNA, 780 bp, Artificial Sequence
  Description of Artificial Sequence: Synthetic coding sequence
atgggcgccggcaacttcctgaccgccctggaggtgcccgtggccgccctggccggcgccgccagcgacagaagagccagctgcgagagagtgagcccccccccccccctgccccacttcagactgccccccctgcccagaagcagactgcccggccccgtgagcagacccgagcccggcgcccccctgctgggctgctggctgcagtggggcgcccccagccccggccccctgtgcctgctgttcagactgtgcagctgcacctgcttcgcccccctgcccgccggcgccgacatggaccccaaccccagagccgccctggagagacagcagctgagactgagagagagacagaagttcttcgaggacatcctgcagcccgagaccgagttcgtgttccccctgagccacctgcacctggagagccagagaccccccatcggcagcatcagcagcatggaggtgaacgtggacaccctggagcaggtggagctgatcgacctgggcgaccccgacgccgccgacgtgttcctgccctgcgaggaccccccccccaccccccagagcagcggcatggacaaccacctggaggagctgagcctgcccgtgcccaccagcgacagaaccaccagcagaaccagcagcagcagcagcagcgacagcagcaccaacctgcacagccccaaccccagcgacgacggcgccgacacccccctggcccagagcgacgaggaggaggagagaggcgacggcggcgccgagcccggcgcctgcagctag

SEQ ID NO: 79912 - DNA, 339 bp, Artificial Sequence; identical to SEQ ID NO: 79910
  Description of Artificial Sequence: Synthetic coding sequence

SEQ ID NO: 79913 - DNA, 486 bp, Artificial Sequence; identical to SEQ ID NO: 79906
  Description of Artificial Sequence: Synthetic coding sequence

SEQ ID NO: 79914 - DNA, 519 bp, Artificial Sequence
  Description of Artificial Sequence: Synthetic coding sequence
tgaacctggttccagggcagaggcaagagaagccccagagccgaggtgagcagacccgagcccggcgcccccctgctgggctgctggctgcagtggggcgcccccagccccggccccctgtgcctgctgttcagactgtgcagctgcacctgcttcgcccccctgcccgccggcgccgacatggaccccaaccccagagccgccctggagagacagcagctgagactgagagagagacagaagttcttcgaggacatcctgcagcccgagaccgagttcgtgttccccctgagccacctgcacctggagagccagagaccccccatcggcagcatcagcagcatggaggtgaacgtggacaccctggagcaggtggagctgatcgacctgggcgaccccgacgccgccgacgtgttcctgccctgcgaggaccccccccccaccccccagagcagcggcatgcccctgtgcttcggcgacttcagcgccagccagcccgagcccgacgtgagactgtag

SEQ ID NO: 79915 - DNA, 15516 bp, Artificial Sequence
  Description of Artificial Sequence: Synthetic coding sequence
atgcacagcagcagctacagctacagaagcagcgacagcgtgttcagcaacaccaccagcaccagaaccagcctggacagcaacgagaacctgctgctggtgcactgcggccccaccctgatcaacagctgcatcagcttcggcagcgagagcttcgacggccacagactggagatgctgcagcagatcgccaacagagtgcagagagacagcgtgatctgcgaggacaagctgatcctggccggcaacgccctgcagagcgacagcaagagactggagagcggcgtgcagttccagaacgaggccgagatcgccggctacatcctggagtgcgagaacctgctgagacagcacgtgatcgacgtgcagatcctgatcgacggcaagtactaccaggccgaccagctggtgcagagagtggccaagctgagagacgagatcatggccctgagaaacgagtgcagcagcgtgtacagcaagggcagaatcctgaccaccgagcagaccaagctgatgatcagcggcatcacccagagcctgaacagcggcttcgcccagaccctgcaccccagcctgaccagcggcctgacccagagcctgacccccagcctgaccagcagcagcatgaccagcggcctgagcagcggcatgaccagcagactgacccccagcgtgacccccgcctacacccccggcttccccagcggcctggtgcccaacttcagcagcggcgtggagcccaacagcctgcagaccctgaagctgatgcagatcagaaagcccctgctgaagagcagcctgctggaccagaacctgaccgaggaggagatcaacatgaagttcgtgcaggacctgctgaactgggtggacgagatgcaggtgcagctggacagaaccgagtggggcagcgacctgcccagcgtggagagccacctggagaaccacaagaacgtgcacagagccatcgaggagttcgagagcagcctgaaggaggccaagatcagcgagatccagatgaccgcccccctgaagctgacctacgccgagaagctgcacagactggagagccagtacgccaagctgctgaacaccagcagaaaccaggagagacacctggacaccctgcacaacttcgtgagcagagccaccaacgagctgatctggctgaacgagaaggaggaggaggaggtggcctacgactggagcgagagaaacaccaacatcgccagaaagaaggactaccacgccgagctgatgagagagctggaccagaaggaggagaacatcaagagcgtgcaggagatcgccgagcagctgctgctggagaaccaccccgccagactgaccatcgaggcctacagagccgccatgcagacccagtggagctggatcctgcagctgtgccagtgcgtggagcagcacatcaaggagaacaccgcctacttcgagttcttcaacgacgccaaggaggccaccgactacctgagaaacctgaaggacgccatccagagaaagtacagctgcgacagaagcagcagcatccacaagctggaggacctggtgcaggagagcatggaggagaaggaggagctgctgcagtacaagagcaccatcgccaacctgatgggcaaggccaagaccatcatccagctgaagcccagaaacagcgactgccccctgaagaccagcatccccatcaaggccatctgcgactacagacagatcgagatcaccatctacaaggacgacgagtgcgtgctggccaacaacagccacagagccaagtggaaggtgatcagccccaccggcaacgaggccatggtgcccagcgtgtgcttcaccgtgcccccccccaacaaggaggccgtggacctggccaacagaatcgagcagcagtaccagaacgtgctgaccctgtggcacgagagccacatcaacatgaagagcgtggtgagctggcactacctgatcaacgagatcgacagaatcagagccagcaacgtggccagcatcaagaccatgctgcccggcgagcaccagcaggtgctgagcaacctgcagagcagattcgaggacttcctggaggacagccaggagagccaggtgttcagcggcagcgacatcacccagctggagaaggaggtgaacgtgtgcaagcagtactaccaggagctgctgaagagcgccgagagagaggagcaggaggagagcgtgtacaacctgtacatcagcgaggtgagaaacatcagactgagactggagaactgcgaggacagactgatcagacagatcagaacccccctggagagagacgacctgcacgagagcgtgttcagaatcaccgagcaggagaagctgaagaaggagctggagagactgaaggacgacctgggcaccatcaccaacaagtgcgaggagttcttcagccaggccgccgccagcagcagcgtgcccaccctgagaagcgagctgaacgtggtgctgcagaacatgaaccaggtgtacagcatgagcagcacctacatcgacaagctgaagaccgtgaacctggtgctgaagaacacccaggccgccgaggccctggtgaagctgtacgagaccaagctgtgcgaggaggaggccgtgatcgccgacaagaacaacatcgagaacctgatcagcaccctgaagcagtggagaagcgaggtggacgagaagagacaggtgttccacgccctggaggacgagctgcagaaggccaaggccatcagcgacgagatgttcaagacctacaaggagagagacctggacttcgactggcacaaggagaaggccgaccagctggtggagagatggcagaacgtgcacgtgcagatcgacaacagactgagagacctggagggcatcggcaagagcctgaagtactacagagacacctaccaccccctggacgactggatccagcaggtggagaccacccagagaaagatccaggagaaccagcccgagaacagcaagaccctggccacccagctgaaccagcagaagatgctggtgagcgagatcgagatgaagcagagcaagatggacgagtgccagaagtacgccgagcagtacagcgccaccgtgaaggactacgagctgcagaccatgacctacagagccatggtggacagccagcagaagagccccgtgaagagaagaagaatgcagagcagcgccgacctgatcatccaggagttcatggacctgagaaccagatacaccgccctggtgaccctgatgacccagtacatcaagttcgccggcgacagcctgaagagactggaggaggaggagaagagcctggaggaggagaagaaggagcacgtggagaaggccaaggagctgcagaagtgggtgagcaacatcagcaagaccctgaaggacgccgagaaggccggcaagccccccttcagcaagcagaagatcagcagcgaggagatcagcaccaagaaggagcagctgagcgaggccctgcagaccatccagctgttcctggccaagcacggcgacaagatgaccgacgaggagagaaacgagctggagaagcaggtgaagaccctgcaggagagctacaacctgctgttcagcgagagcctgaagcagctgcaggagagccagaccagcggcgacgtgaaggtggaggagaagatcgtggccgagagacagcaggagtacaaggagaagctgcagggcatctgcgacctgctgacccagaccgagaacagactgatcggccaccaggaggccttcatgatcggcgacggcaccgtggagctgaagaagtaccagagcaagcaggaggagctgcagaaggacatgcagggcagcgcccaggccctggccgaggtggtgaagaacaccgagaacttcctgaaggagaacggcgagaagctgagccaggaggacaaggccctgatcgagcagaagctgaacgaggccaagatcaagtgcgagcagctgaacctgaaggccgagcagagcaagaaggagctggacaaggtggtgaccaccgccatcaaggaggagaccgagaaggtggccgccgtgaagcagctggaggagagcaagaccaagatcgagaacctgctggactggctgagcaacgtggacaaggacagcgagagagccggcaccaagcacaagcaggtgatcgagcagaacggcacccacttccaggagggcgacggcaagagcgccatcggcgaggaggacgaggtgaacggcaacctgctggagaccgacgtggacggccaggtgggcaccacccaggagaacctgaaccagcagtaccagaaggtgaaggcccagcacgagaagatcatcagccagcaccaggccgtgatcatcgccacccagagcgcccaggtgctgctggagaagcagggccagtacctgagccccgaggagaaggagaagctgcagaagaacatgaaggagctgaaggtgcactacgagaccgccctggccgagagcgagaagaagatgaagctgacccacagcctgcaggaggagctggagaagttcgacgccgactacaccgagttcgagcactggctgcagcagagcgagcaggagctggagaacctggaggccggcgccgacgacatcaacggcctgatgaccaagctgaagagacagaagagcttcagcgaggacgtgatcagccacaagggcgacctgagatacatcaccatcagcggcaacagagtgctggaggccgccaagagctgcagcaagagagacggcggcaaggtggacaccagcgccacccacagagaggtgcagagaaagctggaccacgccaccgacagattcagaagcctgtacagcaagtgcaacgtgctgggcaacaacctgaaggacctggtggacaagtaccagcactacgaggacgccagctgcggcctgctggccggcctgcaggcctgcgaggccaccgccagcaagcacctgagcgagcccatcgccgtggaccccaagaacctgcagagacagctggaggagaccaaggccctgcagggccagatcagcagccagcaggtggccgtggagaagctgaagaagaccgccgaggtgctgctggacgccagaggcagcctgctgcccgccaagaacgacatccagaagaccctggacgacatcgtgggcagatacgaggacctgagcaagagcgtgaacgagagaaacgagaagctgcagatcaccctgaccagaagcctgagcgtgcaggacggcctggacgagatgctggactggatgggcaacgtggagagcagcctgaaggagcagggccaggtgcccctgaacagcaccgccctgcaggacatcatcagcaagaacatcatgctggagcaggacatcgccggcagacagagcagcatcaacgccatgaacgagaaggtgaagaagttcatggagaccaccgaccccagcaccgccagcagcctgcaggccaagatgaaggacctgagcgccagattcagcgaggccagccacaagcacaaggagaccctggccaagatggaggagctgaagaccaaggtggagctgttcgagaacctgagcgagaagctgcagaccttcctggagaccaagacccaggccctgaccgaggtggacgtgcccggcaaggacgtgaccgagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggacgccttccaggtgctggtgaagagcctgaagagctggatcaaggagaccaccaagaaggtgcccatcgtgcagcccagcttcggcgccgaggacctgggcaagagcctggaggacaccaagaagctgcaggagaagtggagcctgaagacccccgagatccagaaggtgaacaacagcggcatcagcctgtgcaacctgatcagcgccgtgaccacccccgccaaggccatcgccgccgtgaagagcggcggcgccgtgctgaacggcgagggcaccgccaccaacaccgaggagttctgggccaacaagggcctgaccagcatcaagaaggacatgaccgacatcagccacggctacgaggacctgggcctgctgctgaaggacaagatcgccgagctgaacaccaagctgagcaagctgcagaaggcccaggaggagagcagcgccatgatgcagtggctgcagaagatgaacaagaccgccaccaagtggcagcagacccccgcccccaccgacaccgaggccgtgaagacccaggtggagcagaacaagagcttcgaggccgagctgaagcagaacgtgaacaaggtgcaggagctgaaggacaagctgaccgagctgctggaggagaaccccgacacccccgaggcccccagatggaagcagatgctgaccgagatcgacagcaagtggcaggagctgaaccagctgaccatcgacagacagcagaagctggaggagagcagcaacaacctgacccagttccagaccgtggaggcccagctgaagcagtggctggtggagaaggagctgatggtgagcgtgctgggccccctgagcatcgaccccaacatgctgaacacccagagacagcaggtgcagatcctgctgcaggagttcgccaccagaaagccccagtacgagcagctgaccgccgccggccagggcatcctgagcagacccggcgaggaccccagcctgagaggcatcgtgaaggagcagctggccgccgtgacccagaagtgggacagcctgaccggccagctgagcgacagatgcgactggatcgaccaggccatcgtgaagagcacccagtaccagagcctgctgagaagcctgagcgacaagctgagcgacctggacaacaagctgagcagcagcctggccgtgagcacccaccccgacgccatgaaccagcagctggagaccgcccagaagatgaagcaggagatccagcaggagaagaagcagatcaaggtggcccaggccctgtgcgaggacctgagcgccctggtgaaggaggagtacctgaaggccgagctgagcagacagctggagggcatcctgaagagcttcaaggacgtggagcagaaggccgagaaccacgtgcagcacctgcagagcgcctgcgccagcagccaccagttccagcagatgagcagagacttccaggcctggctggacaccaagaaggaggagcagaacaagagccaccccatcagcgccaagctggacgtgctggagagcctgatcaaggaccacaaggacttcagcaagaccctgaccgcccagagccacatgtacgagaagaccatcgccgagggcgagaacctgctgctgaagacccagggcagcgagaaggccgccctgcagctgcagctgaacaccatcaagaccaactgggacaccttcaacaagcaggtgaaggagagagagaacaagctgaaggagagcctggagaaggccctgaagtacaaggagcaggtggagaccctgtggccctggatcgacaagtgccagaacaacctggaggagatcaagttctgcctggaccccgccgagggcgagaacagcatcgccaagctgaagagcctgcagaaggagatggaccagcacttcggcatggtggagctgctgaacaacaccgccaacagcctgctgagcgtgtgcgagatcgacaaggaggtggtgaccgacgagaacaagagcctgatccagaaggtggacatggtgaccgagcagctgcacagcaagaagttctgcctggagaacatgacccagaagttcaaggagttccaggaggtgagcaaggagagcaagagacagctgcagtgcgccaaggagcagctggacatccacgacagcctgggcagccaggcctacagcaacaagtacctgaccatgctgcagacccagcagaagagcctgcaggccctgaagcaccaggtggacctggccaagagactggcccaggacctggtggtggaggccagcgacagcaagggcaccagcgacgtgctgctgcaggtggagaccatcgcccaggagcacagcaccctgagccagcaggtggacgagaagtgcagcttcctggagaccaagctgcagggcatcggccacttccagaacaccatcagagagatgttcagccagttcgccgagttcgacgacgagctggacagcatggcccccgtgggcagagacgccgagaccctgcagaagcagaaggagaccatcaaggccttcctgaagaagctggaggccctgatggccagcaacgacaacgccaacaagacctgcaagatgatgctggccaccgaggagaccagccccgacctggtgggcatcaagagagacctggaggccctgagcaagcagtgcaacaagctgctggacagagcccaggccagagaggagcaggtggagggcaccatcaagagactggaggagttctacagcaagctgaaggagttcagcatcctgctgcagaaggccgaggagcacgaggagagccagggccccgtgggcatggagaccgagaccatcaaccagcagctgaacatgttcaaggtgttccagaaggaggagatcgagcccctgcagggcaagcagcaggacgtgaactggctgggccagggcctgatccagagcgccgccaagagcaccagcacccagggcctggagcacgacctggacgacgtgaacgccagatggaagaccctgaacaagaaggtggcccagagagccgcccagctgcaggaggccctgctgcactgcggcagattccaggacgccctggagagcctgctgagctggatggtggacaccgaggagctggtggccaaccagaagccccccagcgccgagttcaaggtggtgaaggcccagatccaggagcagaagctgctgcagagactgctggacgacagaaagagcaccgtggaggtgatcaagagagagggcgagaagatcgccaccaccgccgagcccgccgacaaggtgaagatcctgaagcagctgagcctgctggacagcagatgggaggccctgctgaacaaggccgagaccagaaacagacagctggagggcatcagcgtggtggcccagcagttccacgagaccctggagcccctgaacgagtggctgaccaccatcgagaagagactggtgaactgcgagcccatcggcacccaggccagcaagctggaggagcagatcgcccagcacaaggccctggaggacgacatcatcaaccacaacaagcacctgcaccaggccgtgagcatcggccagagcctgaaggtgctgagcagcagagaggacaaggacatggtgcagagcaagctggacttcagccaggtgtggtacatcgagatccaggagaagagccacagcagaagcgagctgctgcagcaggccctgtgcaacgccaagatcttcggcgaggacgaggtggagctgatgaactggctgaacgaggtgcacgacaagctgagcaagctgagcgtgcaggactacagcaccgagggcctgtggaagcagcagagcgagctgagagtgctgcaggaggacatcctgctgagaaagcagaacgtggaccaggccctgctgaacggcctggagctgctgaagcagaccaccggcgacgaggtgctgatcatccaggacaagctggaggccatcaaggccagatacaaggacatcaccaagctgagcaccgacgtggccaagaccctggagcaggccctgcagctggccagaagactgcacagcacccacgaggagctgtgcacctggctggacaaggtggaggtggagctgctgagctacgagacccaggtgctgaagggcgaggaggccagccaggcccagatgagacccaaggagctgaagaaggaggccaagaacaacaaggccctgctggacagcctgaacgaggtgagcagcgccctgctggagctggtgccctggagagccagagagggcctggagaagatggtggccgaggacaacgagagatacagactggtgagcgacaccatcacccagaaggtggaggagatcgacgccgccatcctgagaagccagcagttcgaccaggccgccgacgccgagctgagctggatcaccgagaccgagaagaagctgatgagcctgggcgacatcagactggagcaggaccagaccagcgcccagctgcaggtgcagaagaccttcaccatggagatcctgagacacaaggacatcatcgacgacctggtgaagagcggccacaagatcatgaccgcctgcagcgaggaggagaagcagagcatgaagaagaagctggacaaggtgctgaagaactacgacaccatctgccagatcaacagcgagagatacctgcagctggagagagcccagagcctggtgaaccagttctgggagacctacgaggagctgtggccctggctgaccgagacccagagcatcatcagccagctgcccgcccccgccctggagtacgagaccctgagacagcagcaggaggagcacagacagctgagagagctgatcgccgagcacaagccccacatcgacaagatgaacaagaccggcccccagctgctggagctgagccccggcgagggcttcagcatccaggagaagtacgtggccgccgacaccctgtacagccagatcaaggaggacgtgaagaagagagccgtggccctggacgaggccatcagccagagcacccagttccacgacaagatcgaccagatcctggagagcctggagagaatcgtggagagactgagacagccccccagcatcagcgccgaggtggagaagatcaaggagcagatcagcgagaacaagaacgtgagcgtggacatggagaagctgcagcccctgtacgagaccctgaagcagagaggcgaggagatgatcgccagaagcggcggcaccgacaaggacatcagcgccaaggccgtgcaggacaagctggaccagatggtgttcatctgggagaacatccacaccctggtggaggagagagaggccaagctgctggacgtgatggagctggccgagaagttctggtgcgaccacatgagcctgatcgtgaccatcaaggacacccaggacttcatcagagacctggaggaccccggcatcgaccccagcgtggtgaagcagcagcaggaggccgccgagaccatcagagaggagatcgacggcctgcaggaggagctggacatcgtgatcaacctgggcagcgagctgatcgccgcctgcggcgagcccgacaagcccatcgtgaagaagagcatcgacgagctgaacagcgcctgggacagcctgaacaaggcctggaaggacagaatcgacaagctggaggaggccatgcaggccgccgtgcagtaccaggacggcctgcaggccgtgttcgactgggtggacatcgccggcggcaagctggccagcatgagccccatcggcaccgacctggagaccgtgaagcagcagatcgaggagctgaagcagttcaagagcgaggcctaccagcagcagatcgagatggagagactgaaccaccaggccgagctgctgctgaagaaggtgaccgaggagagcgacaagcacaccgtgcaggaccccctgatggagctgaagctgatctgggacagcctggaggagagaatcatcaacagacagcacaagctggagggcgccctgctggccctgggccagttccagcacgccctggacgagctgctggcctggctgacccacaccgagggcctgctgagcgagcagaagcccgtgggcggcgaccccaaggccatcgagatcgagctggccaagcaccacgtgctgcagaacgacgtgctggcccaccagagcaccgtggaggccgtgaacaaggccggcaacgacctgatcgagagcagcgccggcgaggaggccagcaacctgcagaacaagctggaggtgctgaaccagagatggcagaacgtgctggagaagaccgagcagagaaagcagcagctggacggcgccctgagacaggccaagggcttccacggcgagatcgaggacctgcagcagtggctgaccgacaccgagagacacctgctggccagcaagcccctgggcggcctgcccgagaccgccaaggagcagctgaacgtgcacatggaggtgtgcgccgccttcgaggccaaggaggagacctacaagagcctgatgcagaagggccagcagatgctggccagatgccccaagagcgccgagaccaacatcgaccaggacatcaacaacctgaaggagaagtgggagagcgtggagaccaagctgaacgagagaaagaccaagctggaggaggccctgaacctggccatggagttccacaacagcctgcaggacttcatcaactggctgacccaggccgagcagaccctgaacgtggccagcagacccagcctgatcctggacaccgtgctgttccagatcgacgagcacaaggtgttcgccaacgaggtgaacagccacagagagcagatcatcgagctggacaagaccggcacccacctgaagtacttcagccagaagcaggacgtggtgctgatcaagaacctgctgatcagcgtgcagagcagatgggagaaggtggtgcagagactggtggagagaggcagaagcctggacgacgccagaaagagagccaagcagttccacgaggcctggagcaagctgatggagtggctggaggagagcgagaagagcctggacagcgagctggagatcgccaacgaccccgacaagatcaagacccagctggcccagcacaaggagttccagaagagcctgggcgccaagcacagcgtgtacgacaccaccaacagaaccggcagaagcctgaaggagaagaccagcctggccgacgacaacctgaagctggacgacatgctgagcgagctgagagacaagtgggacaccatctgcggcaagagcgtggagagacagaacaagctggaggaggccctgctgttcagcggccagttcaccgacgccctgcaggccctgatcgactggctgtacagagtggagccccagctggccgaggaccagcccgtgcacggcgacatcgacctggtgatgaacctgatcgacaaccacaaggccttccagaaggagctgggcaagagaaccagcagcgtgcaggccctgaagagaagcgccagagagctgatcgagggcagcagagacgacagcagctgggtgaaggtgcagatgcaggagctgagcaccagatgggagaccgtgtgcgccctgagcatcagcaagcagaccagactggaggccgccctgagacaggccgaggagttccacagcgtggtgcacgccctgctggagtggctggccgaggccgagcagaccctgagattccacggcgtgctgcccgacgacgaggacgccctgagaaccctgatcgaccagcacaaggagttcatgaagaagctggaggagaagagagccgagctgaacaaggccaccaccatgggcgacaccgtgctggccatctgccaccccgacagcatcaccaccatcaagcactggatcaccatcatcagagccagattcgaggaggtgctggcctgggccaagcagcaccagcagagactggccagcgccctggccggcctgatcgccaagcaggagctgctggaggccctgctggcctggctgcagtgggccgagaccaccctgaccgacaaggacaaggaggtgatcccccaggagatcgaggaggtgaaggccctgatcgccgagcaccagaccttcatggaggagatgaccagaaagcagcccgacgtggacaaggtgaccaagacctacaagagaagagccgccgaccccagcagcctgcagagccacatccccgtgctggacaagggcagagccggcagaaagagattccccgccagcagcctgtaccccagcggcagccagacccagatcgagaccaagaaccccagagtgaacctgctggtgagcaagtggcagcaggtgtggctgctggccctggagagaagaagaaagctgaacgacgccctggacagactggaggagctgagagagttcgccaacttcgacttcgacatctggagaaagaagtacatgagatggatgaaccacaagaagagcagagtgatggacttcttcagaagaatcgacaaggaccaggacggcaagatcaccagacaggagttcatcgacggcatcctgagcagcaagttccccaccagcagactggagatgagcgccgtggccgacatcttcgacagagacggcgacggctacatcgactactacgagttcgtggccgccctgcaccccaacaaggacgcctacaagcccatcaccgacgccgacaagatcgaggacgaggtgaccagacaggtggccaagtgcaagtgcgccaagagattccaggtggagcagatcggcgacaacaagtacagattcttcctgggcaaccagttcggcgacagccagcagctgagactggtgagaatcctgagaagcaccgtgatggtgagagtgggcggcggctggatggccctggacgagttcctggtgaagaacgacccctgcagagccaagggcagaaccaacatggagctgagagagaagttcatcctggccgacggcgccagccagggcatggccgccttcagacccagaggcagaagaagcagacccagcagcagaggcgccagccccaacagaagcaccagcgtgagcagccaggccgcccaggccgccagcccccaggtgcccgccaccaccacccccaagatcctgcaccccctgaccagaaactacggcaagccctggctgaccaacagcaagatgagcaccccctgcaaggccgccgagtgcagcgacttccccgtgcccagcgccgagggcacccccatccagggcagcaagctgagactgcccggctacctgagcggcaagggcttccacagcggcgaggacagcggcctgatcaccaccgccgccgccagagtgagaacccagttcgccgacagcaagaagacccccagcagacccggcagcagagccggcagcaaggccggcagcagagccagcagcagaagaggcagcgacgccagcgacttcgacatcagcgagatccagagcgtgtgcagcgacgtggagaccgtgccccagacccacagacccacccccagagccggcagcagacccagcaccgccaagcccagcaagatccccaccccccagagaaagagccccgccagcaagctggacaagagcagcaagagatag

SEQ ID NO: 79916 - DNA, 12603 bp, Artificial Sequence
  Description of Artificial Sequence: Synthetic coding sequence
atggccggctacctgagccccgccgcctacctgtacgtggaggagcaggagtacctgcaggcctacgaggacgtgctggagagatacaaggacgagagagacaaggtgcagaagaagaccttcaccaagtggatcaaccagcacctgatgaaggtgagaaagcacgtgaacgacctgtacgaggacctgagagacggccacaacctgatcagcctgctggaggtgctgagcggcgacaccctgcccagagagaagggcagaatgagattccacagactgcagaacgtgcagatcgccctggactacctgaagagaagacaggtgaagctggtgaacatcagaaacgacgacatcaccgacggcaaccccaagctgaccctgggcctgatctggaccatcatcctgcacttccagatcagcgacatccacgtgaccggcgagagcgaggacatgagcgccaaggagagactgctgctgtggacccagcaggccaccgagggctacgccggcatcagatgcgagaacttcaccacctgctggagagacggcaagctgttcaacgccatcatccacaagtacagacccgacctgatcgacatgaacaccgtggccgtgcagagcaacctggccaacctggagcacgccttctacgtggccgagaagatcggcgtgatcagactgctggaccccgaggacgtggacgtgagcagccccgacgagaagagcgtgatcacctacgtgagcagcctgtacgacgccttccccaaggtgcccgagggcggcgagggcatcggcgccaacgacgtggaggtgaagtggatcgagtaccagaacatggtgaactacctgatccagtggatcagacaccacgtgaccaccatgagcgagagaaccttccccaacaaccccgtggagctgaaggccctgtacaaccagtacctgcagttcaaggagaccgagatcccccccaaggagaccgagaagagcaagatcaagagactgtacaagctgctggagatctggatcgagttcggcagaatcaagctgctgcagggctaccaccccaacgacatcgagaaggagtggggcaagctgatcatcgccatgctggagagagagaaggccctgagacccgaggtggagagactggagatgctgcagcagatcgccaacagagtgcagagagacagcgtgatctgcgaggacaagctgatcctggccggcaacgccctgcagagcgacagcaagagactggagagcggcgtgcagttccagaacgaggccgagatcgccggctacatcctggagtgcgagaacctgctgagacagcacgtgatcgacgtgcagatcctgatcgacggcaagtactaccaggccgaccagctggtgcagagagtggccaagctgagagacgagatcatggccctgagaaacgagtgcagcagcgtgtacagcaagggcagaatcctgaccaccgagcagaccaagctgatgatcagcggcatcacccagagcctgaacagcggcttcgcccagaccctgcaccccagcctgaccagcggcctgacccagagcctgacccccagcctgaccagcagcagcatgaccagcggcctgagcagcggcatgaccagcagactgacccccagcgtgacccccgcctacacccccggcttccccagcggcctggtgcccaacttcagcagcggcgtggagcccaacagcctgcagaccctgaagctgatgcagatcagaaagcccctgctgaagagcagcctgctggaccagaacctgaccgaggaggagatcaacatgaagttcgtgcaggacctgctgaactgggtggacgagatgcaggtgcagctggacagaaccgagtggggcagcgacctgcccagcgtggagagccacctggagaaccacaagaacgtgcacagagccatcgaggagttcgagagcagcctgaaggaggccaagatcagcgagatccagatgaccgcccccctgaagctgacctacgccgagaagctgcacagactggagagccagtacgccaagctgctgaacaccagcagaaaccaggagagacacctggacaccctgcacaacttcgtgagcagagccaccaacgagctgatctggctgaacgagaaggaggaggaggaggtggcctacgactggagcgagagaaacaccaacatcgccagaaagaaggactaccacgccgagctgatgagagagctggaccagaaggaggagaacatcaagagcgtgcaggagatcgccgagcagctgctgctggagaaccaccccgccagactgaccatcgaggcctacagagccgccatgcagacccagtggagctggatcctgcagctgtgccagtgcgtggagcagcacatcaaggagaacaccgcctacttcgagttcttcaacgacgccaaggaggccaccgactacctgagaaacctgaaggacgccatccagagaaagtacagctgcgacagaagcagcagcatccacaagctggaggacctggtgcaggagagcatggaggagaaggaggagctgctgcagtacaagagcaccatcgccaacctgatgggcaaggccaagaccatcatccagctgaagcccagaaacagcgactgccccctgaagaccagcatccccatcaaggccatctgcgactacagacagatcgagatcaccatctacaaggacgacgagtgcgtgctggccaacaacagccacagagccaagtggaaggtgatcagccccaccggcaacgaggccatggtgcccagcgtgtgcttcaccgtgcccccccccaacaaggaggccgtggacctggccaacagaatcgagcagcagtaccagaacgtgctgaccctgtggcacgagagccacatcaacatgaagagcgtggtgagctggcactacctgatcaacgagatcgacagaatcagagccagcaacgtggccagcatcaagaccatgctgcccggcgagcaccagcaggtgctgagcaacctgcagagcagattcgaggacttcctggaggacagccaggagagccaggtgttcagcggcagcgacatcacccagctggagaaggaggtgaacgtgtgcaagcagtactaccaggagctgctgaagagcgccgagagagaggagcaggaggagagcgtgtacaacctgtacatcagcgaggtgagaaacatcagactgagactggagaactgcgaggacagactgatcagacagatcagaacccccctggagagagacgacctgcacgagagcgtgttcagaatcaccgagcaggagaagctgaagaaggagctggagagactgaaggacgacctgggcaccatcaccaacaagtgcgaggagttcttcagccaggccgccgccagcagcagcgtgcccaccctgagaagcgagctgaacgtggtgctgcagaacatgaaccaggtgtacagcatgagcagcacctacatcgacaagctgaagaccgtgaacctggtgctgaagaacacccaggccgccgaggccctggtgaagctgtacgagaccaagctgtgcgaggaggaggccgtgatcgccgacaagaacaacatcgagaacctgatcagcaccctgaagcagtggagaagcgaggtggacgagaagagacaggtgttccacgccctggaggacgagctgcagaaggccaaggccatcagcgacgagatgttcaagacctacaaggagagagacctggacttcgactggcacaaggagaaggccgaccagctggtggagagatggcagaacgtgcacgtgcagatcgacaacagactgagagacctggagggcatcggcaagagcctgaagtactacagagacacctaccaccccctggacgactggatccagcaggtggagaccacccagagaaagatccaggagaaccagcccgagaacagcaagaccctggccacccagctgaaccagcagaagatgctggtgagcgagatcgagatgaagcagagcaagatggacgagtgccagaagtacgccgagcagtacagcgccaccgtgaaggactacgagctgcagaccatgacctacagagccatggtggacagccagcagaagagccccgtgaagagaagaagaatgcagagcagcgccgacctgatcatccaggagttcatggacctgagaaccagatacaccgccctggtgaccctgatgacccagtacatcaagttcgccggcgacagcctgaagagactggaggaggaggagaagagcctggaggaggagaagaaggagcacgtggagaaggccaaggagctgcagaagtgggtgagcaacatcagcaagaccctgaaggacgccgagaaggccggcaagccccccttcagcaagcagaagatcagcagcgaggagatcagcaccaagaaggagcagctgagcgaggccctgcagaccatccagctgttcctggccaagcacggcgacaagatgaccgacgaggagagaaacgagctggagaagcaggtgaagaccctgcaggagagctacaacctgctgttcagcgagagcctgaagcagctgcaggagagccagaccagcggcgacgtgaaggtggaggagaagctggacaaggtgatcgccggcaccatcgaccagaccaccggcgaggtgctgagcgtgttccaggccgtgctgagaggcctgatcgactacgacaccggcatcagactgctggagacccagctgatgatcagcggcctgatcagccccgagctgagaaagtgcttcgacctgaaggacgccaagagccacggcctgatcgacgagcagatcctgtgccagctgaaggagctgagcaaggccaaggagatcatcagcgccgccagccccaccaccatccccgtgctggacgccctggcccagagcatgatcaccgagagcatggccatcaaggtgctggagatcctgctgagcaccggcagcctggtgatccccgccaccggcgagcagctgaccctgcagaaggccttccagcagaacctggtgagcagcgccctgttcagcaaggtgctggagagacagaacatgtgcaaggacctgatcgacccctgcaccagcgagaaggtgagcctgatcgacatggtgcagagaagcaccctgcaggagaacaccggcatgtggctgctgcccgtgagaccccaggagggcggcagaatcaccctgaagtgcggcagaaacatcagcatcctgagagccgcccacgagggcctgatcgacagagagaccatgttcagactgctgagcgcccagctgctgagcggcggcctgatcaacagcaacagcggccagagaatgaccgtggaggaggccgtgagagagggcgtgatcgacagagacaccgccagcagcatcctgacctaccaggtgcagaccggcggcatcatccagagcaaccccgccaagagactgaccgtggacgaggccgtgcagtgcgacctgatcaccagcagcagcgccctgctggtgctggaggcccagagaggctacgtgggcctgatctggccccacagcggcgagatcttccccaccagcagcagcctgcagcaggagctgatcaccaacgagctggcctacaagatcctgaacggcagacagaagatcgccgccctgtacatccccgagagcagccaggtgatcggcctggacgccgccaagcagctgggcatcatcgacaacaacaccgccagcatcctgaagaacatcaccctgcccgacaagatgcccgacctgggcgacctggaggcctgcaagaacgccagaagatggctgagcttctgcaagttccagcccagcaccgtgcacgactacagacaggaggaggacgtgttcgacggcgaggagcccgtgaccacccagaccagcgaggagaccaagaagctgttcctgagctacctgatgatcaacagctacatggacgccaacaccggccagagactgctgctgtacgacggcgacctggacgaggccgtgggcatgctgctggagggctgccacgccgagttcgacggcaacaccgccatcaaggagtgcctggacgtgctgagcagcagcggcgtgttcctgaacaacgccagcggcagagagaaggacgagtgcaccgccacccccagcagcttcaacaagtgccactgcggcgagcccgagcacgaggagacccccgagaacagaaagtgcgccatcgacgaggagttcaacgagatgagaaacaccgtgatcaacagcgagttcagccagagcggcaagctggccagcaccatcagcatcgaccccaaggtgaacagcagccccagcgtgtgcgtgcccagcctgatcagctacctgacccagaccgagctggccgacatcagcatgctgagaagcgacagcgagaacatcctgaccaactacgagaaccagagcagagtggagaccaacgagagagccaacgagtgcagccacagcaagaacatccagaacttccccagcgacctgatcgagaaccccatcatgaagagcaagatgagcaagttctgcggcgtgaacgagaccgagaacgaggacaacaccaacagagacagccccatcttcgactacagccccagactgagcgccctgctgagccacgacaagctgatgcacagccagggcagcttcaacgacacccacacccccgagagcaacggcaacaagtgcgaggcccccgccctgagcttcagcgacaagaccatgctgagcggccagagaatcggcgagaagttccaggaccagttcctgggcatcgccgccatcaacatcagcctgcccggcgagcagtacggccagaagagcctgaacatgatcagcagcaacccccaggtgcagtaccacaacgacaagtacatcagcaacaccagcggcgaggacgagaagacccaccccggcttccagcagatgcccgaggacaaggaggacgagagcgagatcgaggagtacagctgcgccgtgacccccggcggcgacaccgacaacgccatcgtgagcctgacctgcgccacccccctgctggacgagaccatcagcgccagcgactacgagaccagcctgctgaacgaccagcagaacaacaccggcaccgacaccgacagcgacgacgacttctacgacacccccctgttcgaggacgacgaccacgacagcctgctgctggacggcgacgacagagactgcctgcaccccgaggactacgacaccctgcaggaggagaacgacgagaccgccagccccgccgacgtgttctacgacgtgagcaaggagaacgagaacagcatggtgccccagggcgcccccgtgggcagcctgagcgtgaagaacaaggcccactgcctgcaggacttcctgatggacgtggagaaggacgagctggacagcggcgagaagatccacctgaaccccgtgggcagcgacaaggtgaacggccagagcctggagaccggcagcgagagagagtgcaccaacatcctggagggcgacgagagcgacagcctgaccgactacgacatcgtgggcggcaaggagagcttcaccgccagcctgaagttcgacgacagcggcagctggagaggcagaaaggaggagtacgtgaccggccaggagttccacagcgacaccgaccacctggacagcatgcagagcgaggagagctacggcgactacatctacgacagcaacgaccaggacgacgacgacgacgacggcatcgacgaggagggcggcggcatcagagacgagaacggcaagcccagatgccagaacgtggccgaggacatggacatccagctgtgcgccagcatcctgaacgagaacagcgacgagaacgagaacatcaacaccatgatcctgctggacaagatgcacagctgcagcagcctggagaagcagcagagagtgaacgtggtgcagctggccagccccagcgagaacaacctggtgaccgagaagagcaacctgcccgagtacaccaccgagatcgccggcaagagcaaggagaacctgctgaaccacgagatggtgctgaaggacgtgctgccccccatcatcaaggacaccgagagcgagaagaccttcggccccgccagcatcagccacgacaacaacaacatcagcagcaccagcgagctgggcaccgacctggccaacaccaaggtgaagctgatccagggcagcgagctgcccgagctgaccgacagcgtgaagggcaaggacgagtacttcaagaacatgacccccaaggtggacagcagcctggaccacatcatctgcaccgagcccgacctgatcggcaagcccgccgaggagagccacctgagcctgatcgccagcgtgaccgacaaggacccccagggcaacggcagcgacctgatcaagggcagagacggcaagagcgacatcctgatcgaggacgagaccagcatccagaagatgtacctgggcgagggcgaggtgctggtggagggcctggtggaggaggagaacagacacctgaagctgctgcccggcaagaacaccagagacagcttcaagctgatcaacagccagttccccttcccccagatcaccaacaacgaggagctgaaccagaagggcagcctgaagaaggccaccgtgaccctgaaggacgagcccaacaacctgcagatcatcgtgagcaagagccccgtgcagttcgagaacctggaggagatcttcgacaccagcgtgagcaaggagatcagcgacgacatcaccagcgacatcaccagctgggagggcaacacccacttcgaggagagcttcaccgacggccccgagaaggagctggacctgttcacctacctgaagcactgcgccaagaacatcaaggccaaggacgtggccaagcccaacgaggacgtgcccagccacgtgctgatcaccgccccccccatgaaggagcacctgcagctgggcgtgaacaacaccaaggagaagagcaccagcacccagaaggacagccccctgaacgacatgatccagagcaacgacctgtgcagcaaggagagcatcagcggcggcggcaccgagatcagccagttcacccccgagagcatcgaggccaccctgagcatcctgagcagaaagcacgtggaggacgtgggcaagaacgacttcctgcagagcgagagatgcgccaacggcctgggcaacgacaacagcagcaacaccctgaacaccgactacagcttcctggagatcaacaacaagaaggagagaatcgagcagcagctgcccaaggagcaggccctgagccccagaagccaggagaaggaggtgcagatccccgagctgagccaggtgttcgtggaggacgtgaaggacatcctgaagagcagactgaaggagggccacatgaacccccaggaggtggaggagcccagcgcctgcgccgacaccaagatcctgatccagaacctgatcaagagaatcaccaccagccagctggtgaacgaggccagcaccgtgcccagcgacagccagatgagcgacagcagcggcgtgagccccatgaccaacagcagcgagctgaagcccgagagcagagacgaccccttctgcatcggcaacctgaagagcgagctgctgctgaacatcctgaagcaggaccagcacagccagaagatcaccggcgtgttcgagctgatgagagagctgacccacatggagtacgacctggagaagagaggcatcaccagcaaggtgctgcccctgcagctggagaacatcttctacaagctgctggccgacggctacagcgagaagatcgagcacgtgggcgacttcaaccagaaggcctgcagcaccagcgagatgatggaggagaagccccacatcctgggcgacatcaagagcaaggagggcaactactacagccccaacctggagaccgtgaaggagatcggcctggagagcagcaccgtgtgggccagcaccctgcccagagacgagaagctgaaggacctgtgcaacgacttccccagccacctggagtgcaccagcggcagcaaggagatggccagcggcgacagcagcaccgagcagttcagcagcgagctgcagcagtgcctgcagcacaccgagaagatgcacgagtacctgaccctgctgcaggacatgaagccccccctggacaaccaggagagcctggacaacaacctggaggccctgaagaaccagctgagacagctggagaccttcgagctgggcctggcccccatcgccgtgatcctgagaaaggacatgaagctggccgaggagttcctgaagagcctgcccagcgacttccccagaggccacgtggaggagctgagcatcagccaccagagcctgaagaccgccttcagcagcctgagcaacgtgagcagcgagagaaccaagcagatcatgctggccatcgacagcgagatgagcaagctggccgtgagccacgaggagttcctgcacaagctgaagagcttcagcgactgggtgagcgagaagagcaagagcgtgaaggacatcgagatcgtgaacgtgcaggacagcgagtacgtgaagaagagactggagttcctgaagaacgtgctgaaggacctgggccacaccaagatgcagctggagaccaccgccttcgacgtgcagttcttcatcagcgagtacgcccaggacctgagccccaaccagagcaagcagctgctgagactgctgaacaccacccagaagtgcttcctggacgtgcaggagagcgtgaccacccaggtggagagactggagacccagctgcacctggagcaggacctggacgaccagaagatcgtggccgagagacagcaggagtacaaggagaagctgcagggcatctgcgacctgctgacccagaccgagaacagactgatcggccaccaggaggccttcatgatcggcgacggcaccgtggagctgaagaagtaccagagcaagcaggaggagctgcagaaggacatgcagggcagcgcccaggccctggccgaggtggtgaagaacaccgagaacttcctgaaggagaacggcgagaagctgagccaggaggacaaggccctgatcgagcagaagctgaacgaggccaagatcaagtgcgagcagctgaacctgaaggccgagcagagcaagaaggagctggacaaggtggtgaccaccgccatcaaggaggagaccgagaaggtggccgccgtgaagcagctggaggagagcaagaccaagatcgagaacctgctggactggctgagcaacgtggacaaggacagcgagagagccggcaccaagcacaagcaggtgatcgagcagaacggcacccacttccaggagggcgacggcaagagcgccatcggcgaggaggacgaggtgaacggcaacctgctggagaccgacgtggacggccaggtgggcaccacccaggagaacctgaaccagcagtaccagaaggtgaaggcccagcacgagaagatcatcagccagcaccaggccgtgatcatcgccacccagagcgcccaggtgctgctggagaagcagggccagtacctgagccccgaggagaaggagaagctgcagaagaacatgaaggagctgaaggtgcactacgagaccgccctggccgagagcgagaagaagatgaagctgacccacagcctgcaggaggagctggagaagttcgacgccgactacaccgagttcgagcactggctgcagcagagcgagcaggagctggagaacctggaggccggcgccgacgacatcaacggcctgatgaccaagctgaagagacagaagagcttcagcgaggacgtgatcagccacaagggcgacctgagatacatcaccatcagcggcaacagagtgctggaggccgccaagagctgcagcaagagagacggcggcaaggtggacaccagcgccacccacagagaggtgcagagaaagctggaccacgccaccgacagattcagaagcctgtacagcaagtgcaacgtgctgggcaacaacctgaaggacctggtggacaagtaccagcactacgaggacgccagctgcggcctgctggccggcctgcaggcctgcgaggccaccgccagcaagcacctgagcgagcccatcgccgtggaccccaagaacctgcagagacagctggaggagaccaaggccctgcagggccagatcagcagccagcaggtggccgtggagaagctgaagaagaccgccgaggtgctgctggacgccagaggcagcctgctgcccgccaagaacgacatccagaagaccctggacgacatcgtgggcagatacgaggacctgagcaagagcgtgaacgagagaaacgagaagctgcagatcaccctgaccagaagcctgagcgtgcaggacggcctggacgagatgctggactggatgggcaacgtggagagcagcctgaaggagcaggacgtgggcaccggctactgcagaagcagcgagcagtacaagtgccacgagtag

SEQ ID NO: 79917 - DNA, 22386 bp, Artificial Sequence
  Description of Artificial Sequence: Synthetic coding sequence
atggccggctacctgagccccgccgcctacctgtacgtggaggagcaggagtacctgcaggcctacgaggacgtgctggagagatacaaggacgagagagacaaggtgcagaagaagaccttcaccaagtggatcaaccagcacctgatgaaggtgagaaagcacgtgaacgacctgtacgaggacctgagagacggccacaacctgatcagcctgctggaggtgctgagcggcgacaccctgcccagagagaagggcagaatgagattccacagactgcagaacgtgcagatcgccctggactacctgaagagaagacaggtgaagctggtgaacatcagaaacgacgacatcaccgacggcaaccccaagctgaccctgggcctgatctggaccatcatcctgcacttccagatcagcgacatccacgtgaccggcgagagcgaggacatgagcgccaaggagagactgctgctgtggacccagcaggccaccgagggctacgccggcatcagatgcgagaacttcaccacctgctggagagacggcaagctgttcaacgccatcatccacaagtacagacccgacctgatcgacatgaacaccgtggccgtgcagagcaacctggccaacctggagcacgccttctacgtggccgagaagatcggcgtgatcagactgctggaccccgaggacgtggacgtgagcagccccgacgagaagagcgtgatcacctacgtgagcagcctgtacgacgccttccccaaggtgcccgagggcggcgagggcatcggcgccaacgacgtggaggtgaagtggatcgagtaccagaacatggtgaactacctgatccagtggatcagacaccacgtgaccaccatgagcgagagaaccttccccaacaaccccgtggagctgaaggccctgtacaaccagtacctgcagttcaaggagaccgagatcccccccaaggagaccgagaagagcaagatcaagagactgtacaagctgctggagatctggatcgagttcggcagaatcaagctgctgcagggctaccaccccaacgacatcgagaaggagtggggcaagctgatcatcgccatgctggagagagagaaggccctgagacccgaggtggagagactggagatgctgcagcagatcgccaacagagtgcagagagacagcgtgatctgcgaggacaagctgatcctggccggcaacgccctgcagagcgacagcaagagactggagagcggcgtgcagttccagaacgaggccgagatcgccggctacatcctggagtgcgagaacctgctgagacagcacgtgatcgacgtgcagatcctgatcgacggcaagtactaccaggccgaccagctggtgcagagagtggccaagctgagagacgagatcatggccctgagaaacgagtgcagcagcgtgtacagcaagggcagaatcctgaccaccgagcagaccaagctgatgatcagcggcatcacccagagcctgaacagcggcttcgcccagaccctgcaccccagcctgaccagcggcctgacccagagcctgacccccagcctgaccagcagcagcatgaccagcggcctgagcagcggcatgaccagcagactgacccccagcgtgacccccgcctacacccccggcttccccagcggcctggtgcccaacttcagcagcggcgtggagcccaacagcctgcagaccctgaagctgatgcagatcagaaagcccctgctgaagagcagcctgctggaccagaacctgaccgaggaggagatcaacatgaagttcgtgcaggacctgctgaactgggtggacgagatgcaggtgcagctggacagaaccgagtggggcagcgacctgcccagcgtggagagccacctggagaaccacaagaacgtgcacagagccatcgaggagttcgagagcagcctgaaggaggccaagatcagcgagatccagatgaccgcccccctgaagctgacctacgccgagaagctgcacagactggagagccagtacgccaagctgctgaacaccagcagaaaccaggagagacacctggacaccctgcacaacttcgtgagcagagccaccaacgagctgatctggctgaacgagaaggaggaggaggaggtggcctacgactggagcgagagaaacaccaacatcgccagaaagaaggactaccacgccgagctgatgagagagctggaccagaaggaggagaacatcaagagcgtgcaggagatcgccgagcagctgctgctggagaaccaccccgccagactgaccatcgaggcctacagagccgccatgcagacccagtggagctggatcctgcagctgtgccagtgcgtggagcagcacatcaaggagaacaccgcctacttcgagttcttcaacgacgccaaggaggccaccgactacctgagaaacctgaaggacgccatccagagaaagtacagctgcgacagaagcagcagcatccacaagctggaggacctggtgcaggagagcatggaggagaaggaggagctgctgcagtacaagagcaccatcgccaacctgatgggcaaggccaagaccatcatccagctgaagcccagaaacagcgactgccccctgaagaccagcatccccatcaaggccatctgcgactacagacagatcgagatcaccatctacaaggacgacgagtgcgtgctggccaacaacagccacagagccaagtggaaggtgatcagccccaccggcaacgaggccatggtgcccagcgtgtgcttcaccgtgcccccccccaacaaggaggccgtggacctggccaacagaatcgagcagcagtaccagaacgtgctgaccctgtggcacgagagccacatcaacatgaagagcgtggtgagctggcactacctgatcaacgagatcgacagaatcagagccagcaacgtggccagcatcaagaccatgctgcccggcgagcaccagcaggtgctgagcaacctgcagagcagattcgaggacttcctggaggacagccaggagagccaggtgttcagcggcagcgacatcacccagctggagaaggaggtgaacgtgtgcaagcagtactaccaggagctgctgaagagcgccgagagagaggagcaggaggagagcgtgtacaacctgtacatcagcgaggtgagaaacatcagactgagactggagaactgcgaggacagactgatcagacagatcagaacccccctggagagagacgacctgcacgagagcgtgttcagaatcaccgagcaggagaagctgaagaaggagctggagagactgaaggacgacctgggcaccatcaccaacaagtgcgaggagttcttcagccaggccgccgccagcagcagcgtgcccaccctgagaagcgagctgaacgtggtgctgcagaacatgaaccaggtgtacagcatgagcagcacctacatcgacaagctgaagaccgtgaacctggtgctgaagaacacccaggccgccgaggccctggtgaagctgtacgagaccaagctgtgcgaggaggaggccgtgatcgccgacaagaacaacatcgagaacctgatcagcaccctgaagcagtggagaagcgaggtggacgagaagagacaggtgttccacgccctggaggacgagctgcagaaggccaaggccatcagcgacgagatgttcaagacctacaaggagagagacctggacttcgactggcacaaggagaaggccgaccagctggtggagagatggcagaacgtgcacgtgcagatcgacaacagactgagagacctggagggcatcggcaagagcctgaagtactacagagacacctaccaccccctggacgactggatccagcaggtggagaccacccagagaaagatccaggagaaccagcccgagaacagcaagaccctggccacccagctgaaccagcagaagatgctggtgagcgagatcgagatgaagcagagcaagatggacgagtgccagaagtacgccgagcagtacagcgccaccgtgaaggactacgagctgcagaccatgacctacagagccatggtggacagccagcagaagagccccgtgaagagaagaagaatgcagagcagcgccgacctgatcatccaggagttcatggacctgagaaccagatacaccgccctggtgaccctgatgacccagtacatcaagttcgccggcgacagcctgaagagactggaggaggaggagaagagcctggaggaggagaagaaggagcacgtggagaaggccaaggagctgcagaagtgggtgagcaacatcagcaagaccctgaaggacgccgagaaggccggcaagccccccttcagcaagcagaagatcagcagcgaggagatcagcaccaagaaggagcagctgagcgaggccctgcagaccatccagctgttcctggccaagcacggcgacaagatgaccgacgaggagagaaacgagctggagaagcaggtgaagaccctgcaggagagctacaacctgctgttcagcgagagcctgaagcagctgcaggagagccagaccagcggcgacgtgaaggtggaggagaagctggacaaggtgatcgccggcaccatcgaccagaccaccggcgaggtgctgagcgtgttccaggccgtgctgagaggcctgatcgactacgacaccggcatcagactgctggagacccagctgatgatcagcggcctgatcagccccgagctgagaaagtgcttcgacctgaaggacgccaagagccacggcctgatcgacgagcagatcctgtgccagctgaaggagctgagcaaggccaaggagatcatcagcgccgccagccccaccaccatccccgtgctggacgccctggcccagagcatgatcaccgagagcatggccatcaaggtgctggagatcctgctgagcaccggcagcctggtgatccccgccaccggcgagcagctgaccctgcagaaggccttccagcagaacctggtgagcagcgccctgttcagcaaggtgctggagagacagaacatgtgcaaggacctgatcgacccctgcaccagcgagaaggtgagcctgatcgacatggtgcagagaagcaccctgcaggagaacaccggcatgtggctgctgcccgtgagaccccaggagggcggcagaatcaccctgaagtgcggcagaaacatcagcatcctgagagccgcccacgagggcctgatcgacagagagaccatgttcagactgctgagcgcccagctgctgagcggcggcctgatcaacagcaacagcggccagagaatgaccgtggaggaggccgtgagagagggcgtgatcgacagagacaccgccagcagcatcctgacctaccaggtgcagaccggcggcatcatccagagcaaccccgccaagagactgaccgtggacgaggccgtgcagtgcgacctgatcaccagcagcagcgccctgctggtgctggaggcccagagaggctacgtgggcctgatctggccccacagcggcgagatcttccccaccagcagcagcctgcagcaggagctgatcaccaacgagctggcctacaagatcctgaacggcagacagaagatcgccgccctgtacatccccgagagcagccaggtgatcggcctggacgccgccaagcagctgggcatcatcgacaacaacaccgccagcatcctgaagaacatcaccctgcccgacaagatgcccgacctgggcgacctggaggcctgcaagaacgccagaagatggctgagcttctgcaagttccagcccagcaccgtgcacgactacagacaggaggaggacgtgttcgacggcgaggagcccgtgaccacccagaccagcgaggagaccaagaagctgttcctgagctacctgatgatcaacagctacatggacgccaacaccggccagagactgctgctgtacgacggcgacctggacgaggccgtgggcatgctgctggagggctgccacgccgagttcgacggcaacaccgccatcaaggagtgcctggacgtgctgagcagcagcggcgtgttcctgaacaacgccagcggcagagagaaggacgagtgcaccgccacccccagcagcttcaacaagtgccactgcggcgagcccgagcacgaggagacccccgagaacagaaagtgcgccatcgacgaggagttcaacgagatgagaaacaccgtgatcaacagcgagttcagccagagcggcaagctggccagcaccatcagcatcgaccccaaggtgaacagcagccccagcgtgtgcgtgcccagcctgatcagctacctgacccagaccgagctggccgacatcagcatgctgagaagcgacagcgagaacatcctgaccaactacgagaaccagagcagagtggagaccaacgagagagccaacgagtgcagccacagcaagaacatccagaacttccccagcgacctgatcgagaaccccatcatgaagagcaagatgagcaagttctgcggcgtgaacgagaccgagaacgaggacaacaccaacagagacagccccatcttcgactacagccccagactgagcgccctgctgagccacgacaagctgatgcacagccagggcagcttcaacgacacccacacccccgagagcaacggcaacaagtgcgaggcccccgccctgagcttcagcgacaagaccatgctgagcggccagagaatcggcgagaagttccaggaccagttcctgggcatcgccgccatcaacatcagcctgcccggcgagcagtacggccagaagagcctgaacatgatcagcagcaacccccaggtgcagtaccacaacgacaagtacatcagcaacaccagcggcgaggacgagaagacccaccccggcttccagcagatgcccgaggacaaggaggacgagagcgagatcgaggagtacagctgcgccgtgacccccggcggcgacaccgacaacgccatcgtgagcctgacctgcgccacccccctgctggacgagaccatcagcgccagcgactacgagaccagcctgctgaacgaccagcagaacaacaccggcaccgacaccgacagcgacgacgacttctacgacacccccctgttcgaggacgacgaccacgacagcctgctgctggacggcgacgacagagactgcctgcaccccgaggactacgacaccctgcaggaggagaacgacgagaccgccagccccgccgacgtgttctacgacgtgagcaaggagaacgagaacagcatggtgccccagggcgcccccgtgggcagcctgagcgtgaagaacaaggcccactgcctgcaggacttcctgatggacgtggagaaggacgagctggacagcggcgagaagatccacctgaaccccgtgggcagcgacaaggtgaacggccagagcctggagaccggcagcgagagagagtgcaccaacatcctggagggcgacgagagcgacagcctgaccgactacgacatcgtgggcggcaaggagagcttcaccgccagcctgaagttcgacgacagcggcagctggagaggcagaaaggaggagtacgtgaccggccaggagttccacagcgacaccgaccacctggacagcatgcagagcgaggagagctacggcgactacatctacgacagcaacgaccaggacgacgacgacgacgacggcatcgacgaggagggcggcggcatcagagacgagaacggcaagcccagatgccagaacgtggccgaggacatggacatccagctgtgcgccagcatcctgaacgagaacagcgacgagaacgagaacatcaacaccatgatcctgctggacaagatgcacagctgcagcagcctggagaagcagcagagagtgaacgtggtgcagctggccagccccagcgagaacaacctggtgaccgagaagagcaacctgcccgagtacaccaccgagatcgccggcaagagcaaggagaacctgctgaaccacgagatggtgctgaaggacgtgctgccccccatcatcaaggacaccgagagcgagaagaccttcggccccgccagcatcagccacgacaacaacaacatcagcagcaccagcgagctgggcaccgacctggccaacaccaaggtgaagctgatccagggcagcgagctgcccgagctgaccgacagcgtgaagggcaaggacgagtacttcaagaacatgacccccaaggtggacagcagcctggaccacatcatctgcaccgagcccgacctgatcggcaagcccgccgaggagagccacctgagcctgatcgccagcgtgaccgacaaggacccccagggcaacggcagcgacctgatcaagggcagagacggcaagagcgacatcctgatcgaggacgagaccagcatccagaagatgtacctgggcgagggcgaggtgctggtggagggcctggtggaggaggagaacagacacctgaagctgctgcccggcaagaacaccagagacagcttcaagctgatcaacagccagttccccttcccccagatcaccaacaacgaggagctgaaccagaagggcagcctgaagaaggccaccgtgaccctgaaggacgagcccaacaacctgcagatcatcgtgagcaagagccccgtgcagttcgagaacctggaggagatcttcgacaccagcgtgagcaaggagatcagcgacgacatcaccagcgacatcaccagctgggagggcaacacccacttcgaggagagcttcaccgacggccccgagaaggagctggacctgttcacctacctgaagcactgcgccaagaacatcaaggccaaggacgtggccaagcccaacgaggacgtgcccagccacgtgctgatcaccgccccccccatgaaggagcacctgcagctgggcgtgaacaacaccaaggagaagagcaccagcacccagaaggacagccccctgaacgacatgatccagagcaacgacctgtgcagcaaggagagcatcagcggcggcggcaccgagatcagccagttcacccccgagagcatcgaggccaccctgagcatcctgagcagaaagcacgtggaggacgtgggcaagaacgacttcctgcagagcgagagatgcgccaacggcctgggcaacgacaacagcagcaacaccctgaacaccgactacagcttcctggagatcaacaacaagaaggagagaatcgagcagcagctgcccaaggagcaggccctgagccccagaagccaggagaaggaggtgcagatccccgagctgagccaggtgttcgtggaggacgtgaaggacatcctgaagagcagactgaaggagggccacatgaacccccaggaggtggaggagcccagcgcctgcgccgacaccaagatcctgatccagaacctgatcaagagaatcaccaccagccagctggtgaacgaggccagcaccgtgcccagcgacagccagatgagcgacagcagcggcgtgagccccatgaccaacagcagcgagctgaagcccgagagcagagacgaccccttctgcatcggcaacctgaagagcgagctgctgctgaacatcctgaagcaggaccagcacagccagaagatcaccggcgtgttcgagctgatgagagagctgacccacatggagtacgacctggagaagagaggcatcaccagcaaggtgctgcccctgcagctggagaacatcttctacaagctgctggccgacggctacagcgagaagatcgagcacgtgggcgacttcaaccagaaggcctgcagcaccagcgagatgatggaggagaagccccacatcctgggcgacatcaagagcaaggagggcaactactacagccccaacctggagaccgtgaaggagatcggcctggagagcagcaccgtgtgggccagcaccctgcccagagacgagaagctgaaggacctgtgcaacgacttccccagccacctggagtgcaccagcggcagcaaggagatggccagcggcgacagcagcaccgagcagttcagcagcgagctgcagcagtgcctgcagcacaccgagaagatgcacgagtacctgaccctgctgcaggacatgaagccccccctggacaaccaggagagcctggacaacaacctggaggccctgaagaaccagctgagacagctggagaccttcgagctgggcctggcccccatcgccgtgatcctgagaaaggacatgaagctggccgaggagttcctgaagagcctgcccagcgacttccccagaggccacgtggaggagctgagcatcagccaccagagcctgaagaccgccttcagcagcctgagcaacgtgagcagcgagagaaccaagcagatcatgctggccatcgacagcgagatgagcaagctggccgtgagccacgaggagttcctgcacaagctgaagagcttcagcgactgggtgagcgagaagagcaagagcgtgaaggacatcgagatcgtgaacgtgcaggacagcgagtacgtgaagaagagactggagttcctgaagaacgtgctgaaggacctgggccacaccaagatgcagctggagaccaccgccttcgacgtgcagttcttcatcagcgagtacgcccaggacctgagccccaaccagagcaagcagctgctgagactgctgaacaccacccagaagtgcttcctggacgtgcaggagagcgtgaccacccaggtggagagactggagacccagctgcacctggagcaggacctggacgaccagaagatcgtggccgagagacagcaggagtacaaggagaagctgcagggcatctgcgacctgctgacccagaccgagaacagactgatcggccaccaggaggccttcatgatcggcgacggcaccgtggagctgaagaagtaccagagcaagcaggaggagctgcagaaggacatgcagggcagcgcccaggccctggccgaggtggtgaagaacaccgagaacttcctgaaggagaacggcgagaagctgagccaggaggacaaggccctgatcgagcagaagctgaacgaggccaagatcaagtgcgagcagctgaacctgaaggccgagcagagcaagaaggagctggacaaggtggtgaccaccgccatcaaggaggagaccgagaaggtggccgccgtgaagcagctggaggagagcaagaccaagatcgagaacctgctggactggctgagcaacgtggacaaggacagcgagagagccggcaccaagcacaagcaggtgatcgagcagaacggcacccacttccaggagggcgacggcaagagcgccatcggcgaggaggacgaggtgaacggcaacctgctggagaccgacgtggacggccaggtgggcaccacccaggagaacctgaaccagcagtaccagaaggtgaaggcccagcacgagaagatcatcagccagcaccaggccgtgatcatcgccacccagagcgcccaggtgctgctggagaagcagggccagtacctgagccccgaggagaaggagaagctgcagaagaacatgaaggagctgaaggtgcactacgagaccgccctggccgagagcgagaagaagatgaagctgacccacagcctgcaggaggagctggagaagttcgacgccgactacaccgagttcgagcactggctgcagcagagcgagcaggagctggagaacctggaggccggcgccgacgacatcaacggcctgatgaccaagctgaagagacagaagagcttcagcgaggacgtgatcagccacaagggcgacctgagatacatcaccatcagcggcaacagagtgctggaggccgccaagagctgcagcaagagagacggcggcaaggtggacaccagcgccacccacagagaggtgcagagaaagctggaccacgccaccgacagattcagaagcctgtacagcaagtgcaacgtgctgggcaacaacctgaaggacctggtggacaagtaccagcactacgaggacgccagctgcggcctgctggccggcctgcaggcctgcgaggccaccgccagcaagcacctgagcgagcccatcgccgtggaccccaagaacctgcagagacagctggaggagaccaaggccctgcagggccagatcagcagccagcaggtggccgtggagaagctgaagaagaccgccgaggtgctgctggacgccagaggcagcctgctgcccgccaagaacgacatccagaagaccctggacgacatcgtgggcagatacgaggacctgagcaagagcgtgaacgagagaaacgagaagctgcagatcaccctgaccagaagcctgagcgtgcaggacggcctggacgagatgctggactggatgggcaacgtggagagcagcctgaaggagcagggccaggtgcccctgaacagcaccgccctgcaggacatcatcagcaagaacatcatgctggagcaggacatcgccggcagacagagcagcatcaacgccatgaacgagaaggtgaagaagttcatggagaccaccgaccccagcaccgccagcagcctgcaggccaagatgaaggacctgagcgccagattcagcgaggccagccacaagcacaaggagaccctggccaagatggaggagctgaagaccaaggtggagctgttcgagaacctgagcgagaagctgcagaccttcctggagaccaagacccaggccctgaccgaggtggacgtgcccggcaaggacgtgaccgagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggacgccttccaggtgctggtgaagagcctgaagagctggatcaaggagaccaccaagaaggtgcccatcgtgcagcccagcttcggcgccgaggacctgggcaagagcctggaggacaccaagaagctgcaggagaagtggagcctgaagacccccgagatccagaaggtgaacaacagcggcatcagcctgtgcaacctgatcagcgccgtgaccacccccgccaaggccatcgccgccgtgaagagcggcggcgccgtgctgaacggcgagggcaccgccaccaacaccgaggagttctgggccaacaagggcctgaccagcatcaagaaggacatgaccgacatcagccacggctacgaggacctgggcctgctgctgaaggacaagatcgccgagctgaacaccaagctgagcaagctgcagaaggcccaggaggagagcagcgccatgatgcagtggctgcagaagatgaacaagaccgccaccaagtggcagcagacccccgcccccaccgacaccgaggccgtgaagacccaggtggagcagaacaagagcttcgaggccgagctgaagcagaacgtgaacaaggtgcaggagctgaaggacaagctgaccgagctgctggaggagaaccccgacacccccgaggcccccagatggaagcagatgctgaccgagatcgacagcaagtggcaggagctgaaccagctgaccatcgacagacagcagaagctggaggagagcagcaacaacctgacccagttccagaccgtggaggcccagctgaagcagtggctggtggagaaggagctgatggtgagcgtgctgggccccctgagcatcgaccccaacatgctgaacacccagagacagcaggtgcagatcctgctgcaggagttcgccaccagaaagccccagtacgagcagctgaccgccgccggccagggcatcctgagcagacccggcgaggaccccagcctgagaggcatcgtgaaggagcagctggccgccgtgacccagaagtgggacagcctgaccggccagctgagcgacagatgcgactggatcgaccaggccatcgtgaagagcacccagtaccagagcctgctgagaagcctgagcgacaagctgagcgacctggacaacaagctgagcagcagcctggccgtgagcacccaccccgacgccatgaaccagcagctggagaccgcccagaagatgaagcaggagatccagcaggagaagaagcagatcaaggtggcccaggccctgtgcgaggacctgagcgccctggtgaaggaggagtacctgaaggccgagctgagcagacagctggagggcatcctgaagagcttcaaggacgtggagcagaaggccgagaaccacgtgcagcacctgcagagcgcctgcgccagcagccaccagttccagcagatgagcagagacttccaggcctggctggacaccaagaaggaggagcagaacaagagccaccccatcagcgccaagctggacgtgctggagagcctgatcaaggaccacaaggacttcagcaagaccctgaccgcccagagccacatgtacgagaagaccatcgccgagggcgagaacctgctgctgaagacccagggcagcgagaaggccgccctgcagctgcagctgaacaccatcaagaccaactgggacaccttcaacaagcaggtgaaggagagagagaacaagctgaaggagagcctggagaaggccctgaagtacaaggagcaggtggagaccctgtggccctggatcgacaagtgccagaacaacctggaggagatcaagttctgcctggaccccgccgagggcgagaacagcatcgccaagctgaagagcctgcagaaggagatggaccagcacttcggcatggtggagctgctgaacaacaccgccaacagcctgctgagcgtgtgcgagatcgacaaggaggtggtgaccgacgagaacaagagcctgatccagaaggtggacatggtgaccgagcagctgcacagcaagaagttctgcctggagaacatgacccagaagttcaaggagttccaggaggtgagcaaggagagcaagagacagctgcagtgcgccaaggagcagctggacatccacgacagcctgggcagccaggcctacagcaacaagtacctgaccatgctgcagacccagcagaagagcctgcaggccctgaagcaccaggtggacctggccaagagactggcccaggacctggtggtggaggccagcgacagcaagggcaccagcgacgtgctgctgcaggtggagaccatcgcccaggagcacagcaccctgagccagcaggtggacgagaagtgcagcttcctggagaccaagctgcagggcatcggccacttccagaacaccatcagagagatgttcagccagttcgccgagttcgacgacgagctggacagcatggcccccgtgggcagagacgccgagaccctgcagaagcagaaggagaccatcaaggccttcctgaagaagctggaggccctgatggccagcaacgacaacgccaacaagacctgcaagatgatgctggccaccgaggagaccagccccgacctggtgggcatcaagagagacctggaggccctgagcaagcagtgcaacaagctgctggacagagcccaggccagagaggagcaggtggagggcaccatcaagagactggaggagttctacagcaagctgaaggagttcagcatcctgctgcagaaggccgaggagcacgaggagagccagggccccgtgggcatggagaccgagaccatcaaccagcagctgaacatgttcaaggtgttccagaaggaggagatcgagcccctgcagggcaagcagcaggacgtgaactggctgggccagggcctgatccagagcgccgccaagagcaccagcacccagggcctggagcacgacctggacgacgtgaacgccagatggaagaccctgaacaagaaggtggcccagagagccgcccagctgcaggaggccctgctgcactgcggcagattccaggacgccctggagagcctgctgagctggatggtggacaccgaggagctggtggccaaccagaagccccccagcgccgagttcaaggtggtgaaggcccagatccaggagcagaagctgctgcagagactgctggacgacagaaagagcaccgtggaggtgatcaagagagagggcgagaagatcgccaccaccgccgagcccgccgacaaggtgaagatcctgaagcagctgagcctgctggacagcagatgggaggccctgctgaacaaggccgagaccagaaacagacagctggagggcatcagcgtggtggcccagcagttccacgagaccctggagcccctgaacgagtggctgaccaccatcgagaagagactggtgaactgcgagcccatcggcacccaggccagcaagctggaggagcagatcgcccagcacaaggtgctgcaggaggacatcctgctgagaaagcagaacgtggaccaggccctgctgaacggcctggagctgctgaagcagaccaccggcgacgaggtgctgatcatccaggacaagctggaggccatcaaggccagatacaaggacatcaccaagctgagcaccgacgtggccaagaccctggagcaggccctgcagctggccagaagactgcacagcacccacgaggagctgtgcacctggctggacaaggtggaggtggagctgctgagctacgagacccaggtgctgaagggcgaggaggccagccaggcccagatgagacccaaggagctgaagaaggaggccaagaacaacaaggccctgctggacagcctgaacgaggtgagcagcgccctgctggagctggtgccctggagagccagagagggcctggagaagatggtggccgaggacaacgagagatacagactggtgagcgacaccatcacccagaaggtggaggagatcgacgccgccatcctgagaagccagcagttcgaccaggccgccgacgccgagctgagctggatcaccgagaccgagaagaagctgatgagcctgggcgacatcagactggagcaggaccagaccagcgcccagctgcaggtgcagaagaccttcaccatggagatcctgagacacaaggacatcatcgacgacctggtgaagagcggccacaagatcatgaccgcctgcagcgaggaggagaagcagagcatgaagaagaagctggacaaggtgctgaagaactacgacaccatctgccagatcaacagcgagagatacctgcagctggagagagcccagagcctggtgaaccagttctgggagacctacgaggagctgtggccctggctgaccgagacccagagcatcatcagccagctgcccgcccccgccctggagtacgagaccctgagacagcagcaggaggagcacagacagctgagagagctgatcgccgagcacaagccccacatcgacaagatgaacaagaccggcccccagctgctggagctgagccccggcgagggcttcagcatccaggagaagtacgtggccgccgacaccctgtacagccagatcaaggaggacgtgaagaagagagccgtggccctggacgaggccatcagccagagcacccagttccacgacaagatcgaccagatcctggagagcctggagagaatcgtggagagactgagacagccccccagcatcagcgccgaggtggagaagatcaaggagcagatcagcgagaacaagaacgtgagcgtggacatggagaagctgcagcccctgtacgagaccctgaagcagagaggcgaggagatgatcgccagaagcggcggcaccgacaaggacatcagcgccaaggccgtgcaggacaagctggaccagatggtgttcatctgggagaacatccacaccctggtggaggagagagaggccaagctgctggacgtgatggagctggccgagaagttctggtgcgaccacatgagcctgatcgtgaccatcaaggacacccaggacttcatcagagacctggaggaccccggcatcgaccccagcgtggtgaagcagcagcaggaggccgccgagaccatcagagaggagatcgacggcctgcaggaggagctggacatcgtgatcaacctgggcagcgagctgatcgccgcctgcggcgagcccgacaagcccatcgtgaagaagagcatcgacgagctgaacagcgcctgggacagcctgaacaaggcctggaaggacagaatcgacaagctggaggaggccatgcaggccgccgtgcagtaccaggacggcctgcaggccgtgttcgactgggtggacatcgccggcggcaagctggccagcatgagccccatcggcaccgacctggagaccgtgaagcagcagatcgaggagctgaagcagttcaagagcgaggcctaccagcagcagatcgagatggagagactgaaccaccaggccgagctgctgctgaagaaggtgaccgaggagagcgacaagcacaccgtgcaggaccccctgatggagctgaagctgatctgggacagcctggaggagagaatcatcaacagacagcacaagctggagggcgccctgctggccctgggccagttccagcacgccctggacgagctgctggcctggctgacccacaccgagggcctgctgagcgagcagaagcccgtgggcggcgaccccaaggccatcgagatcgagctggccaagcaccacgtgctgcagaacgacgtgctggcccaccagagcaccgtggaggccgtgaacaaggccggcaacgacctgatcgagagcagcgccggcgaggaggccagcaacctgcagaacaagctggaggtgctgaaccagagatggcagaacgtgctggagaagaccgagcagagaaagcagcagctggacggcgccctgagacaggccaagggcttccacggcgagatcgaggacctgcagcagtggctgaccgacaccgagagacacctgctggccagcaagcccctgggcggcctgcccgagaccgccaaggagcagctgaacgtgcacatggaggtgtgcgccgccttcgaggccaaggaggagacctacaagagcctgatgcagaagggccagcagatgctggccagatgccccaagagcgccgagaccaacatcgaccaggacatcaacaacctgaaggagaagtgggagagcgtggagaccaagctgaacgagagaaagaccaagctggaggaggccctgaacctggccatggagttccacaacagcctgcaggacttcatcaactggctgacccaggccgagcagaccctgaacgtggccagcagacccagcctgatcctggacaccgtgctgttccagatcgacgagcacaaggtgttcgccaacgaggtgaacagccacagagagcagatcatcgagctggacaagaccggcacccacctgaagtacttcagccagaagcaggacgtggtgctgatcaagaacctgctgatcagcgtgcagagcagatgggagaaggtggtgcagagactggtggagagaggcagaagcctggacgacgccagaaagagagccaagcagttccacgaggcctggagcaagctgatggagtggctggaggagagcgagaagagcctggacagcgagctggagatcgccaacgaccccgacaagatcaagacccagctggcccagcacaaggagttccagaagagcctgggcgccaagcacagcgtgtacgacaccaccaacagaaccggcagaagcctgaaggagaagaccagcctggccgacgacaacctgaagctggacgacatgctgagcgagctgagagacaagtgggacaccatctgcggcaagagcgtggagagacagaacaagctggaggaggccctgctgttcagcggccagttcaccgacgccctgcaggccctgatcgactggctgtacagagtggagccccagctggccgaggaccagcccgtgcacggcgacatcgacctggtgatgaacctgatcgacaaccacaaggccttccagaaggagctgggcaagagaaccagcagcgtgcaggccctgaagagaagcgccagagagctgatcgagggcagcagagacgacagcagctgggtgaaggtgcagatgcaggagctgagcaccagatgggagaccgtgtgcgccctgagcatcagcaagcagaccagactggaggccgccctgagacaggccgaggagttccacagcgtggtgcacgccctgctggagtggctggccgaggccgagcagaccctgagattccacggcgtgctgcccgacgacgaggacgccctgagaaccctgatcgaccagcacaaggagttcatgaagaagctggaggagaagagagccgagctgaacaaggccaccaccatgggcgacaccgtgctggccatctgccaccccgacagcatcaccaccatcaagcactggatcaccatcatcagagccagattcgaggaggtgctggcctgggccaagcagcaccagcagagactggccagcgccctggccggcctgatcgccaagcaggagctgctggaggccctgctggcctggctgcagtgggccgagaccaccctgaccgacaaggacaaggaggtgatcccccaggagatcgaggaggtgaaggccctgatcgccgagcaccagaccttcatggaggagatgaccagaaagcagcccgacgtggacaaggtgaccaagacctacaagagaagagccgccgaccccagcagcctgcagagccacatccccgtgctggacaagggcagagccggcagaaagagattccccgccagcagcctgtaccccagcggcagccagacccagatcgagaccaagaaccccagagtgaacctgctggtgagcaagtggcagcaggtgtggctgctggccctggagagaagaagaaagctgaacgacgccctggacagactggaggagctgagagagttcgccaacttcgacttcgacatctggagaaagaagtacatgagatggatgaaccacaagaagagcagagtgatggacttcttcagaagaatcgacaaggaccaggacggcaagatcaccagacaggagttcatcgacggcatcctgagcagcaagttccccaccagcagactggagatgagcgccgtggccgacatcttcgacagagacggcgacggctacatcgactactacgagttcgtggccgccctgcaccccaacaaggacgcctacaagcccatcaccgacgccgacaagatcgaggacgaggtgaccagacaggtggccaagtgcaagtgcgccaagagattccaggtggagcagatcggcgacaacaagtacagattcttcctgggcaaccagttcggcgacagccagcagctgagactggtgagaatcctgagaagcaccgtgatggtgagagtgggcggcggctggatggccctggacgagttcctggtgaagaacgacccctgcagagtgcaccaccacggcagcaagatgctgagaagcgagagcaacagcagcatcaccaccacccagcccaccatcgccaagggcagaaccaacatggagctgagagagaagttcatcctggccgacggcgccagccagggcatggccgccttcagacccagaggcagaagaagcagacccagcagcagaggcgccagccccaacagaagcaccagcgtgagcagccaggccgcccaggccgccagcccccaggtgcccgccaccaccacccccaagggcacccccatccagggcagcaagctgagactgcccggctacctgagcggcaagggcttccacagcggcgaggacagcggcctgatcaccaccgccgccgccagagtgagaacccagttcgccgacagcaagaagacccccagcagacccggcagcagagccggcagcaaggccggcagcagagccagcagcagaagaggcagcgacgccagcgacttcgacatcagcgagatccagagcgtgtgcagcgacgtggagaccgtgccccagacccacagacccacccccagagccggcagcagacccagcaccgccaagcccagcaagatccccaccccccagagaaagagccccgccagcaagctggacaagagcagcaagagatag

SEQ ID NO: 79918 - DNA, 23253 bp, Artificial Sequence
  Description of Artificial Sequence: Synthetic coding sequence
atgatcgccgccgccttcctggtgctgctgagaccctacagcatccagtgcgccctgttcctgctgctgctgctgctgggcaccatcgccaccatcgtgttcttctgctgctggcacagaaagctgcagaagggcagacaccccatgaagagcgtgttcagcggcagaagcagaagcagagacgccgtgctgagaagccaccacttcagaagcgagggcttcagagccagccccagacacctgagaagaagagtggccgccgccgccgccgccagactggaggaggtgaagcccgtggtggaggtgcaccaccagagcgagcaggagaccagcgtgagaaagagaagaatcaagaagagcagcagagtgcagcccgagttctaccacagcgtgcagggcgccagcatcagaagacccagcagcggcaacgccagctacagatgcagcatgagcagcagcgccgacttcagcgacgaggacgacttcagccagaagagcggcagcgccagccccgcccccggcgacaccctgccctggaacctgcccaagcacgagagaagcaagagaaagatccagggcggcagcgtgctggaccccgccgagagagccgtgctgagaatcgccgacgagagagacaaggtgcagaagaagaccttcaccaagtggatcaaccagcacctgatgaaggtgagaaagcacgtgaacgacctgtacgaggacctgagagacggccacaacctgatcagcctgctggaggtgctgagcggcgacaccctgcccagagagaagggcagaatgagattccacagactgcagaacgtgcagatcgccctggactacctgaagagaagacaggtgaagctggtgaacatcagaaacgacgacatcaccgacggcaaccccaagctgaccctgggcctgatctggaccatcatcctgcacttccagatcagcgacatccacgtgaccggcgagagcgaggacatgagcgccaaggagagactgctgctgtggacccagcaggccaccgagggctacgccggcatcagatgcgagaacttcaccacctgctggagagacggcaagctgttcaacgccatcatccacaagtacagacccgacctgatcgacatgaacaccgtggccgtgcagagcaacctggccaacctggagcacgccttctacgtggccgagaagatcggcgtgatcagactgctggaccccgaggacgtggacgtgagcagccccgacgagaagagcgtgatcacctacgtgagcagcctgtacgacgccttccccaaggtgcccgagggcggcgagggcatcggcgccaacgacgtggaggtgaagtggatcgagtaccagaacatggtgaactacctgatccagtggatcagacaccacgtgaccaccatgagcgagagaaccttccccaacaaccccgtggagctgaaggccctgtacaaccagtacctgcagttcaaggagaccgagatcccccccaaggagaccgagaagagcaagatcaagagactgtacaagctgctggagatctggatcgagttcggcagaatcaagctgctgcagggctaccaccccaacgacatcgagaaggagtggggcaagctgatcatcgccatgctggagagagagaaggccctgagacccgaggtggagagactggagatgctgcagcagatcgccaacagagtgcagagagacagcgtgatctgcgaggacaagctgatcctggccggcaacgccctgcagagcgacagcaagagactggagagcggcgtgcagttccagaacgaggccgagatcgccggctacatcctggagtgcgagaacctgctgagacagcacgtgatcgacgtgcagatcctgatcgacggcaagtactaccaggccgaccagctggtgcagagagtggccaagctgagagacgagatcatggccctgagaaacgagtgcagcagcgtgtacagcaagggcagaatcctgaccaccgagcagaccaagctgatgatcagcggcatcacccagagcctgaacagcggcttcgcccagaccctgcaccccagcctgaccagcggcctgacccagagcctgacccccagcctgaccagcagcagcatgaccagcggcctgagcagcggcatgaccagcagactgacccccagcgtgacccccgcctacacccccggcttccccagcggcctggtgcccaacttcagcagcggcgtggagcccaacagcctgcagaccctgaagctgatgcagatcagaaagcccctgctgaagagcagcctgctggaccagaacctgaccgaggaggagatcaacatgaagttcgtgcaggacctgctgaactgggtggacgagatgcaggtgcagctggacagaaccgagtggggcagcgacctgcccagcgtggagagccacctggagaaccacaagaacgtgcacagagccatcgaggagttcgagagcagcctgaaggaggccaagatcagcgagatccagatgaccgcccccctgaagctgacctacgccgagaagctgcacagactggagagccagtacgccaagctgctgaacaccagcagaaaccaggagagacacctggacaccctgcacaacttcgtgagcagagccaccaacgagctgatctggctgaacgagaaggaggaggaggaggtggcctacgactggagcgagagaaacaccaacatcgccagaaagaaggactaccacgccgagctgatgagagagctggaccagaaggaggagaacatcaagagcgtgcaggagatcgccgagcagctgctgctggagaaccaccccgccagactgaccatcgaggcctacagagccgccatgcagacccagtggagctggatcctgcagctgtgccagtgcgtggagcagcacatcaaggagaacaccgcctacttcgagttcttcaacgacgccaaggaggccaccgactacctgagaaacctgaaggacgccatccagagaaagtacagctgcgacagaagcagcagcatccacaagctggaggacctggtgcaggagagcatggaggagaaggaggagctgctgcagtacaagagcaccatcgccaacctgatgggcaaggccaagaccatcatccagctgaagcccagaaacagcgactgccccctgaagaccagcatccccatcaaggccatctgcgactacagacagatcgagatcaccatctacaaggacgacgagtgcgtgctggccaacaacagccacagagccaagtggaaggtgatcagccccaccggcaacgaggccatggtgcccagcgtgtgcttcaccgtgcccccccccaacaaggaggccgtggacctggccaacagaatcgagcagcagtaccagaacgtgctgaccctgtggcacgagagccacatcaacatgaagagcgtggtgagctggcactacctgatcaacgagatcgacagaatcagagccagcaacgtggccagcatcaagaccatgctgcccggcgagcaccagcaggtgctgagcaacctgcagagcagattcgaggacttcctggaggacagccaggagagccaggtgttcagcggcagcgacatcacccagctggagaaggaggtgaacgtgtgcaagcagtactaccaggagctgctgaagagcgccgagagagaggagcaggaggagagcgtgtacaacctgtacatcagcgaggtgagaaacatcagactgagactggagaactgcgaggacagactgatcagacagatcagaacccccctggagagagacgacctgcacgagagcgtgttcagaatcaccgagcaggagaagctgaagaaggagctggagagactgaaggacgacctgggcaccatcaccaacaagtgcgaggagttcttcagccaggccgccgccagcagcagcgtgcccaccctgagaagcgagctgaacgtggtgctgcagaacatgaaccaggtgtacagcatgagcagcacctacatcgacaagctgaagaccgtgaacctggtgctgaagaacacccaggccgccgaggccctggtgaagctgtacgagaccaagctgtgcgaggaggaggccgtgatcgccgacaagaacaacatcgagaacctgatcagcaccctgaagcagtggagaagcgaggtggacgagaagagacaggtgttccacgccctggaggacgagctgcagaaggccaaggccatcagcgacgagatgttcaagacctacaaggagagagacctggacttcgactggcacaaggagaaggccgaccagctggtggagagatggcagaacgtgcacgtgcagatcgacaacagactgagagacctggagggcatcggcaagagcctgaagtactacagagacacctaccaccccctggacgactggatccagcaggtggagaccacccagagaaagatccaggagaaccagcccgagaacagcaagaccctggccacccagctgaaccagcagaagatgctggtgagcgagatcgagatgaagcagagcaagatggacgagtgccagaagtacgccgagcagtacagcgccaccgtgaaggactacgagctgcagaccatgacctacagagccatggtggacagccagcagaagagccccgtgaagagaagaagaatgcagagcagcgccgacctgatcatccaggagttcatggacctgagaaccagatacaccgccctggtgaccctgatgacccagtacatcaagttcgccggcgacagcctgaagagactggaggaggaggagaagagcctggaggaggagaagaaggagcacgtggagaaggccaaggagctgcagaagtgggtgagcaacatcagcaagaccctgaaggacgccgagaaggccggcaagccccccttcagcaagcagaagatcagcagcgaggagatcagcaccaagaaggagcagctgagcgaggccctgcagaccatccagctgttcctggccaagcacggcgacaagatgaccgacgaggagagaaacgagctggagaagcaggtgaagaccctgcaggagagctacaacctgctgttcagcgagagcctgaagcagctgcaggagagccagaccagcggcgacgtgaaggtggaggagaagctggacaaggtgatcgccggcaccatcgaccagaccaccggcgaggtgctgagcgtgttccaggccgtgctgagaggcctgatcgactacgacaccggcatcagactgctggagacccagctgatgatcagcggcctgatcagccccgagctgagaaagtgcttcgacctgaaggacgccaagagccacggcctgatcgacgagcagatcctgtgccagctgaaggagctgagcaaggccaaggagatcatcagcgccgccagccccaccaccatccccgtgctggacgccctggcccagagcatgatcaccgagagcatggccatcaaggtgctggagatcctgctgagcaccggcagcctggtgatccccgccaccggcgagcagctgaccctgcagaaggccttccagcagaacctggtgagcagcgccctgttcagcaaggtgctggagagacagaacatgtgcaaggacctgatcgacccctgcaccagcgagaaggtgagcctgatcgacatggtgcagagaagcaccctgcaggagaacaccggcatgtggctgctgcccgtgagaccccaggagggcggcagaatcaccctgaagtgcggcagaaacatcagcatcctgagagccgcccacgagggcctgatcgacagagagaccatgttcagactgctgagcgcccagctgctgagcggcggcctgatcaacagcaacagcggccagagaatgaccgtggaggaggccgtgagagagggcgtgatcgacagagacaccgccagcagcatcctgacctaccaggtgcagaccggcggcatcatccagagcaaccccgccaagagactgaccgtggacgaggccgtgcagtgcgacctgatcaccagcagcagcgccctgctggtgctggaggcccagagaggctacgtgggcctgatctggccccacagcggcgagatcttccccaccagcagcagcctgcagcaggagctgatcaccaacgagctggcctacaagatcctgaacggcagacagaagatcgccgccctgtacatccccgagagcagccaggtgatcggcctggacgccgccaagcagctgggcatcatcgacaacaacaccgccagcatcctgaagaacatcaccctgcccgacaagatgcccgacctgggcgacctggaggcctgcaagaacgccagaagatggctgagcttctgcaagttccagcccagcaccgtgcacgactacagacaggaggaggacgtgttcgacggcgaggagcccgtgaccacccagaccagcgaggagaccaagaagctgttcctgagctacctgatgatcaacagctacatggacgccaacaccggccagagactgctgctgtacgacggcgacctggacgaggccgtgggcatgctgctggagggctgccacgccgagttcgacggcaacaccgccatcaaggagtgcctggacgtgctgagcagcagcggcgtgttcctgaacaacgccagcggcagagagaaggacgagtgcaccgccacccccagcagcttcaacaagtgccactgcggcgagcccgagcacgaggagacccccgagaacagaaagtgcgccatcgacgaggagttcaacgagatgagaaacaccgtgatcaacagcgagttcagccagagcggcaagctggccagcaccatcagcatcgaccccaaggtgaacagcagccccagcgtgtgcgtgcccagcctgatcagctacctgacccagaccgagctggccgacatcagcatgctgagaagcgacagcgagaacatcctgaccaactacgagaaccagagcagagtggagaccaacgagagagccaacgagtgcagccacagcaagaacatccagaacttccccagcgacctgatcgagaaccccatcatgaagagcaagatgagcaagttctgcggcgtgaacgagaccgagaacgaggacaacaccaacagagacagccccatcttcgactacagccccagactgagcgccctgctgagccacgacaagctgatgcacagccagggcagcttcaacgacacccacacccccgagagcaacggcaacaagtgcgaggcccccgccctgagcttcagcgacaagaccatgctgagcggccagagaatcggcgagaagttccaggaccagttcctgggcatcgccgccatcaacatcagcctgcccggcgagcagtacggccagaagagcctgaacatgatcagcagcaacccccaggtgcagtaccacaacgacaagtacatcagcaacaccagcggcgaggacgagaagacccaccccggcttccagcagatgcccgaggacaaggaggacgagagcgagatcgaggagtacagctgcgccgtgacccccggcggcgacaccgacaacgccatcgtgagcctgacctgcgccacccccctgctggacgagaccatcagcgccagcgactacgagaccagcctgctgaacgaccagcagaacaacaccggcaccgacaccgacagcgacgacgacttctacgacacccccctgttcgaggacgacgaccacgacagcctgctgctggacggcgacgacagagactgcctgcaccccgaggactacgacaccctgcaggaggagaacgacgagaccgccagccccgccgacgtgttctacgacgtgagcaaggagaacgagaacagcatggtgccccagggcgcccccgtgggcagcctgagcgtgaagaacaaggcccactgcctgcaggacttcctgatggacgtggagaaggacgagctggacagcggcgagaagatccacctgaaccccgtgggcagcgacaaggtgaacggccagagcctggagaccggcagcgagagagagtgcaccaacatcctggagggcgacgagagcgacagcctgaccgactacgacatcgtgggcggcaaggagagcttcaccgccagcctgaagttcgacgacagcggcagctggagaggcagaaaggaggagtacgtgaccggccaggagttccacagcgacaccgaccacctggacagcatgcagagcgaggagagctacggcgactacatctacgacagcaacgaccaggacgacgacgacgacgacggcatcgacgaggagggcggcggcatcagagacgagaacggcaagcccagatgccagaacgtggccgaggacatggacatccagctgtgcgccagcatcctgaacgagaacagcgacgagaacgagaacatcaacaccatgatcctgctggacaagatgcacagctgcagcagcctggagaagcagcagagagtgaacgtggtgcagctggccagccccagcgagaacaacctggtgaccgagaagagcaacctgcccgagtacaccaccgagatcgccggcaagagcaaggagaacctgctgaaccacgagatggtgctgaaggacgtgctgccccccatcatcaaggacaccgagagcgagaagaccttcggccccgccagcatcagccacgacaacaacaacatcagcagcaccagcgagctgggcaccgacctggccaacaccaaggtgaagctgatccagggcagcgagctgcccgagctgaccgacagcgtgaagggcaaggacgagtacttcaagaacatgacccccaaggtggacagcagcctggaccacatcatctgcaccgagcccgacctgatcggcaagcccgccgaggagagccacctgagcctgatcgccagcgtgaccgacaaggacccccagggcaacggcagcgacctgatcaagggcagagacggcaagagcgacatcctgatcgaggacgagaccagcatccagaagatgtacctgggcgagggcgaggtgctggtggagggcctggtggaggaggagaacagacacctgaagctgctgcccggcaagaacaccagagacagcttcaagctgatcaacagccagttccccttcccccagatcaccaacaacgaggagctgaaccagaagggcagcctgaagaaggccaccgtgaccctgaaggacgagcccaacaacctgcagatcatcgtgagcaagagccccgtgcagttcgagaacctggaggagatcttcgacaccagcgtgagcaaggagatcagcgacgacatcaccagcgacatcaccagctgggagggcaacacccacttcgaggagagcttcaccgacggccccgagaaggagctggacctgttcacctacctgaagcactgcgccaagaacatcaaggccaaggacgtggccaagcccaacgaggacgtgcccagccacgtgctgatcaccgccccccccatgaaggagcacctgcagctgggcgtgaacaacaccaaggagaagagcaccagcacccagaaggacagccccctgaacgacatgatccagagcaacgacctgtgcagcaaggagagcatcagcggcggcggcaccgagatcagccagttcacccccgagagcatcgaggccaccctgagcatcctgagcagaaagcacgtggaggacgtgggcaagaacgacttcctgcagagcgagagatgcgccaacggcctgggcaacgacaacagcagcaacaccctgaacaccgactacagcttcctggagatcaacaacaagaaggagagaatcgagcagcagctgcccaaggagcaggccctgagccccagaagccaggagaaggaggtgcagatccccgagctgagccaggtgttcgtggaggacgtgaaggacatcctgaagagcagactgaaggagggccacatgaacccccaggaggtggaggagcccagcgcctgcgccgacaccaagatcctgatccagaacctgatcaagagaatcaccaccagccagctggtgaacgaggccagcaccgtgcccagcgacagccagatgagcgacagcagcggcgtgagccccatgaccaacagcagcgagctgaagcccgagagcagagacgaccccttctgcatcggcaacctgaagagcgagctgctgctgaacatcctgaagcaggaccagcacagccagaagatcaccggcgtgttcgagctgatgagagagctgacccacatggagtacgacctggagaagagaggcatcaccagcaaggtgctgcccctgcagctggagaacatcttctacaagctgctggccgacggctacagcgagaagatcgagcacgtgggcgacttcaaccagaaggcctgcagcaccagcgagatgatggaggagaagccccacatcctgggcgacatcaagagcaaggagggcaactactacagccccaacctggagaccgtgaaggagatcggcctggagagcagcaccgtgtgggccagcaccctgcccagagacgagaagctgaaggacctgtgcaacgacttccccagccacctggagtgcaccagcggcagcaaggagatggccagcggcgacagcagcaccgagcagttcagcagcgagctgcagcagtgcctgcagcacaccgagaagatgcacgagtacctgaccctgctgcaggacatgaagccccccctggacaaccaggagagcctggacaacaacctggaggccctgaagaaccagctgagacagctggagaccttcgagctgggcctggcccccatcgccgtgatcctgagaaaggacatgaagctggccgaggagttcctgaagagcctgcccagcgacttccccagaggccacgtggaggagctgagcatcagccaccagagcctgaagaccgccttcagcagcctgagcaacgtgagcagcgagagaaccaagcagatcatgctggccatcgacagcgagatgagcaagctggccgtgagccacgaggagttcctgcacaagctgaagagcttcagcgactgggtgagcgagaagagcaagagcgtgaaggacatcgagatcgtgaacgtgcaggacagcgagtacgtgaagaagagactggagttcctgaaggccaacaacgtgctgaaggacctgggccacaccaagatgcagctggagaccaccgccttcgacgtgcagttcttcatcagcgagtacgcccaggacctgagccccaaccagagcaagcagctgctgagactgctgaacaccacccagaagtgcttcctggacgtgcaggagagcgtgaccacccaggtggagagactggagacccagctgcacctggagcaggacctggacgaccagaagatcgtggccgagagacagcaggagtacaaggagaagctgcagggcatctgcgacctgctgacccagaccgagaacagactgatcggccaccaggaggccttcatgatcggcgacggcaccgtggagctgaagaagtaccagagcaagcaggaggagctgcagaaggacatgcagggcagcgcccaggccctggccgaggtggtgaagaacaccgagaacttcctgaaggagaacggcgagaagctgagccaggaggacaaggccctgatcgagcagaagctgaacgaggccaagatcaagtgcgagcagctgaacctgaaggccgagcagagcaagaaggagctggacaaggtggtgaccaccgccatcaaggaggagaccgagaaggtggccgccgtgaagcagctggaggagagcaagaccaagatcgagaacctgctggactggctgagcaacgtggacaaggacagcgagagagccggcaccaagcacaagcaggtgatcgagcagaacggcacccacttccaggagggcgacggcaagagcgccatcggcgaggaggacgaggtgaacggcaacctgctggagaccgacgtggacggccaggtgggcaccacccaggagaacctgaaccagcagtaccagaaggtgaaggcccagcacgagaagatcatcagccagcaccaggccgtgatcatcgccacccagagcgcccaggtgctgctggagaagcagggccagtacctgagccccgaggagaaggagaagctgcagaagaacatgaaggagctgaaggtgcactacgagaccgccctggccgagagcgagaagaagatgaagctgacccacagcctgcaggaggagctggagaagttcgacgccgactacaccgagttcgagcactggctgcagcagagcgagcaggagctggagaacctggaggccggcgccgacgacatcaacggcctgatgaccaagctgaagagacagaagagcttcagcgaggacgtgatcagccacaagggcgacctgagatacatcaccatcagcggcaacagagtgctggaggccgccaagagctgcagcaagagagacggcggcaaggtggacaccagcgccacccacagagaggtgcagagaaagctggaccacgccaccgacagattcagaagcctgtacagcaagtgcaacgtgctgggcaacaacctgaaggacctggtggacaagtaccagcactacgaggacgccagctgcggcctgctggccggcctgcaggcctgcgaggccaccgccagcaagcacctgagcgagcccatcgccgtggaccccaagaacctgcagagacagctggaggagaccaaggccctgcagggccagatcagcagccagcaggtggccgtggagaagctgaagaagaccgccgaggtgctgctggacgccagaggcagcctgctgcccgccaagaacgacatccagaagaccctggacgacatcgtgggcagatacgaggacctgagcaagagcgtgaacgagagaaacgagaagctgcagatcaccctgaccagaagcctgagcgtgcaggacggcctggacgagatgctggactggatgggcaacgtggagagcagcctgaaggagcagggccaggtgcccctgaacagcaccgccctgcaggacatcatcagcaagaacatcatgctggagcaggacatcgccggcagacagagcagcatcaacgccatgaacgagaaggtgaagaagttcatggagaccaccgaccccagcaccgccagcagcctgcaggccaagatgaaggacctgagcgccagattcagcgaggccagccacaagcacaaggagaccctggccaagatggaggagctgaagaccaaggtggagctgttcgagaacctgagcgagaagctgcagaccttcctggagaccaagacccaggccctgaccgaggtggacgtgcccggcaaggacgtgaccgagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggacgccttccaggtgctggtgaagagcctgaagagctggatcaaggagaccaccaagaaggtgcccatcgtgcagcccagcttcggcgccgaggacctgggcaagagcctggaggacaccaagaagctgcaggagaagtggagcctgaagacccccgagatccagaaggtgaacaacagcggcatcagcctgtgcaacctgatcagcgccgtgaccacccccgccaaggccatcgccgccgtgaagagcggcggcgccgtgctgaacggcgagggcaccgccaccaacaccgaggagttctgggccaacaagggcctgaccagcatcaagaaggacatgaccgacatcagccacggctacgaggacctgggcctgctgctgaaggacaagatcgccgagctgaacaccaagctgagcaagctgcagaaggcccaggaggagagcagcgccatgatgcagtggctgcagaagatgaacaagaccgccaccaagtggcagcagacccccgcccccaccgacaccgaggccgtgaagacccaggtggagcagaacaagagcttcgaggccgagctgaagcagaacgtgaacaaggtgcaggagctgaaggacaagctgaccgagctgctggaggagaaccccgacacccccgaggcccccagatggaagcagatgctgaccgagatcgacagcaagtggcaggagctgaaccagctgaccatcgacagacagcagaagctggaggagagcagcaacaacctgacccagttccagaccgtggaggcccagctgaagcagtggctggtggagaaggagctgatggtgagcgtgctgggccccctgagcatcgaccccaacatgctgaacacccagagacagcaggtgcagatcctgctgcaggagttcgccaccagaaagccccagtacgagcagctgaccgccgccggccagggcatcctgagcagacccggcgaggaccccagcctgagaggcatcgtgaaggagcagctggccgccgtgacccagaagtgggacagcctgaccggccagctgagcgacagatgcgactggatcgaccaggccatcgtgaagagcacccagtaccagagcctgctgagaagcctgagcgacaagctgagcgacctggacaacaagctgagcagcagcctggccgtgagcacccaccccgacgccatgaaccagcagctggagaccgcccagaagatgaagcaggagatccagcaggagaagaagcagatcaaggtggcccaggccctgtgcgaggacctgagcgccctggtgaaggaggagtacctgaaggccgagctgagcagacagctggagggcatcctgaagagcttcaaggacgtggagcagaaggccgagaaccacgtgcagcacctgcagagcgcctgcgccagcagccaccagttccagcagatgagcagagacttccaggcctggctggacaccaagaaggaggagcagaacaagagccaccccatcagcgccaagctggacgtgctggagagcctgatcaaggaccacaaggacttcagcaagaccctgaccgcccagagccacatgtacgagaagaccatcgccgagggcgagaacctgctgctgaagacccagggcagcgagaaggccgccctgcagctgcagctgaacaccatcaagaccaactgggacaccttcaacaagcaggtgaaggagagagagaacaagctgaaggagagcctggagaaggccctgaagtacaaggagcaggtggagaccctgtggccctggatcgacaagtgccagaacaacctggaggagatcaagttctgcctggaccccgccgagggcgagaacagcatcgccaagctgaagagcctgcagaaggagatggaccagcacttcggcatggtggagctgctgaacaacaccgccaacagcctgctgagcgtgtgcgagatcgacaaggaggtggtgaccgacgagaacaagagcctgatccagaaggtggacatggtgaccgagcagctgcacagcaagaagttctgcctggagaacatgacccagaagttcaaggagttccaggaggtgagcaaggagagcaagagacagctgcagtgcgccaaggagcagctggacatccacgacagcctgggcagccaggcctacagcaacaagtacctgaccatgctgcagacccagcagaagagcctgcaggccctgaagcaccaggtggacctggccaagagactggcccaggacctggtggtggaggccagcgacagcaagggcaccagcgacgtgctgctgcaggtggagaccatcgcccaggagcacagcaccctgagccagcaggtggacgagaagtgcagcttcctggagaccaagctgcagggcatcggccacttccagaacaccatcagagagatgttcagccagttcgccgagttcgacgacgagctggacagcatggcccccgtgggcagagacgccgagaccctgcagaagcagaaggagaccatcaaggccttcctgaagaagctggaggccctgatggccagcaacgacaacgccaacaagacctgcaagatgatgctggccaccgaggagaccagccccgacctggtgggcatcaagagagacctggaggccctgagcaagcagtgcaacaagctgctggacagagcccaggccagagaggagcaggtggagggcaccatcaagagactggaggagttctacagcaagctgaaggagttcagcatcctgctgcagaaggccgaggagcacgaggagagccagggccccgtgggcatggagaccgagaccatcaaccagcagctgaacatgttcaaggtgttccagaaggaggagatcgagcccctgcagggcaagcagcaggacgtgaactggctgggccagggcctgatccagagcgccgccaagagcaccagcacccagggcctggagcacgacctggacgacgtgaacgccagatggaagaccctgaacaagaaggtggcccagagagccgcccagctgcaggaggccctgctgcactgcggcagattccaggacgccctggagagcctgctgagctggatggtggacaccgaggagctggtggccaaccagaagccccccagcgccgagttcaaggtggtgaaggcccagatccaggagcagaagctgctgcagagactgctggacgacagaaagagcaccgtggaggtgatcaagagagagggcgagaagatcgccaccaccgccgagcccgccgacaaggtgaagatcctgaagcagctgagcctgctggacagcagatgggaggccctgctgaacaaggccgagaccagaaacagacagctggagggcatcagcgtggtggcccagcagttccacgagaccctggagcccctgaacgagtggctgaccaccatcgagaagagactggtgaactgcgagcccatcggcacccaggccagcaagctggaggagcagatcgcccagcacaaggccctggaggacgacatcatcaaccacaacaagcacctgcaccaggccgtgagcatcggccagagcctgaaggtgctgagcagcagagaggacaaggacatggtgcagagcaagctggacttcagccaggtgtggtacatcgagatccaggagaagagccacagcagaagcgagctgctgcagcaggccctgtgcaacgccaagatcttcggcgaggacgaggtggagctgatgaactggctgaacgaggtgcacgacaagctgagcaagctgagcgtgcaggactacagcaccgagggcctgtggaagcagcagagcgagctgagagtgctgcaggaggacatcctgctgagaaagcagaacgtggaccaggccctgctgaacggcctggagctgctgaagcagaccaccggcgacgaggtgctgatcatccaggacaagctggaggccatcaaggccagatacaaggacatcaccaagctgagcaccgacgtggccaagaccctggagcaggccctgcagctggccagaagactgcacagcacccacgaggagctgtgcacctggctggacaaggtggaggtggagctgctgagctacgagacccaggtgctgaagggcgaggaggccagccaggcccagatgagacccaaggagctgaagaaggaggccaagaacaacaaggccctgctggacagcctgaacgaggtgagcagcgccctgctggagctggtgccctggagagccagagagggcctggagaagatggtggccgaggacaacgagagatacagactggtgagcgacaccatcacccagaaggtggaggagatcgacgccgccatcctgagaagccagcagttcgaccaggccgccgacgccgagctgagctggatcaccgagaccgagaagaagctgatgagcctgggcgacatcagactggagcaggaccagaccagcgcccagctgcaggtgcagaagaccttcaccatggagatcctgagacacaaggacatcatcgacgacctggtgaagagcggccacaagatcatgaccgcctgcagcgaggaggagaagcagagcatgaagaagaagctggacaaggtgctgaagaactacgacaccatctgccagatcaacagcgagagatacctgcagctggagagagcccagagcctggtgaaccagttctgggagacctacgaggagctgtggccctggctgaccgagacccagagcatcatcagccagctgcccgcccccgccctggagtacgagaccctgagacagcagcaggaggagcacagacagctgagagagctgatcgccgagcacaagccccacatcgacaagatgaacaagaccggcccccagctgctggagctgagccccggcgagggcttcagcatccaggagaagtacgtggccgccgacaccctgtacagccagatcaaggaggacgtgaagaagagagccgtggccctggacgaggccatcagccagagcacccagttccacgacaagatcgaccagatcctggagagcctggagagaatcgtggagagactgagacagccccccagcatcagcgccgaggtggagaagatcaaggagcagatcagcgagaacaagaacgtgagcgtggacatggagaagctgcagcccctgtacgagaccctgaagcagagaggcgaggagatgatcgccagaagcggcggcaccgacaaggacatcagcgccaaggccgtgcaggacaagctggaccagatggtgttcatctgggagaacatccacaccctggtggaggagagagaggccaagctgctggacgtgatggagctggccgagaagttctggtgcgaccacatgagcctgatcgtgaccatcaaggacacccaggacttcatcagagacctggaggaccccggcatcgaccccagcgtggtgaagcagcagcaggaggccgccgagaccatcagagaggagatcgacggcctgcaggaggagctggacatcgtgatcaacctgggcagcgagctgatcgccgcctgcggcgagcccgacaagcccatcgtgaagaagagcatcgacgagctgaacagcgcctgggacagcctgaacaaggcctggaaggacagaatcgacaagctggaggaggccatgcaggccgccgtgcagtaccaggacggcctgcaggccgtgttcgactgggtggacatcgccggcggcaagctggccagcatgagccccatcggcaccgacctggagaccgtgaagcagcagatcgaggagctgaagcagttcaagagcgaggcctaccagcagcagatcgagatggagagactgaaccaccaggccgagctgctgctgaagaaggtgaccgaggagagcgacaagcacaccgtgcaggaccccctgatggagctgaagctgatctgggacagcctggaggagagaatcatcaacagacagcacaagctggagggcgccctgctggccctgggccagttccagcacgccctggacgagctgctggcctggctgacccacaccgagggcctgctgagcgagcagaagcccgtgggcggcgaccccaaggccatcgagatcgagctggccaagcaccacgtgctgcagaacgacgtgctggcccaccagagcaccgtggaggccgtgaacaaggccggcaacgacctgatcgagagcagcgccggcgaggaggccagcaacctgcagaacaagctggaggtgctgaaccagagatggcagaacgtgctggagaagaccgagcagagaaagcagcagctggacggcgccctgagacaggccaagggcttccacggcgagatcgaggacctgcagcagtggctgaccgacaccgagagacacctgctggccagcaagcccctgggcggcctgcccgagaccgccaaggagcagctgaacgtgcacatggaggtgtgcgccgccttcgaggccaaggaggagacctacaagagcctgatgcagaagggccagcagatgctggccagatgccccaagagcgccgagaccaacatcgaccaggacatcaacaacctgaaggagaagtgggagagcgtggagaccaagctgaacgagagaaagaccaagctggaggaggccctgaacctggccatggagttccacaacagcctgcaggacttcatcaactggctgacccaggccgagcagaccctgaacgtggccagcagacccagcctgatcctggacaccgtgctgttccagatcgacgagcacaaggtgttcgccaacgaggtgaacagccacagagagcagatcatcgagctggacaagaccggcacccacctgaagtacttcagccagaagcaggacgtggtgctgatcaagaacctgctgatcagcgtgcagagcagatgggagaaggtggtgcagagactggtggagagaggcagaagcctggacgacgccagaaagagagccaagcagttccacgaggcctggagcaagctgatggagtggctggaggagagcgagaagagcctggacagcgagctggagatcgccaacgaccccgacaagatcaagacccagctggcccagcacaaggagttccagaagagcctgggcgccaagcacagcgtgtacgacaccaccaacagaaccggcagaagcctgaaggagaagaccagcctggccgacgacaacctgaagctggacgacatgctgagcgagctgagagacaagtgggacaccatctgcggcaagagcgtggagagacagaacaagctggaggaggccctgctgttcagcggccagttcaccgacgccctgcaggccctgatcgactggctgtacagagtggagccccagctggccgaggaccagcccgtgcacggcgacatcgacctggtgatgaacctgatcgacaaccacaaggccttccagaaggagctgggcaagagaaccagcagcgtgcaggccctgaagagaagcgccagagagctgatcgagggcagcagagacgacagcagctgggtgaaggtgcagatgcaggagctgagcaccagatgggagaccgtgtgcgccctgagcatcagcaagcagaccagactggaggccgccctgagacaggccgaggagttccacagcgtggtgcacgccctgctggagtggctggccgaggccgagcagaccctgagattccacggcgtgctgcccgacgacgaggacgccctgagaaccctgatcgaccagcacaaggagttcatgaagaagctggaggagaagagagccgagctgaacaaggccaccaccatgggcgacaccgtgctggccatctgccaccccgacagcatcaccaccatcaagcactggatcaccatcatcagagccagattcgaggaggtgctggcctgggccaagcagcaccagcagagactggccagcgccctggccggcctgatcgccaagcaggagctgctggaggccctgctggcctggctgcagtgggccgagaccaccctgaccgacaaggacaaggaggtgatcccccaggagatcgaggaggtgaaggccctgatcgccgagcaccagaccttcatggaggagatgaccagaaagcagcccgacgtggacaaggtgaccaagacctacaagagaagagccgccgaccccagcagcctgcagagccacatccccgtgctggacaagggcagagccggcagaaagagattccccgccagcagcctgtaccccagcggcagccagacccagatcgagaccaagaaccccagagtgaacctgctggtgagcaagtggcagcaggtgtggctgctggccctggagagaagaagaaagctgaacgacgccctggacagactggaggagctgagagagttcgccaacttcgacttcgacatctggagaaagaagtacatgagatggatgaaccacaagaagagcagagtgatggacttcttcagaagaatcgacaaggaccaggacggcaagatcaccagacaggagttcatcgacggcatcctgagcagcaagttccccaccagcagactggagatgagcgccgtggccgacatcttcgacagagacggcgacggctacatcgactactacgagttcgtggccgccctgcaccccaacaaggacgcctacaagcccatcaccgacgccgacaagatcgaggacgaggtgaccagacaggtggccaagtgcaagtgcgccaagagattccaggtggagcagatcggcgacaacaagtacagagtgagcttccagagcaacttcggcgacagccagcagctgagactggtgagaatcctgagaagcaccgtgatggtgagagtgggcggcggctggatggccctggacgagttcctggtgaagaacgacccctgcagagtgcaccaccacggcagcaagatgctgagaagcgagagcaacagcagcatcaccaccacccagcccaccatcgccaagggcagaaccaacatggagctgagagagaagttcatcctggccgacggcgccagccagggcatggccgccttcagacccagaggcagaagaagcagacccagcagcagaggcgccagccccaacagaagcaccagcgtgagcagccaggccgcccaggccgccagcccccaggtgcccgccaccaccacccccaagggcacccccatccagggcagcaagctgagactgcccggctacctgagcggcaagggcttccacagcggcgaggacagcggcctgatcaccaccgccgccgccagagtgagaacccagttcgccgacagcaagaagacccccagcagacccggcagcagagccggcagcaaggccggcagcagagccagcagcagaagaggcagcgacgccagcgacttcgacatcagcgagatccagagcgtgtgcagcgacgtggagaccgtgccccagacccacagacccacccccagagccggcagcagacccagcaccgccaagcccagcaagatccccaccccccagagaaagagccccgccagcaagctggacaagagcagcaagagatag

SEQ ID NO: 79919 - DNA, 7950 bp, Artificial Sequence
  Description of Artificial Sequence: Synthetic coding sequence
atgcacagcagcagctacagctacagaagcagcgacagcgtgttcagcaacaccaccagcaccagaaccagcctggacagcaacgagaacctgctgctggtgcactgcggccccaccctgatcaacagctgcatcagcttcggcagcgagagcttcgacggccacagactggagatgctgcagcagatcgccaacagagtgcagagagacagcgtgatctgcgaggacaagctgatcctggccggcaacgccctgcagagcgacagcaagagactggagagcggcgtgcagttccagaacgaggccgagatcgccggctacatcctggagtgcgagaacctgctgagacagcacgtgatcgacgtgcagatcctgatcgacggcaagtactaccaggccgaccagctggtgcagagagtggccaagctgagagacgagatcatggccctgagaaacgagtgcagcagcgtgtacagcaagggcagaatcctgaccaccgagcagaccaagctgatgatcagcggcatcacccagagcctgaacagcggcttcgcccagaccctgcaccccagcctgaccagcggcctgacccagagcctgacccccagcctgaccagcagcagcatgaccagcggcctgagcagcggcatgaccagcagactgacccccagcgtgacccccgcctacacccccggcttccccagcggcctggtgcccaacttcagcagcggcgtggagcccaacagcctgcagaccctgaagctgatgcagatcagaaagcccctgctgaagagcagcctgctggaccagaacctgaccgaggaggagatcaacatgaagttcgtgcaggacctgctgaactgggtggacgagatgcaggtgcagctggacagaaccgagtggggcagcgacctgcccagcgtggagagccacctggagaaccacaagaacgtgcacagagccatcgaggagttcgagagcagcctgaaggaggccaagatcagcgagatccagatgaccgcccccctgaagctgacctacgccgagaagctgcacagactggagagccagtacgccaagctgctgaacaccagcagaaaccaggagagacacctggacaccctgcacaacttcgtgagcagagccaccaacgagctgatctggctgaacgagaaggaggaggaggaggtggcctacgactggagcgagagaaacaccaacatcgccagaaagaaggactaccacgccgagctgatgagagagctggaccagaaggaggagaacatcaagagcgtgcaggagatcgccgagcagctgctgctggagaaccaccccgccagactgaccatcgaggcctacagagccgccatgcagacccagtggagctggatcctgcagctgtgccagtgcgtggagcagcacatcaaggagaacaccgcctacttcgagttcttcaacgacgccaaggaggccaccgactacctgagaaacctgaaggacgccatccagagaaagtacagctgcgacagaagcagcagcatccacaagctggaggacctggtgcaggagagcatggaggagaaggaggagctgctgcagtacaagagcaccatcgccaacctgatgggcaaggccaagaccatcatccagctgaagcccagaaacagcgactgccccctgaagaccagcatccccatcaaggccatctgcgactacagacagatcgagatcaccatctacaaggacgacgagtgcgtgctggccaacaacagccacagagccaagtggaaggtgatcagccccaccggcaacgaggccatggtgcccagcgtgtgcttcaccgtgcccccccccaacaaggaggccgtggacctggccaacagaatcgagcagcagtaccagaacgtgctgaccctgtggcacgagagccacatcaacatgaagagcgtggtgagctggcactacctgatcaacgagatcgacagaatcagagccagcaacgtggccagcatcaagaccatgctgcccggcgagcaccagcaggtgctgagcaacctgcagagcagattcgaggacttcctggaggacagccaggagagccaggtgttcagcggcagcgacatcacccagctggagaaggaggtgaacgtgtgcaagcagtactaccaggagctgctgaagagcgccgagagagaggagcaggaggagagcgtgtacaacctgtacatcagcgaggtgagaaacatcagactgagactggagaactgcgaggacagactgatcagacagatcagaacccccctggagagagacgacctgcacgagagcgtgttcagaatcaccgagcaggagaagctgaagaaggagctggagagactgaaggacgacctgggcaccatcaccaacaagtgcgaggagttcttcagccaggccgccgccagcagcagcgtgcccaccctgagaagcgagctgaacgtggtgctgcagaacatgaaccaggtgtacagcatgagcagcacctacatcgacaagctgaagaccgtgaacctggtgctgaagaacacccaggccgccgaggccctggtgaagctgtacgagaccaagctgtgcgaggaggaggccgtgatcgccgacaagaacaacatcgagaacctgatcagcaccctgaagcagtggagaagcgaggtggacgagaagagacaggtgttccacgccctggaggacgagctgcagaaggccaaggccatcagcgacgagatgttcaagacctacaaggagagagacctggacttcgactggcacaaggagaaggccgaccagctggtggagagatggcagaacgtgcacgtgcagatcgacaacagactgagagacctggagggcatcggcaagagcctgaagtactacagagacacctaccaccccctggacgactggatccagcaggtggagaccacccagagaaagatccaggagaaccagcccgagaacagcaagaccctggccacccagctgaaccagcagaagatgctggtgagcgagatcgagatgaagcagagcaagatggacgagtgccagaagtacgccgagcagtacagcgccaccgtgaaggactacgagctgcagaccatgacctacagagccatggtggacagccagcagaagagccccgtgaagagaagaagaatgcagagcagcgccgacctgatcatccaggagttcatggacctgagaaccagatacaccgccctggtgaccctgatgacccagtacatcaagttcgccggcgacagcctgaagagactggaggaggaggagatcaagagatgcaaggagaccagcgagcacggcgcctacagcgacctgctgcagagacagaaggccaccgtgctggagaacagcaagctgaccggcaagatcagcgagctggagagaatggtggccgagctgaagaagcagaagagcagagtggaggaggagctgcccaaggtgagagaggccgccgagaacgagctgagaaagcagcagagaaacgtggaggacatcagcctgcagaagatcagagccgagagcgaggccaagcagtacagaagagagctggagaccatcgtgagagagaaggaggccgccgagagagagctggagagagtgagacagctgaccatcgaggccgaggccaagagagccgccgtggaggagaacctgctgaacttcagaaaccagctggaggagaacaccttcaccagaagaaccctggaggaccacctgaagagaaaggacctgagcctgaacgacctggagcagcagaagaacaagctgatggaggagctgagaagaaagagagacaacgaggaggagctgctgaagctgatcaagcagatggagaaggacctggccttccagaagcaggtggccgagaagcagctgaaggagaagcagaagatcgagctggaggccagaagaaagatcaccgagatccagtacacctgcagagagaacgccctgcccgtgtgccccatcacccaggccaccagctgcagagccgtgaccggcctgcagcaggagcacgacaagcagaaggccgaggagctgaagcagcaggtggacgagctgaccgccgccaacagaaaggccgagcaggacatgagagagctgacctacgagctgaacgccctgcagctggagaagaccagcagcgaggagaaggccagactgctgaaggacaagctggacgagaccaacaacaccctgagatgcctgaagctggagctggagagaaaggaccaggccgagaagggctacagccagcagctgagagagctgggcagacagctgaaccagaccaccggcaaggccgaggaggccatgcaggaggccagcgacctgaagaagatcaagagaaactaccagctggagctggagagcctgaaccacgagaagggcaagctgcagagagaggtggacagaatcaccagagcccacgccgtggccgagaagaacatccagcacctgaacagccagatccacagcttcagagacgagaaggagctggagagactgcagatctgccagagaaagagcgaccacctgaaggagcagttcgagaagagccacgagcagctgctgcagaacatcaaggccgagaaggagaacaacgacaagatccagagactgaacgaggagctggagaagagcaacgagtgcgccgagatgctgaagcagaaggtggaggagctgaccagacagaacaacgagaccaagctgatgatgcagagaatccaggccgagagcgagaacatcgtgctggagaagcagaccatccagcagagatgcgaggccctgaagatccaggccgacggcttcaaggaccagctgagaagcaccaacgagcacctgcacaagcagaccaagaccgagcaggacttccagagaaagatcaagtgcctggaggaggacctggccaagagccagaacctggtgagcgagttcaagcagaagtgcgaccagcagaacatcatcatccagaacaccaagaaggaggtgagaaacctgaacgccgagctgaacgccagcaaggaggagaagagaagaggcgagcagaaggtgcagctgcagcaggcccaggtgcaggagctgaacaacagactgaagaaggtgcaggacgagctgcacctgaagaccatcgaggagcagatgacccacagaaagatggtgctgttccaggaggagagcggcaagttcaagcagagcgccgaggagttcagaaagaagatggagaagctgatggagagcaaggtgatcaccgagaacgacatcagcggcatcagactggacttcgtgagcctgcagcaggagaacagcagagcccaggagaacgccaagctgtgcgagaccaacatcaaggagctggagagacagctgcagcagtacagagagcagatgcagcagggccagcacatggaggccaaccactaccagaagtgccagaagctggaggacgagctgatcgcccagaagagagaggtggagaacctgaagcagaagatggaccagcagatcaaggagcacgagcaccagctggtgctgctgcagtgcgagatccagaagaagagcaccgccaaggactgcaccttcaagcccgacttcgagatgaccgtgaaggagtgccagcacagcggcgagctgagcagcagaaacaccggccacctgcaccccacccccagaagccccctgctgagatggacccaggagccccagcccctggaggagaagtggcagcacagagtggtggagcagatccccaaggaggtgcagttccagccccccggcgcccccctggagaaggagaagagccagcagtgctacagcgagtacttcagccagaccagcaccgagctgcagatcaccttcgacgagaccaaccccatcaccagactgagcgagatcgagaagatcagagaccaggccctgaacaacagcagaccccccgtgagataccaggacaacgcctgcgagatggagctggtgaaggtgctgacccccctggagatcgccaagaacaagcagtacgacatgcacaccgaggtgaccaccctgaagcaggagaagaaccccgtgcccagcgccgaggagtggatgctggagggctgcagagccagcggcggcctgaagaagggcgacttcctgaagaagggcctggagcccgagaccttccagaacttcgacggcgaccacgcctgcagcgtgagagacgacgagttcaagttccagggcctgagacacaccgtgaccgccagacagctggtggaggccaagctgctggacatgagaaccatcgagcagctgagactgggcctgaagaccgtggaggaggtgcagaagaccctgaacaagttcctgaccaaggccaccagcatcgccggcctgtacctggagagcaccaaggagaagatcagcttcgccagcgccgccgagagaatcatcatcgacaagatggtggccctggccttcctggaggcccaggccgccaccggcttcatcatcgaccccatcagcggccagacctacagcgtggaggacgccgtgctgaagggcgtggtggaccccgagttcagaatcagactgctggaggccgagaaggccgccgtgggctacagctacagcagcaagaccctgagcgtgttccaggccatggagaacagaatgctggacagacagaagggcaagcacatcctggaggcccagatcgccagcggcggcgtgatcgaccccgtgagaggcatcagagtgccccccgagatcgccctgcagcagggcctgctgaacaacgccatcctgcagttcctgcacgagcccagcagcaacaccagagtgttccccaaccccaacaacaagcaggccctgtactacagcgagctgctgagaatgtgcgtgttcgacgtggagagccagtgcttcctgttccccttcggcgagagaaacatcagcaacctgaacgtgaagaagacccacagaatcagcgtggtggacaccaagaccggcagcgagctgaccgtgtacgaggccttccagagaaacctgatcgagaagagcatctacctggagctgagcggccagcagtaccagtggaaggaggccatgttcttcgagagctacggccacagcagccacatgctgaccgacaccaagaccggcctgcacttcaacatcaacgaggccatcgagcagggcaccatcgacaaggccctggtgaagaagtaccaggagggcctgatcaccctgaccgagctggccgacagcctgctgagcagactggtgcccaagaaggacctgcacagccccgtggccggctactggctgaccgccagcggcgagagaatcagcgtgctgaaggccagcagaagaaacctggtggacagaatcaccgccctgagatgcctggaggcccaggtgagcaccggcggcatcatcgaccccctgaccggcaagaagtacagagtggccgaggccctgcacagaggcctggtggacgagggcttcgcccagcagctgagacagtgcgagctggtgatcaccggcatcggccaccccatcaccaacaagatgatgagcgtggtggaggccgtgaacgccaacatcatcaacaaggagatgggcatcagatgcctggagttccagtacctgaccggcggcctgatcgagccccaggtgcacagcagactgagcatcgaggaggccctgcaggtgggcatcatcgacgtgctgatcgccaccaagctgaaggaccagaagagctacgtgagaaacatcatctgcccccagaccaagagaaagctgacctacaaggaggccctggagaaggccgacttcgacttccacaccggcctgaagctgctggaggtgagcgagcccctgatgaccggcatcagcagcctgtactacagcagctag

SEQ ID NO: 79920 - DNA, 22719 bp, Artificial Sequence
  Description of Artificial Sequence: Synthetic coding sequence
atggccggctacctgagccccgccgcctacctgtacgtggaggagcaggagtacctgcaggcctacgaggacgtgctggagagatacaaggacgagagagacaaggtgcagaagaagaccttcaccaagtggatcaaccagcacctgatgaaggtgagaaagcacgtgaacgacctgtacgaggacctgagagacggccacaacctgatcagcctgctggaggtgctgagcggcgacaccctgcccagagagaagggcagaatgagattccacagactgcagaacgtgcagatcgccctggactacctgaagagaagacaggtgaagctggtgaacatcagaaacgacgacatcaccgacggcaaccccaagctgaccctgggcctgatctggaccatcatcctgcacttccagatcagcgacatccacgtgaccggcgagagcgaggacatgagcgccaaggagagactgctgctgtggacccagcaggccaccgagggctacgccggcatcagatgcgagaacttcaccacctgctggagagacggcaagctgttcaacgccatcatccacaagtacagacccgacctgatcgacatgaacaccgtggccgtgcagagcaacctggccaacctggagcacgccttctacgtggccgagaagatcggcgtgatcagactgctggaccccgaggacgtggacgtgagcagccccgacgagaagagcgtgatcacctacgtgagcagcctgtacgacgccttccccaaggtgcccgagggcggcgagggcatcggcgccaacgacgtggaggtgaagtggatcgagtaccagaacatggtgaactacctgatccagtggatcagacaccacgtgaccaccatgagcgagagaaccttccccaacaaccccgtggagctgaaggccctgtacaaccagtacctgcagttcaaggagaccgagatcccccccaaggagaccgagaagagcaagatcaagagactgtacaagctgctggagatctggatcgagttcggcagaatcaagctgctgcagggctaccaccccaacgacatcgagaaggagtggggcaagctgatcatcgccatgctggagagagagaaggccctgagacccgaggtggagagactggagatgctgcagcagatcgccaacagagtgcagagagacagcgtgatctgcgaggacaagctgatcctggccggcaacgccctgcagagcgacagcaagagactggagagcggcgtgcagttccagaacgaggccgagatcgccggctacatcctggagtgcgagaacctgctgagacagcacgtgatcgacgtgcagatcctgatcgacggcaagtactaccaggccgaccagctggtgcagagagtggccaagctgagagacgagatcatggccctgagaaacgagtgcagcagcgtgtacagcaagggcagaatcctgaccaccgagcagaccaagctgatgatcagcggcatcacccagagcctgaacagcggcttcgcccagaccctgcaccccagcctgaccagcggcctgacccagagcctgacccccagcctgaccagcagcagcatgaccagcggcctgagcagcggcatgaccagcagactgacccccagcgtgacccccgcctacacccccggcttccccagcggcctggtgcccaacttcagcagcggcgtggagcccaacagcctgcagaccctgaagctgatgcagatcagaaagcccctgctgaagagcagcctgctggaccagaacctgaccgaggaggagatcaacatgaagttcgtgcaggacctgctgaactgggtggacgagatgcaggtgcagctggacagaaccgagtggggcagcgacctgcccagcgtggagagccacctggagaaccacaagaacgtgcacagagccatcgaggagttcgagagcagcctgaaggaggccaagatcagcgagatccagatgaccgcccccctgaagctgacctacgccgagaagctgcacagactggagagccagtacgccaagctgctgaacaccagcagaaaccaggagagacacctggacaccctgcacaacttcgtgagcagagccaccaacgagctgatctggctgaacgagaaggaggaggaggaggtggcctacgactggagcgagagaaacaccaacatcgccagaaagaaggactaccacgccgagctgatgagagagctggaccagaaggaggagaacatcaagagcgtgcaggagatcgccgagcagctgctgctggagaaccaccccgccagactgaccatcgaggcctacagagccgccatgcagacccagtggagctggatcctgcagctgtgccagtgcgtggagcagcacatcaaggagaacaccgcctacttcgagttcttcaacgacgccaaggaggccaccgactacctgagaaacctgaaggacgccatccagagaaagtacagctgcgacagaagcagcagcatccacaagctggaggacctggtgcaggagagcatggaggagaaggaggagctgctgcagtacaagagcaccatcgccaacctgatgggcaaggccaagaccatcatccagctgaagcccagaaacagcgactgccccctgaagaccagcatccccatcaaggccatctgcgactacagacagatcgagatcaccatctacaaggacgacgagtgcgtgctggccaacaacagccacagagccaagtggaaggtgatcagccccaccggcaacgaggccatggtgcccagcgtgtgcttcaccgtgcccccccccaacaaggaggccgtggacctggccaacagaatcgagcagcagtaccagaacgtgctgaccctgtggcacgagagccacatcaacatgaagagcgtggtgagctggcactacctgatcaacgagatcgacagaatcagagccagcaacgtggccagcatcaagaccatgctgcccggcgagcaccagcaggtgctgagcaacctgcagagcagattcgaggacttcctggaggacagccaggagagccaggtgttcagcggcagcgacatcacccagctggagaaggaggtgaacgtgtgcaagcagtactaccaggagctgctgaagagcgccgagagagaggagcaggaggagagcgtgtacaacctgtacatcagcgaggtgagaaacatcagactgagactggagaactgcgaggacagactgatcagacagatcagaacccccctggagagagacgacctgcacgagagcgtgttcagaatcaccgagcaggagaagctgaagaaggagctggagagactgaaggacgacctgggcaccatcaccaacaagtgcgaggagttcttcagccaggccgccgccagcagcagcgtgcccaccctgagaagcgagctgaacgtggtgctgcagaacatgaaccaggtgtacagcatgagcagcacctacatcgacaagctgaagaccgtgaacctggtgctgaagaacacccaggccgccgaggccctggtgaagctgtacgagaccaagctgtgcgaggaggaggccgtgatcgccgacaagaacaacatcgagaacctgatcagcaccctgaagcagtggagaagcgaggtggacgagaagagacaggtgttccacgccctggaggacgagctgcagaaggccaaggccatcagcgacgagatgttcaagacctacaaggagagagacctggacttcgactggcacaaggagaaggccgaccagctggtggagagatggcagaacgtgcacgtgcagatcgacaacagactgagagacctggagggcatcggcaagagcctgaagtactacagagacacctaccaccccctggacgactggatccagcaggtggagaccacccagagaaagatccaggagaaccagcccgagaacagcaagaccctggccacccagctgaaccagcagaagatgctggtgagcgagatcgagatgaagcagagcaagatggacgagtgccagaagtacgccgagcagtacagcgccaccgtgaaggactacgagctgcagaccatgacctacagagccatggtggacagccagcagaagagccccgtgaagagaagaagaatgcagagcagcgccgacctgatcatccaggagttcatggacctgagaaccagatacaccgccctggtgaccctgatgacccagtacatcaagttcgccggcgacagcctgaagagactggaggaggaggagaagagcctggaggaggagaagaaggagcacgtggagaaggccaaggagctgcagaagtgggtgagcaacatcagcaagaccctgaaggacgccgagaaggccggcaagccccccttcagcaagcagaagatcagcagcgaggagatcagcaccaagaaggagcagctgagcgaggccctgcagaccatccagctgttcctggccaagcacggcgacaagatgaccgacgaggagagaaacgagctggagaagcaggtgaagaccctgcaggagagctacaacctgctgttcagcgagagcctgaagcagctgcaggagagccagaccagcggcgacgtgaaggtggaggagaagctggacaaggtgatcgccggcaccatcgaccagaccaccggcgaggtgctgagcgtgttccaggccgtgctgagaggcctgatcgactacgacaccggcatcagactgctggagacccagctgatgatcagcggcctgatcagccccgagctgagaaagtgcttcgacctgaaggacgccaagagccacggcctgatcgacgagcagatcctgtgccagctgaaggagctgagcaaggccaaggagatcatcagcgccgccagccccaccaccatccccgtgctggacgccctggcccagagcatgatcaccgagagcatggccatcaaggtgctggagatcctgctgagcaccggcagcctggtgatccccgccaccggcgagcagctgaccctgcagaaggccttccagcagaacctggtgagcagcgccctgttcagcaaggtgctggagagacagaacatgtgcaaggacctgatcgacccctgcaccagcgagaaggtgagcctgatcgacatggtgcagagaagcaccctgcaggagaacaccggcatgtggctgctgcccgtgagaccccaggagggcggcagaatcaccctgaagtgcggcagaaacatcagcatcctgagagccgcccacgagggcctgatcgacagagagaccatgttcagactgctgagcgcccagctgctgagcggcggcctgatcaacagcaacagcggccagagaatgaccgtggaggaggccgtgagagagggcgtgatcgacagagacaccgccagcagcatcctgacctaccaggtgcagaccggcggcatcatccagagcaaccccgccaagagactgaccgtggacgaggccgtgcagtgcgacctgatcaccagcagcagcgccctgctggtgctggaggcccagagaggctacgtgggcctgatctggccccacagcggcgagatcttccccaccagcagcagcctgcagcaggagctgatcaccaacgagctggcctacaagatcctgaacggcagacagaagatcgccgccctgtacatccccgagagcagccaggtgatcggcctggacgccgccaagcagctgggcatcatcgacaacaacaccgccagcatcctgaagaacatcaccctgcccgacaagatgcccgacctgggcgacctggaggcctgcaagaacgccagaagatggctgagcttctgcaagttccagcccagcaccgtgcacgactacagacaggaggaggacgtgttcgacggcgaggagcccgtgaccacccagaccagcgaggagaccaagaagctgttcctgagctacctgatgatcaacagctacatggacgccaacaccggccagagactgctgctgtacgacggcgacctggacgaggccgtgggcatgctgctggagggctgccacgccgagttcgacggcaacaccgccatcaaggagtgcctggacgtgctgagcagcagcggcgtgttcctgaacaacgccagcggcagagagaaggacgagtgcaccgccacccccagcagcttcaacaagtgccactgcggcgagcccgagcacgaggagacccccgagaacagaaagtgcgccatcgacgaggagttcaacgagatgagaaacaccgtgatcaacagcgagttcagccagagcggcaagctggccagcaccatcagcatcgaccccaaggtgaacagcagccccagcgtgtgcgtgcccagcctgatcagctacctgacccagaccgagctggccgacatcagcatgctgagaagcgacagcgagaacatcctgaccaactacgagaaccagagcagagtggagaccaacgagagagccaacgagtgcagccacagcaagaacatccagaacttccccagcgacctgatcgagaaccccatcatgaagagcaagatgagcaagttctgcggcgtgaacgagaccgagaacgaggacaacaccaacagagacagccccatcttcgactacagccccagactgagcgccctgctgagccacgacaagctgatgcacagccagggcagcttcaacgacacccacacccccgagagcaacggcaacaagtgcgaggcccccgccctgagcttcagcgacaagaccatgctgagcggccagagaatcggcgagaagttccaggaccagttcctgggcatcgccgccatcaacatcagcctgcccggcgagcagtacggccagaagagcctgaacatgatcagcagcaacccccaggtgcagtaccacaacgacaagtacatcagcaacaccagcggcgaggacgagaagacccaccccggcttccagcagatgcccgaggacaaggaggacgagagcgagatcgaggagtacagctgcgccgtgacccccggcggcgacaccgacaacgccatcgtgagcctgacctgcgccacccccctgctggacgagaccatcagcgccagcgactacgagaccagcctgctgaacgaccagcagaacaacaccggcaccgacaccgacagcgacgacgacttctacgacacccccctgttcgaggacgacgaccacgacagcctgctgctggacggcgacgacagagactgcctgcaccccgaggactacgacaccctgcaggaggagaacgacgagaccgccagccccgccgacgtgttctacgacgtgagcaaggagaacgagaacagcatggtgccccagggcgcccccgtgggcagcctgagcgtgaagaacaaggcccactgcctgcaggacttcctgatggacgtggagaaggacgagctggacagcggcgagaagatccacctgaaccccgtgggcagcgacaaggtgaacggccagagcctggagaccggcagcgagagagagtgcaccaacatcctggagggcgacgagagcgacagcctgaccgactacgacatcgtgggcggcaaggagagcttcaccgccagcctgaagttcgacgacagcggcagctggagaggcagaaaggaggagtacgtgaccggccaggagttccacagcgacaccgaccacctggacagcatgcagagcgaggagagctacggcgactacatctacgacagcaacgaccaggacgacgacgacgacgacggcatcgacgaggagggcggcggcatcagagacgagaacggcaagcccagatgccagaacgtggccgaggacatggacatccagctgtgcgccagcatcctgaacgagaacagcgacgagaacgagaacatcaacaccatgatcctgctggacaagatgcacagctgcagcagcctggagaagcagcagagagtgaacgtggtgcagctggccagccccagcgagaacaacctggtgaccgagaagagcaacctgcccgagtacaccaccgagatcgccggcaagagcaaggagaacctgctgaaccacgagatggtgctgaaggacgtgctgccccccatcatcaaggacaccgagagcgagaagaccttcggccccgccagcatcagccacgacaacaacaacatcagcagcaccagcgagctgggcaccgacctggccaacaccaaggtgaagctgatccagggcagcgagctgcccgagctgaccgacagcgtgaagggcaaggacgagtacttcaagaacatgacccccaaggtggacagcagcctggaccacatcatctgcaccgagcccgacctgatcggcaagcccgccgaggagagccacctgagcctgatcgccagcgtgaccgacaaggacccccagggcaacggcagcgacctgatcaagggcagagacggcaagagcgacatcctgatcgaggacgagaccagcatccagaagatgtacctgggcgagggcgaggtgctggtggagggcctggtggaggaggagaacagacacctgaagctgctgcccggcaagaacaccagagacagcttcaagctgatcaacagccagttccccttcccccagatcaccaacaacgaggagctgaaccagaagggcagcctgaagaaggccaccgtgaccctgaaggacgagcccaacaacctgcagatcatcgtgagcaagagccccgtgcagttcgagaacctggaggagatcttcgacaccagcgtgagcaaggagatcagcgacgacatcaccagcgacatcaccagctgggagggcaacacccacttcgaggagagcttcaccgacggccccgagaaggagctggacctgttcacctacctgaagcactgcgccaagaacatcaaggccaaggacgtggccaagcccaacgaggacgtgcccagccacgtgctgatcaccgccccccccatgaaggagcacctgcagctgggcgtgaacaacaccaaggagaagagcaccagcacccagaaggacagccccctgaacgacatgatccagagcaacgacctgtgcagcaaggagagcatcagcggcggcggcaccgagatcagccagttcacccccgagagcatcgaggccaccctgagcatcctgagcagaaagcacgtggaggacgtgggcaagaacgacttcctgcagagcgagagatgcgccaacggcctgggcaacgacaacagcagcaacaccctgaacaccgactacagcttcctggagatcaacaacaagaaggagagaatcgagcagcagctgcccaaggagcaggccctgagccccagaagccaggagaaggaggtgcagatccccgagctgagccaggtgttcgtggaggacgtgaaggacatcctgaagagcagactgaaggagggccacatgaacccccaggaggtggaggagcccagcgcctgcgccgacaccaagatcctgatccagaacctgatcaagagaatcaccaccagccagctggtgaacgaggccagcaccgtgcccagcgacagccagatgagcgacagcagcggcgtgagccccatgaccaacagcagcgagctgaagcccgagagcagagacgaccccttctgcatcggcaacctgaagagcgagctgctgctgaacatcctgaagcaggaccagcacagccagaagatcaccggcgtgttcgagctgatgagagagctgacccacatggagtacgacctggagaagagaggcatcaccagcaaggtgctgcccctgcagctggagaacatcttctacaagctgctggccgacggctacagcgagaagatcgagcacgtgggcgacttcaaccagaaggcctgcagcaccagcgagatgatggaggagaagccccacatcctgggcgacatcaagagcaaggagggcaactactacagccccaacctggagaccgtgaaggagatcggcctggagagcagcaccgtgtgggccagcaccctgcccagagacgagaagctgaaggacctgtgcaacgacttccccagccacctggagtgcaccagcggcagcaaggagatggccagcggcgacagcagcaccgagcagttcagcagcgagctgcagcagtgcctgcagcacaccgagaagatgcacgagtacctgaccctgctgcaggacatgaagccccccctggacaaccaggagagcctggacaacaacctggaggccctgaagaaccagctgagacagctggagaccttcgagctgggcctggcccccatcgccgtgatcctgagaaaggacatgaagctggccgaggagttcctgaagagcctgcccagcgacttccccagaggccacgtggaggagctgagcatcagccaccagagcctgaagaccgccttcagcagcctgagcaacgtgagcagcgagagaaccaagcagatcatgctggccatcgacagcgagatgagcaagctggccgtgagccacgaggagttcctgcacaagctgaagagcttcagcgactgggtgagcgagaagagcaagagcgtgaaggacatcgagatcgtgaacgtgcaggacagcgagtacgtgaagaagagactggagttcctgaaggccaacaacgtgctgaaggacctgggccacaccaagatgcagctggagaccaccgccttcgacgtgcagttcttcatcagcgagtacgcccaggacctgagccccaaccagagcaagcagctgctgagactgctgaacaccacccagaagtgcttcctggacgtgcaggagagcgtgaccacccaggtggagagactggagacccagctgcacctggagcaggacctggacgaccagaagatcgtggccgagagacagcaggagtacaaggagaagctgcagggcatctgcgacctgctgacccagaccgagaacagactgatcggccaccaggaggccttcatgatcggcgacggcaccgtggagctgaagaagtaccagagcaagcaggaggagctgcagaaggacatgcagggcagcgcccaggccctggccgaggtggtgaagaacaccgagaacttcctgaaggagaacggcgagaagctgagccaggaggacaaggccctgatcgagcagaagctgaacgaggccaagatcaagtgcgagcagctgaacctgaaggccgagcagagcaagaaggagctggacaaggtggtgaccaccgccatcaaggaggagaccgagaaggtggccgccgtgaagcagctggaggagagcaagaccaagatcgagaacctgctggactggctgagcaacgtggacaaggacagcgagagagccggcaccaagcacaagcaggtgatcgagcagaacggcacccacttccaggagggcgacggcaagagcgccatcggcgaggaggacgaggtgaacggcaacctgctggagaccgacgtggacggccaggtgggcaccacccaggagaacctgaaccagcagtaccagaaggtgaaggcccagcacgagaagatcatcagccagcaccaggccgtgatcatcgccacccagagcgcccaggtgctgctggagaagcagggccagtacctgagccccgaggagaaggagaagctgcagaagaacatgaaggagctgaaggtgcactacgagaccgccctggccgagagcgagaagaagatgaagctgacccacagcctgcaggaggagctggagaagttcgacgccgactacaccgagttcgagcactggctgcagcagagcgagcaggagctggagaacctggaggccggcgccgacgacatcaacggcctgatgaccaagctgaagagacagaagagcttcagcgaggacgtgatcagccacaagggcgacctgagatacatcaccatcagcggcaacagagtgctggaggccgccaagagctgcagcaagagagacggcggcaaggtggacaccagcgccacccacagagaggtgcagagaaagctggaccacgccaccgacagattcagaagcctgtacagcaagtgcaacgtgctgggcaacaacctgaaggacctggtggacaagtaccagcactacgaggacgccagctgcggcctgctggccggcctgcaggcctgcgaggccaccgccagcaagcacctgagcgagcccatcgccgtggaccccaagaacctgcagagacagctggaggagaccaaggccctgcagggccagatcagcagccagcaggtggccgtggagaagctgaagaagaccgccgaggtgctgctggacgccagaggcagcctgctgcccgccaagaacgacatccagaagaccctggacgacatcgtgggcagatacgaggacctgagcaagagcgtgaacgagagaaacgagaagctgcagatcaccctgaccagaagcctgagcgtgcaggacggcctggacgagatgctggactggatgggcaacgtggagagcagcctgaaggagcagggccaggtgcccctgaacagcaccgccctgcaggacatcatcagcaagaacatcatgctggagcaggacatcgccggcagacagagcagcatcaacgccatgaacgagaaggtgaagaagttcatggagaccaccgaccccagcaccgccagcagcctgcaggccaagatgaaggacctgagcgccagattcagcgaggccagccacaagcacaaggagaccctggccaagatggaggagctgaagaccaaggtggagctgttcgagaacctgagcgagaagctgcagaccttcctggagaccaagacccaggccctgaccgaggtggacgtgcccggcaaggacgtgaccgagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggacgccttccaggtgctggtgaagagcctgaagagctggatcaaggagaccaccaagaaggtgcccatcgtgcagcccagcttcggcgccgaggacctgggcaagagcctggaggacaccaagaagctgcaggagaagtggagcctgaagacccccgagatccagaaggtgaacaacagcggcatcagcctgtgcaacctgatcagcgccgtgaccacccccgccaaggccatcgccgccgtgaagagcggcggcgccgtgctgaacggcgagggcaccgccaccaacaccgaggagttctgggccaacaagggcctgaccagcatcaagaaggacatgaccgacatcagccacggctacgaggacctgggcctgctgctgaaggacaagatcgccgagctgaacaccaagctgagcaagctgcagaaggcccaggaggagagcagcgccatgatgcagtggctgcagaagatgaacaagaccgccaccaagtggcagcagacccccgcccccaccgacaccgaggccgtgaagacccaggtggagcagaacaagagcttcgaggccgagctgaagcagaacgtgaacaaggtgcaggagctgaaggacaagctgaccgagctgctggaggagaaccccgacacccccgaggcccccagatggaagcagatgctgaccgagatcgacagcaagtggcaggagctgaaccagctgaccatcgacagacagcagaagctggaggagagcagcaacaacctgacccagttccagaccgtggaggcccagctgaagcagtggctggtggagaaggagctgatggtgagcgtgctgggccccctgagcatcgaccccaacatgctgaacacccagagacagcaggtgcagatcctgctgcaggagttcgccaccagaaagccccagtacgagcagctgaccgccgccggccagggcatcctgagcagacccggcgaggaccccagcctgagaggcatcgtgaaggagcagctggccgccgtgacccagaagtgggacagcctgaccggccagctgagcgacagatgcgactggatcgaccaggccatcgtgaagagcacccagtaccagagcctgctgagaagcctgagcgacaagctgagcgacctggacaacaagctgagcagcagcctggccgtgagcacccaccccgacgccatgaaccagcagctggagaccgcccagaagatgaagcaggagatccagcaggagaagaagcagatcaaggtggcccaggccctgtgcgaggacctgagcgccctggtgaaggaggagtacctgaaggccgagctgagcagacagctggagggcatcctgaagagcttcaaggacgtggagcagaaggccgagaaccacgtgcagcacctgcagagcgcctgcgccagcagccaccagttccagcagatgagcagagacttccaggcctggctggacaccaagaaggaggagcagaacaagagccaccccatcagcgccaagctggacgtgctggagagcctgatcaaggaccacaaggacttcagcaagaccctgaccgcccagagccacatgtacgagaagaccatcgccgagggcgagaacctgctgctgaagacccagggcagcgagaaggccgccctgcagctgcagctgaacaccatcaagaccaactgggacaccttcaacaagcaggtgaaggagagagagaacaagctgaaggagagcctggagaaggccctgaagtacaaggagcaggtggagaccctgtggccctggatcgacaagtgccagaacaacctggaggagatcaagttctgcctggaccccgccgagggcgagaacagcatcgccaagctgaagagcctgcagaaggagatggaccagcacttcggcatggtggagctgctgaacaacaccgccaacagcctgctgagcgtgtgcgagatcgacaaggaggtggtgaccgacgagaacaagagcctgatccagaaggtggacatggtgaccgagcagctgcacagcaagaagttctgcctggagaacatgacccagaagttcaaggagttccaggaggtgagcaaggagagcaagagacagctgcagtgcgccaaggagcagctggacatccacgacagcctgggcagccaggcctacagcaacaagtacctgaccatgctgcagacccagcagaagagcctgcaggccctgaagcaccaggtggacctggccaagagactggcccaggacctggtggtggaggccagcgacagcaagggcaccagcgacgtgctgctgcaggtggagaccatcgcccaggagcacagcaccctgagccagcaggtggacgagaagtgcagcttcctggagaccaagctgcagggcatcggccacttccagaacaccatcagagagatgttcagccagttcgccgagttcgacgacgagctggacagcatggcccccgtgggcagagacgccgagaccctgcagaagcagaaggagaccatcaaggccttcctgaagaagctggaggccctgatggccagcaacgacaacgccaacaagacctgcaagatgatgctggccaccgaggagaccagccccgacctggtgggcatcaagagagacctggaggccctgagcaagcagtgcaacaagctgctggacagagcccaggccagagaggagcaggtggagggcaccatcaagagactggaggagttctacagcaagctgaaggagttcagcatcctgctgcagaaggccgaggagcacgaggagagccagggccccgtgggcatggagaccgagaccatcaaccagcagctgaacatgttcaaggtgttccagaaggaggagatcgagcccctgcagggcaagcagcaggacgtgaactggctgggccagggcctgatccagagcgccgccaagagcaccagcacccagggcctggagcacgacctggacgacgtgaacgccagatggaagaccctgaacaagaaggtggcccagagagccgcccagctgcaggaggccctgctgcactgcggcagattccaggacgccctggagagcctgctgagctggatggtggacaccgaggagctggtggccaaccagaagccccccagcgccgagttcaaggtggtgaaggcccagatccaggagcagaagctgctgcagagactgctggacgacagaaagagcaccgtggaggtgatcaagagagagggcgagaagatcgccaccaccgccgagcccgccgacaaggtgaagatcctgaagcagctgagcctgctggacagcagatgggaggccctgctgaacaaggccgagaccagaaacagacagctggagggcatcagcgtggtggcccagcagttccacgagaccctggagcccctgaacgagtggctgaccaccatcgagaagagactggtgaactgcgagcccatcggcacccaggccagcaagctggaggagcagatcgcccagcacaaggccctggaggacgacatcatcaaccacaacaagcacctgcaccaggccgtgagcatcggccagagcctgaaggtgctgagcagcagagaggacaaggacatggtgcagagcaagctggacttcagccaggtgtggtacatcgagatccaggagaagagccacagcagaagcgagctgctgcagcaggccctgtgcaacgccaagatcttcggcgaggacgaggtggagctgatgaactggctgaacgaggtgcacgacaagctgagcaagctgagcgtgcaggactacagcaccgagggcctgtggaagcagcagagcgagctgagagtgctgcaggaggacatcctgctgagaaagcagaacgtggaccaggccctgctgaacggcctggagctgctgaagcagaccaccggcgacgaggtgctgatcatccaggacaagctggaggccatcaaggccagatacaaggacatcaccaagctgagcaccgacgtggccaagaccctggagcaggccctgcagctggccagaagactgcacagcacccacgaggagctgtgcacctggctggacaaggtggaggtggagctgctgagctacgagacccaggtgctgaagggcgaggaggccagccaggcccagatgagacccaaggagctgaagaaggaggccaagaacaacaaggccctgctggacagcctgaacgaggtgagcagcgccctgctggagctggtgccctggagagccagagagggcctggagaagatggtggccgaggacaacgagagatacagactggtgagcgacaccatcacccagaaggtggaggagatcgacgccgccatcctgagaagccagcagttcgaccaggccgccgacgccgagctgagctggatcaccgagaccgagaagaagctgatgagcctgggcgacatcagactggagcaggaccagaccagcgcccagctgcaggtgcagaagaccttcaccatggagatcctgagacacaaggacatcatcgacgacctggtgaagagcggccacaagatcatgaccgcctgcagcgaggaggagaagcagagcatgaagaagaagctggacaaggtgctgaagaactacgacaccatctgccagatcaacagcgagagatacctgcagctggagagagcccagagcctggtgaaccagttctgggagacctacgaggagctgtggccctggctgaccgagacccagagcatcatcagccagctgcccgcccccgccctggagtacgagaccctgagacagcagcaggaggagcacagacagctgagagagctgatcgccgagcacaagccccacatcgacaagatgaacaagaccggcccccagctgctggagctgagccccggcgagggcttcagcatccaggagaagtacgtggccgccgacaccctgtacagccagatcaaggaggacgtgaagaagagagccgtggccctggacgaggccatcagccagagcacccagttccacgacaagatcgaccagatcctggagagcctggagagaatcgtggagagactgagacagccccccagcatcagcgccgaggtggagaagatcaaggagcagatcagcgagaacaagaacgtgagcgtggacatggagaagctgcagcccctgtacgagaccctgaagcagagaggcgaggagatgatcgccagaagcggcggcaccgacaaggacatcagcgccaaggccgtgcaggacaagctggaccagatggtgttcatctgggagaacatccacaccctggtggaggagagagaggccaagctgctggacgtgatggagctggccgagaagttctggtgcgaccacatgagcctgatcgtgaccatcaaggacacccaggacttcatcagagacctggaggaccccggcatcgaccccagcgtggtgaagcagcagcaggaggccgccgagaccatcagagaggagatcgacggcctgcaggaggagctggacatcgtgatcaacctgggcagcgagctgatcgccgcctgcggcgagcccgacaagcccatcgtgaagaagagcatcgacgagctgaacagcgcctgggacagcctgaacaaggcctggaaggacagaatcgacaagctggaggaggccatgcaggccgccgtgcagtaccaggacggcctgcaggccgtgttcgactgggtggacatcgccggcggcaagctggccagcatgagccccatcggcaccgacctggagaccgtgaagcagcagatcgaggagctgaagcagttcaagagcgaggcctaccagcagcagatcgagatggagagactgaaccaccaggccgagctgctgctgaagaaggtgaccgaggagagcgacaagcacaccgtgcaggaccccctgatggagctgaagctgatctgggacagcctggaggagagaatcatcaacagacagcacaagctggagggcgccctgctggccctgggccagttccagcacgccctggacgagctgctggcctggctgacccacaccgagggcctgctgagcgagcagaagcccgtgggcggcgaccccaaggccatcgagatcgagctggccaagcaccacgtgctgcagaacgacgtgctggcccaccagagcaccgtggaggccgtgaacaaggccggcaacgacctgatcgagagcagcgccggcgaggaggccagcaacctgcagaacaagctggaggtgctgaaccagagatggcagaacgtgctggagaagaccgagcagagaaagcagcagctggacggcgccctgagacaggccaagggcttccacggcgagatcgaggacctgcagcagtggctgaccgacaccgagagacacctgctggccagcaagcccctgggcggcctgcccgagaccgccaaggagcagctgaacgtgcacatggaggtgtgcgccgccttcgaggccaaggaggagacctacaagagcctgatgcagaagggccagcagatgctggccagatgccccaagagcgccgagaccaacatcgaccaggacatcaacaacctgaaggagaagtgggagagcgtggagaccaagctgaacgagagaaagaccaagctggaggaggccctgaacctggccatggagttccacaacagcctgcaggacttcatcaactggctgacccaggccgagcagaccctgaacgtggccagcagacccagcctgatcctggacaccgtgctgttccagatcgacgagcacaaggtgttcgccaacgaggtgaacagccacagagagcagatcatcgagctggacaagaccggcacccacctgaagtacttcagccagaagcaggacgtggtgctgatcaagaacctgctgatcagcgtgcagagcagatgggagaaggtggtgcagagactggtggagagaggcagaagcctggacgacgccagaaagagagccaagcagttccacgaggcctggagcaagctgatggagtggctggaggagagcgagaagagcctggacagcgagctggagatcgccaacgaccccgacaagatcaagacccagctggcccagcacaaggagttccagaagagcctgggcgccaagcacagcgtgtacgacaccaccaacagaaccggcagaagcctgaaggagaagaccagcctggccgacgacaacctgaagctggacgacatgctgagcgagctgagagacaagtgggacaccatctgcggcaagagcgtggagagacagaacaagctggaggaggccctgctgttcagcggccagttcaccgacgccctgcaggccctgatcgactggctgtacagagtggagccccagctggccgaggaccagcccgtgcacggcgacatcgacctggtgatgaacctgatcgacaaccacaaggccttccagaaggagctgggcaagagaaccagcagcgtgcaggccctgaagagaagcgccagagagctgatcgagggcagcagagacgacagcagctgggtgaaggtgcagatgcaggagctgagcaccagatgggagaccgtgtgcgccctgagcatcagcaagcagaccagactggaggccgccctgagacaggccgaggagttccacagcgtggtgcacgccctgctggagtggctggccgaggccgagcagaccctgagattccacggcgtgctgcccgacgacgaggacgccctgagaaccctgatcgaccagcacaaggagttcatgaagaagctggaggagaagagagccgagctgaacaaggccaccaccatgggcgacaccgtgctggccatctgccaccccgacagcatcaccaccatcaagcactggatcaccatcatcagagccagattcgaggaggtgctggcctgggccaagcagcaccagcagagactggccagcgccctggccggcctgatcgccaagcaggagctgctggaggccctgctggcctggctgcagtgggccgagaccaccctgaccgacaaggacaaggaggtgatcccccaggagatcgaggaggtgaaggccctgatcgccgagcaccagaccttcatggaggagatgaccagaaagcagcccgacgtggacaaggtgaccaagacctacaagagaagagccgccgaccccagcagcctgcagagccacatccccgtgctggacaagggcagagccggcagaaagagattccccgccagcagcctgtaccccagcggcagccagacccagatcgagaccaagaaccccagagtgaacctgctggtgagcaagtggcagcaggtgtggctgctggccctggagagaagaagaaagctgaacgacgccctggacagactggaggagctgagagagttcgccaacttcgacttcgacatctggagaaagaagtacatgagatggatgaaccacaagaagagcagagtgatggacttcttcagaagaatcgacaaggaccaggacggcaagatcaccagacaggagttcatcgacggcatcctgagcagcaagttccccaccagcagactggagatgagcgccgtggccgacatcttcgacagagacggcgacggctacatcgactactacgagttcgtggccgccctgcaccccaacaaggacgcctacaagcccatcaccgacgccgacaagatcgaggacgaggtgaccagacaggtggccaagtgcaagtgcgccaagagattccaggtggagcagatcggcgacaacaagtacagagtgagcttccagagcaacttcggcgacagccagcagctgagactggtgagaatcctgagaagcaccgtgatggtgagagtgggcggcggctggatggccctggacgagttcctggtgaagaacgacccctgcagagtgcaccaccacggcagcaagatgctgagaagcgagagcaacagcagcatcaccaccacccagcccaccatcgccaagggcagaaccaacatggagctgagagagaagttcatcctggccgacggcgccagccagggcatggccgccttcagacccagaggcagaagaagcagacccagcagcagaggcgccagccccaacagaagcaccagcgtgagcagccaggccgcccaggccgccagcccccaggtgcccgccaccaccacccccaagggcacccccatccagggcagcaagctgagactgcccggctacctgagcggcaagggcttccacagcggcgaggacagcggcctgatcaccaccgccgccgccagagtgagaacccagttcgccgacagcaagaagacccccagcagacccggcagcagagccggcagcaaggccggcagcagagccagcagcagaagaggcagcgacgccagcgacttcgacatcagcgagatccagagcgtgtgcagcgacgtggagaccgtgccccagacccacagacccacccccagagccggcagcagacccagcaccgccaagcccagcaagatccccaccccccagagaaagagccccgccagcaagctggacaagagcagcaagagatag

SEQ ID NO: 79921 - DNA, 16374 bp, Artificial Sequence
  Description of Artificial Sequence: Synthetic coding sequence
atggccggctacctgagccccgccgcctacctgtacgtggaggagcaggagtacctgcaggcctacgaggacgtgctggagagatacaaggacgagagagacaaggtgcagaagaagaccttcaccaagtggatcaaccagcacctgatgaaggtgagaaagcacgtgaacgacctgtacgaggacctgagagacggccacaacctgatcagcctgctggaggtgctgagcggcgacaccctgcccagagagaagggcagaatgagattccacagactgcagaacgtgcagatcgccctggactacctgaagagaagacaggtgaagctggtgaacatcagaaacgacgacatcaccgacggcaaccccaagctgaccctgggcctgatctggaccatcatcctgcacttccagatcagcgacatccacgtgaccggcgagagcgaggacatgagcgccaaggagagactgctgctgtggacccagcaggccaccgagggctacgccggcatcagatgcgagaacttcaccacctgctggagagacggcaagctgttcaacgccatcatccacaagtacagacccgacctgatcgacatgaacaccgtggccgtgcagagcaacctggccaacctggagcacgccttctacgtggccgagaagatcggcgtgatcagactgctggaccccgaggacgtggacgtgagcagccccgacgagaagagcgtgatcacctacgtgagcagcctgtacgacgccttccccaaggtgcccgagggcggcgagggcatcggcgccaacgacgtggaggtgaagtggatcgagtaccagaacatggtgaactacctgatccagtggatcagacaccacgtgaccaccatgagcgagagaaccttccccaacaaccccgtggagctgaaggccctgtacaaccagtacctgcagttcaaggagaccgagatcccccccaaggagaccgagaagagcaagatcaagagactgtacaagctgctggagatctggatcgagttcggcagaatcaagctgctgcagggctaccaccccaacgacatcgagaaggagtggggcaagctgatcatcgccatgctggagagagagaaggccctgagacccgaggtggagagactggagatgctgcagcagatcgccaacagagtgcagagagacagcgtgatctgcgaggacaagctgatcctggccggcaacgccctgcagagcgacagcaagagactggagagcggcgtgcagttccagaacgaggccgagatcgccggctacatcctggagtgcgagaacctgctgagacagcacgtgatcgacgtgcagatcctgatcgacggcaagtactaccaggccgaccagctggtgcagagagtggccaagctgagagacgagatcatggccctgagaaacgagtgcagcagcgtgtacagcaagggcagaatcctgaccaccgagcagaccaagctgatgatcagcggcatcacccagagcctgaacagcggcttcgcccagaccctgcaccccagcctgaccagcggcctgacccagagcctgacccccagcctgaccagcagcagcatgaccagcggcctgagcagcggcatgaccagcagactgacccccagcgtgacccccgcctacacccccggcttccccagcggcctggtgcccaacttcagcagcggcgtggagcccaacagcctgcagaccctgaagctgatgcagatcagaaagcccctgctgaagagcagcctgctggaccagaacctgaccgaggaggagatcaacatgaagttcgtgcaggacctgctgaactgggtggacgagatgcaggtgcagctggacagaaccgagtggggcagcgacctgcccagcgtggagagccacctggagaaccacaagaacgtgcacagagccatcgaggagttcgagagcagcctgaaggaggccaagatcagcgagatccagatgaccgcccccctgaagctgacctacgccgagaagctgcacagactggagagccagtacgccaagctgctgaacaccagcagaaaccaggagagacacctggacaccctgcacaacttcgtgagcagagccaccaacgagctgatctggctgaacgagaaggaggaggaggaggtggcctacgactggagcgagagaaacaccaacatcgccagaaagaaggactaccacgccgagctgatgagagagctggaccagaaggaggagaacatcaagagcgtgcaggagatcgccgagcagctgctgctggagaaccaccccgccagactgaccatcgaggcctacagagccgccatgcagacccagtggagctggatcctgcagctgtgccagtgcgtggagcagcacatcaaggagaacaccgcctacttcgagttcttcaacgacgccaaggaggccaccgactacctgagaaacctgaaggacgccatccagagaaagtacagctgcgacagaagcagcagcatccacaagctggaggacctggtgcaggagagcatggaggagaaggaggagctgctgcagtacaagagcaccatcgccaacctgatgggcaaggccaagaccatcatccagctgaagcccagaaacagcgactgccccctgaagaccagcatccccatcaaggccatctgcgactacagacagatcgagatcaccatctacaaggacgacgagtgcgtgctggccaacaacagccacagagccaagtggaaggtgatcagccccaccggcaacgaggccatggtgcccagcgtgtgcttcaccgtgcccccccccaacaaggaggccgtggacctggccaacagaatcgagcagcagtaccagaacgtgctgaccctgtggcacgagagccacatcaacatgaagagcgtggtgagctggcactacctgatcaacgagatcgacagaatcagagccagcaacgtggccagcatcaagaccatgctgcccggcgagcaccagcaggtgctgagcaacctgcagagcagattcgaggacttcctggaggacagccaggagagccaggtgttcagcggcagcgacatcacccagctggagaaggaggtgaacgtgtgcaagcagtactaccaggagctgctgaagagcgccgagagagaggagcaggaggagagcgtgtacaacctgtacatcagcgaggtgagaaacatcagactgagactggagaactgcgaggacagactgatcagacagatcagaacccccctggagagagacgacctgcacgagagcgtgttcagaatcaccgagcaggagaagctgaagaaggagctggagagactgaaggacgacctgggcaccatcaccaacaagtgcgaggagttcttcagccaggccgccgccagcagcagcgtgcccaccctgagaagcgagctgaacgtggtgctgcagaacatgaaccaggtgtacagcatgagcagcacctacatcgacaagctgaagaccgtgaacctggtgctgaagaacacccaggccgccgaggccctggtgaagctgtacgagaccaagctgtgcgaggaggaggccgtgatcgccgacaagaacaacatcgagaacctgatcagcaccctgaagcagtggagaagcgaggtggacgagaagagacaggtgttccacgccctggaggacgagctgcagaaggccaaggccatcagcgacgagatgttcaagacctacaaggagagagacctggacttcgactggcacaaggagaaggccgaccagctggtggagagatggcagaacgtgcacgtgcagatcgacaacagactgagagacctggagggcatcggcaagagcctgaagtactacagagacacctaccaccccctggacgactggatccagcaggtggagaccacccagagaaagatccaggagaaccagcccgagaacagcaagaccctggccacccagctgaaccagcagaagatgctggtgagcgagatcgagatgaagcagagcaagatggacgagtgccagaagtacgccgagcagtacagcgccaccgtgaaggactacgagctgcagaccatgacctacagagccatggtggacagccagcagaagagccccgtgaagagaagaagaatgcagagcagcgccgacctgatcatccaggagttcatggacctgagaaccagatacaccgccctggtgaccctgatgacccagtacatcaagttcgccggcgacagcctgaagagactggaggaggaggagaagagcctggaggaggagaagaaggagcacgtggagaaggccaaggagctgcagaagtgggtgagcaacatcagcaagaccctgaaggacgccgagaaggccggcaagccccccttcagcaagcagaagatcagcagcgaggagatcagcaccaagaaggagcagctgagcgaggccctgcagaccatccagctgttcctggccaagcacggcgacaagatgaccgacgaggagagaaacgagctggagaagcaggtgaagaccctgcaggagagctacaacctgctgttcagcgagagcctgaagcagctgcaggagagccagaccagcggcgacgtgaaggtggaggagaagatcgtggccgagagacagcaggagtacaaggagaagctgcagggcatctgcgacctgctgacccagaccgagaacagactgatcggccaccaggaggccttcatgatcggcgacggcaccgtggagctgaagaagtaccagagcaagcaggaggagctgcagaaggacatgcagggcagcgcccaggccctggccgaggtggtgaagaacaccgagaacttcctgaaggagaacggcgagaagctgagccaggaggacaaggccctgatcgagcagaagctgaacgaggccaagatcaagtgcgagcagctgaacctgaaggccgagcagagcaagaaggagctggacaaggtggtgaccaccgccatcaaggaggagaccgagaaggtggccgccgtgaagcagctggaggagagcaagaccaagatcgagaacctgctggactggctgagcaacgtggacaaggacagcgagagagccggcaccaagcacaagcaggtgatcgagcagaacggcacccacttccaggagggcgacggcaagagcgccatcggcgaggaggacgaggtgaacggcaacctgctggagaccgacgtggacggccaggtgggcaccacccaggagaacctgaaccagcagtaccagaaggtgaaggcccagcacgagaagatcatcagccagcaccaggccgtgatcatcgccacccagagcgcccaggtgctgctggagaagcagggccagtacctgagccccgaggagaaggagaagctgcagaagaacatgaaggagctgaaggtgcactacgagaccgccctggccgagagcgagaagaagatgaagctgacccacagcctgcaggaggagctggagaagttcgacgccgactacaccgagttcgagcactggctgcagcagagcgagcaggagctggagaacctggaggccggcgccgacgacatcaacggcctgatgaccaagctgaagagacagaagagcttcagcgaggacgtgatcagccacaagggcgacctgagatacatcaccatcagcggcaacagagtgctggaggccgccaagagctgcagcaagagagacggcggcaaggtggacaccagcgccacccacagagaggtgcagagaaagctggaccacgccaccgacagattcagaagcctgtacagcaagtgcaacgtgctgggcaacaacctgaaggacctggtggacaagtaccagcactacgaggacgccagctgcggcctgctggccggcctgcaggcctgcgaggccaccgccagcaagcacctgagcgagcccatcgccgtggaccccaagaacctgcagagacagctggaggagaccaaggccctgcagggccagatcagcagccagcaggtggccgtggagaagctgaagaagaccgccgaggtgctgctggacgccagaggcagcctgctgcccgccaagaacgacatccagaagaccctggacgacatcgtgggcagatacgaggacctgagcaagagcgtgaacgagagaaacgagaagctgcagatcaccctgaccagaagcctgagcgtgcaggacggcctggacgagatgctggactggatgggcaacgtggagagcagcctgaaggagcagggccaggtgcccctgaacagcaccgccctgcaggacatcatcagcaagaacatcatgctggagcaggacatcgccggcagacagagcagcatcaacgccatgaacgagaaggtgaagaagttcatggagaccaccgaccccagcaccgccagcagcctgcaggccaagatgaaggacctgagcgccagattcagcgaggccagccacaagcacaaggagaccctggccaagatggaggagctgaagaccaaggtggagctgttcgagaacctgagcgagaagctgcagaccttcctggagaccaagacccaggccctgaccgaggtggacgtgcccggcaaggacgtgaccgagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggacgccttccaggtgctggtgaagagcctgaagagctggatcaaggagaccaccaagaaggtgcccatcgtgcagcccagcttcggcgccgaggacctgggcaagagcctggaggacaccaagaagctgcaggagaagtggagcctgaagacccccgagatccagaaggtgaacaacagcggcatcagcctgtgcaacctgatcagcgccgtgaccacccccgccaaggccatcgccgccgtgaagagcggcggcgccgtgctgaacggcgagggcaccgccaccaacaccgaggagttctgggccaacaagggcctgaccagcatcaagaaggacatgaccgacatcagccacggctacgaggacctgggcctgctgctgaaggacaagatcgccgagctgaacaccaagctgagcaagctgcagaaggcccaggaggagagcagcgccatgatgcagtggctgcagaagatgaacaagaccgccaccaagtggcagcagacccccgcccccaccgacaccgaggccgtgaagacccaggtggagcagaacaagagcttcgaggccgagctgaagcagaacgtgaacaaggtgcaggagctgaaggacaagctgaccgagctgctggaggagaaccccgacacccccgaggcccccagatggaagcagatgctgaccgagatcgacagcaagtggcaggagctgaaccagctgaccatcgacagacagcagaagctggaggagagcagcaacaacctgacccagttccagaccgtggaggcccagctgaagcagtggctggtggagaaggagctgatggtgagcgtgctgggccccctgagcatcgaccccaacatgctgaacacccagagacagcaggtgcagatcctgctgcaggagttcgccaccagaaagccccagtacgagcagctgaccgccgccggccagggcatcctgagcagacccggcgaggaccccagcctgagaggcatcgtgaaggagcagctggccgccgtgacccagaagtgggacagcctgaccggccagctgagcgacagatgcgactggatcgaccaggccatcgtgaagagcacccagtaccagagcctgctgagaagcctgagcgacaagctgagcgacctggacaacaagctgagcagcagcctggccgtgagcacccaccccgacgccatgaaccagcagctggagaccgcccagaagatgaagcaggagatccagcaggagaagaagcagatcaaggtggcccaggccctgtgcgaggacctgagcgccctggtgaaggaggagtacctgaaggccgagctgagcagacagctggagggcatcctgaagagcttcaaggacgtggagcagaaggccgagaaccacgtgcagcacctgcagagcgcctgcgccagcagccaccagttccagcagatgagcagagacttccaggcctggctggacaccaagaaggaggagcagaacaagagccaccccatcagcgccaagctggacgtgctggagagcctgatcaaggaccacaaggacttcagcaagaccctgaccgcccagagccacatgtacgagaagaccatcgccgagggcgagaacctgctgctgaagacccagggcagcgagaaggccgccctgcagctgcagctgaacaccatcaagaccaactgggacaccttcaacaagcaggtgaaggagagagagaacaagctgaaggagagcctggagaaggccctgaagtacaaggagcaggtggagaccctgtggccctggatcgacaagtgccagaacaacctggaggagatcaagttctgcctggaccccgccgagggcgagaacagcatcgccaagctgaagagcctgcagaaggagatggaccagcacttcggcatggtggagctgctgaacaacaccgccaacagcctgctgagcgtgtgcgagatcgacaaggaggtggtgaccgacgagaacaagagcctgatccagaaggtggacatggtgaccgagcagctgcacagcaagaagttctgcctggagaacatgacccagaagttcaaggagttccaggaggtgagcaaggagagcaagagacagctgcagtgcgccaaggagcagctggacatccacgacagcctgggcagccaggcctacagcaacaagtacctgaccatgctgcagacccagcagaagagcctgcaggccctgaagcaccaggtggacctggccaagagactggcccaggacctggtggtggaggccagcgacagcaagggcaccagcgacgtgctgctgcaggtggagaccatcgcccaggagcacagcaccctgagccagcaggtggacgagaagtgcagcttcctggagaccaagctgcagggcatcggccacttccagaacaccatcagagagatgttcagccagttcgccgagttcgacgacgagctggacagcatggcccccgtgggcagagacgccgagaccctgcagaagcagaaggagaccatcaaggccttcctgaagaagctggaggccctgatggccagcaacgacaacgccaacaagacctgcaagatgatgctggccaccgaggagaccagccccgacctggtgggcatcaagagagacctggaggccctgagcaagcagtgcaacaagctgctggacagagcccaggccagagaggagcaggtggagggcaccatcaagagactggaggagttctacagcaagctgaaggagttcagcatcctgctgcagaaggccgaggagcacgaggagagccagggccccgtgggcatggagaccgagaccatcaaccagcagctgaacatgttcaaggtgttccagaaggaggagatcgagcccctgcagggcaagcagcaggacgtgaactggctgggccagggcctgatccagagcgccgccaagagcaccagcacccagggcctggagcacgacctggacgacgtgaacgccagatggaagaccctgaacaagaaggtggcccagagagccgcccagctgcaggaggccctgctgcactgcggcagattccaggacgccctggagagcctgctgagctggatggtggacaccgaggagctggtggccaaccagaagccccccagcgccgagttcaaggtggtgaaggcccagatccaggagcagaagctgctgcagagactgctggacgacagaaagagcaccgtggaggtgatcaagagagagggcgagaagatcgccaccaccgccgagcccgccgacaaggtgaagatcctgaagcagctgagcctgctggacagcagatgggaggccctgctgaacaaggccgagaccagaaacagacagctggagggcatcagcgtggtggcccagcagttccacgagaccctggagcccctgaacgagtggctgaccaccatcgagaagagactggtgaactgcgagcccatcggcacccaggccagcaagctggaggagcagatcgcccagcacaaggccctggaggacgacatcatcaaccacaacaagcacctgcaccaggccgtgagcatcggccagagcctgaaggtgctgagcagcagagaggacaaggacatggtgcagagcaagctggacttcagccaggtgtggtacatcgagatccaggagaagagccacagcagaagcgagctgctgcagcaggccctgtgcaacgccaagatcttcggcgaggacgaggtggagctgatgaactggctgaacgaggtgcacgacaagctgagcaagctgagcgtgcaggactacagcaccgagggcctgtggaagcagcagagcgagctgagagtgctgcaggaggacatcctgctgagaaagcagaacgtggaccaggccctgctgaacggcctggagctgctgaagcagaccaccggcgacgaggtgctgatcatccaggacaagctggaggccatcaaggccagatacaaggacatcaccaagctgagcaccgacgtggccaagaccctggagcaggccctgcagctggccagaagactgcacagcacccacgaggagctgtgcacctggctggacaaggtggaggtggagctgctgagctacgagacccaggtgctgaagggcgaggaggccagccaggcccagatgagacccaaggagctgaagaaggaggccaagaacaacaaggccctgctggacagcctgaacgaggtgagcagcgccctgctggagctggtgccctggagagccagagagggcctggagaagatggtggccgaggacaacgagagatacagactggtgagcgacaccatcacccagaaggtggaggagatcgacgccgccatcctgagaagccagcagttcgaccaggccgccgacgccgagctgagctggatcaccgagaccgagaagaagctgatgagcctgggcgacatcagactggagcaggaccagaccagcgcccagctgcaggtgcagaagaccttcaccatggagatcctgagacacaaggacatcatcgacgacctggtgaagagcggccacaagatcatgaccgcctgcagcgaggaggagaagcagagcatgaagaagaagctggacaaggtgctgaagaactacgacaccatctgccagatcaacagcgagagatacctgcagctggagagagcccagagcctggtgaaccagttctgggagacctacgaggagctgtggccctggctgaccgagacccagagcatcatcagccagctgcccgcccccgccctggagtacgagaccctgagacagcagcaggaggagcacagacagctgagagagctgatcgccgagcacaagccccacatcgacaagatgaacaagaccggcccccagctgctggagctgagccccggcgagggcttcagcatccaggagaagtacgtggccgccgacaccctgtacagccagatcaaggaggacgtgaagaagagagccgtggccctggacgaggccatcagccagagcacccagttccacgacaagatcgaccagatcctggagagcctggagagaatcgtggagagactgagacagccccccagcatcagcgccgaggtggagaagatcaaggagcagatcagcgagaacaagaacgtgagcgtggacatggagaagctgcagcccctgtacgagaccctgaagcagagaggcgaggagatgatcgccagaagcggcggcaccgacaaggacatcagcgccaaggccgtgcaggacaagctggaccagatggtgttcatctgggagaacatccacaccctggtggaggagagagaggccaagctgctggacgtgatggagctggccgagaagttctggtgcgaccacatgagcctgatcgtgaccatcaaggacacccaggacttcatcagagacctggaggaccccggcatcgaccccagcgtggtgaagcagcagcaggaggccgccgagaccatcagagaggagatcgacggcctgcaggaggagctggacatcgtgatcaacctgggcagcgagctgatcgccgcctgcggcgagcccgacaagcccatcgtgaagaagagcatcgacgagctgaacagcgcctgggacagcctgaacaaggcctggaaggacagaatcgacaagctggaggaggccatgcaggccgccgtgcagtaccaggacggcctgcaggccgtgttcgactgggtggacatcgccggcggcaagctggccagcatgagccccatcggcaccgacctggagaccgtgaagcagcagatcgaggagctgaagcagttcaagagcgaggcctaccagcagcagatcgagatggagagactgaaccaccaggccgagctgctgctgaagaaggtgaccgaggagagcgacaagcacaccgtgcaggaccccctgatggagctgaagctgatctgggacagcctggaggagagaatcatcaacagacagcacaagctggagggcgccctgctggccctgggccagttccagcacgccctggacgagctgctggcctggctgacccacaccgagggcctgctgagcgagcagaagcccgtgggcggcgaccccaaggccatcgagatcgagctggccaagcaccacgtgctgcagaacgacgtgctggcccaccagagcaccgtggaggccgtgaacaaggccggcaacgacctgatcgagagcagcgccggcgaggaggccagcaacctgcagaacaagctggaggtgctgaaccagagatggcagaacgtgctggagaagaccgagcagagaaagcagcagctggacggcgccctgagacaggccaagggcttccacggcgagatcgaggacctgcagcagtggctgaccgacaccgagagacacctgctggccagcaagcccctgggcggcctgcccgagaccgccaaggagcagctgaacgtgcacatggaggtgtgcgccgccttcgaggccaaggaggagacctacaagagcctgatgcagaagggccagcagatgctggccagatgccccaagagcgccgagaccaacatcgaccaggacatcaacaacctgaaggagaagtgggagagcgtggagaccaagctgaacgagagaaagaccaagctggaggaggccctgaacctggccatggagttccacaacagcctgcaggacttcatcaactggctgacccaggccgagcagaccctgaacgtggccagcagacccagcctgatcctggacaccgtgctgttccagatcgacgagcacaaggtgttcgccaacgaggtgaacagccacagagagcagatcatcgagctggacaagaccggcacccacctgaagtacttcagccagaagcaggacgtggtgctgatcaagaacctgctgatcagcgtgcagagcagatgggagaaggtggtgcagagactggtggagagaggcagaagcctggacgacgccagaaagagagccaagcagttccacgaggcctggagcaagctgatggagtggctggaggagagcgagaagagcctggacagcgagctggagatcgccaacgaccccgacaagatcaagacccagctggcccagcacaaggagttccagaagagcctgggcgccaagcacagcgtgtacgacaccaccaacagaaccggcagaagcctgaaggagaagaccagcctggccgacgacaacctgaagctggacgacatgctgagcgagctgagagacaagtgggacaccatctgcggcaagagcgtggagagacagaacaagctggaggaggccctgctgttcagcggccagttcaccgacgccctgcaggccctgatcgactggctgtacagagtggagccccagctggccgaggaccagcccgtgcacggcgacatcgacctggtgatgaacctgatcgacaaccacaaggccttccagaaggagctgggcaagagaaccagcagcgtgcaggccctgaagagaagcgccagagagctgatcgagggcagcagagacgacagcagctgggtgaaggtgcagatgcaggagctgagcaccagatgggagaccgtgtgcgccctgagcatcagcaagcagaccagactggaggccgccctgagacaggccgaggagttccacagcgtggtgcacgccctgctggagtggctggccgaggccgagcagaccctgagattccacggcgtgctgcccgacgacgaggacgccctgagaaccctgatcgaccagcacaaggagttcatgaagaagctggaggagaagagagccgagctgaacaaggccaccaccatgggcgacaccgtgctggccatctgccaccccgacagcatcaccaccatcaagcactggatcaccatcatcagagccagattcgaggaggtgctggcctgggccaagcagcaccagcagagactggccagcgccctggccggcctgatcgccaagcaggagctgctggaggccctgctggcctggctgcagtgggccgagaccaccctgaccgacaaggacaaggaggtgatcccccaggagatcgaggaggtgaaggccctgatcgccgagcaccagaccttcatggaggagatgaccagaaagcagcccgacgtggacaaggtgaccaagacctacaagagaagagccgccgaccccagcagcctgcagagccacatccccgtgctggacaagggcagagccggcagaaagagattccccgccagcagcctgtaccccagcggcagccagacccagatcgagaccaagaaccccagagtgaacctgctgctgagagagttcgccaacttcgacttcgacatctggagaaagaagtacatgagatggatgaaccacaagaagagcagagtgatggacttcttcagaagaatcgacaaggaccaggacggcaagatcaccagacaggagttcatcgacggcatcctgagcagcaagttccccaccagcagactggagatgagcgccgtggccgacatcttcgacagagacggcgacggctacatcgactactacgagttcgtggccgccctgcaccccaacaaggacgcctacaagcccatcaccgacgccgacaagatcgaggacgaggtgaccagacaggtggccaagtgcaagtgcgccaagagattccaggtggagcagatcggcgacaacaagtacagagtgagcttccagagcaacttcggcgacagccagcagctgagactggtgagaatcctgagaagcaccgtgatggtgagagtgggcggcggctggatggccctggacgagttcctggtgaagaacgacccctgcagagtgcaccaccacggcagcaagatgctgagaagcgagagcaacagcagcatcaccaccacccagcccaccatcgccaagggcagaaccaacatggagctgagagagaagttcatcctggccgacggcgccagccagggcatggccgccttcagacccagaggcagaagaagcagacccagcagcagaggcgccagccccaacagaagcaccagcgtgagcagccaggccgcccaggccgccagcccccaggtgcccgccaccaccacccccaagggcacccccatccagggcagcaagctgagactgcccggctacctgagcggcaagggcttccacagcggcgaggacagcggcctgatcaccaccgccgccgccagagtgagaacccagttcgccgacagcaagaagacccccagcagacccggcagcagagccggcagcaaggccggcagcagagccagcagcagaagaggcagcgacgccagcgacttcgacatcagcgagatccagagcgtgtgcagcgacgtggagaccgtgccccagacccacagacccacccccagagccggcagcagacccagcaccgccaagcccagcaagatccccaccccccagagaaagagccccgccagcaagctggacaagagcagcaagagatag

SEQ ID NO: 79922 - DNA, 9183 bp, Artificial Sequence
  Description of Artificial Sequence: Synthetic coding sequence
atgcacagcagcagctacagctacagaagcagcgacagcgtgttcagcaacaccaccagcaccagaaccagcctggacagcaacgagaacctgctgctggtgcactgcggccccaccctgatcaacagctgcatcagcttcggcagcgagagcttcgacggccacagactggagatgctgcagcagatcgccaacagagtgcagagagacagcgtgatctgcgaggacaagctgatcctggccggcaacgccctgcagagcgacagcaagagactggagagcggcgtgcagttccagaacgaggccgagatcgccggctacatcctggagtgcgagaacctgctgagacagcacgtgatcgacgtgcagatcctgatcgacggcaagtactaccaggccgaccagctggtgcagagagtggccaagctgagagacgagatcatggccctgagaaacgagtgcagcagcgtgtacagcaagggcagaatcctgaccaccgagcagaccaagctgatgatcagcggcatcacccagagcctgaacagcggcttcgcccagaccctgcaccccagcctgaccagcggcctgacccagagcctgacccccagcctgaccagcagcagcatgaccagcggcctgagcagcggcatgaccagcagactgacccccagcgtgacccccgcctacacccccggcttccccagcggcctggtgcccaacttcagcagcggcgtggagcccaacagcctgcagaccctgaagctgatgcagatcagaaagcccctgctgaagagcagcctgctggaccagaacctgaccgaggaggagatcaacatgaagttcgtgcaggacctgctgaactgggtggacgagatgcaggtgcagctggacagaaccgagtggggcagcgacctgcccagcgtggagagccacctggagaaccacaagaacgtgcacagagccatcgaggagttcgagagcagcctgaaggaggccaagatcagcgagatccagatgaccgcccccctgaagctgacctacgccgagaagctgcacagactggagagccagtacgccaagctgctgaacaccagcagaaaccaggagagacacctggacaccctgcacaacttcgtgagcagagccaccaacgagctgatctggctgaacgagaaggaggaggaggaggtggcctacgactggagcgagagaaacaccaacatcgccagaaagaaggactaccacgccgagctgatgagagagctggaccagaaggaggagaacatcaagagcgtgcaggagatcgccgagcagctgctgctggagaaccaccccgccagactgaccatcgaggcctacagagccgccatgcagacccagtggagctggatcctgcagctgtgccagtgcgtggagcagcacatcaaggagaacaccgcctacttcgagttcttcaacgacgccaaggaggccaccgactacctgagaaacctgaaggacgccatccagagaaagtacagctgcgacagaagcagcagcatccacaagctggaggacctggtgcaggagagcatggaggagaaggaggagctgctgcagtacaagagcaccatcgccaacctgatgggcaaggccaagaccatcatccagctgaagcccagaaacagcgactgccccctgaagaccagcatccccatcaaggccatctgcgactacagacagatcgagatcaccatctacaaggacgacgagtgcgtgctggccaacaacagccacagagccaagtggaaggtgatcagccccaccggcaacgaggccatggtgcccagcgtgtgcttcaccgtgcccccccccaacaaggaggccgtggacctggccaacagaatcgagcagcagtaccagaacgtgctgaccctgtggcacgagagccacatcaacatgaagagcgtggtgagctggcactacctgatcaacgagatcgacagaatcagagccagcaacgtggccagcatcaagaccatgctgcccggcgagcaccagcaggtgctgagcaacctgcagagcagattcgaggacttcctggaggacagccaggagagccaggtgttcagcggcagcgacatcacccagctggagaaggaggtgaacgtgtgcaagcagtactaccaggagctgctgaagagcgccgagagagaggagcaggaggagagcgtgtacaacctgtacatcagcgaggtgagaaacatcagactgagactggagaactgcgaggacagactgatcagacagatcagaacccccctggagagagacgacctgcacgagagcgtgttcagaatcaccgagcaggagaagctgaagaaggagctggagagactgaaggacgacctgggcaccatcaccaacaagtgcgaggagttcttcagccaggccgccgccagcagcagcgtgcccaccctgagaagcgagctgaacgtggtgctgcagaacatgaaccaggtgtacagcatgagcagcacctacatcgacaagctgaagaccgtgaacctggtgctgaagaacacccaggccgccgaggccctggtgaagctgtacgagaccaagctgtgcgaggaggaggccgtgatcgccgacaagaacaacatcgagaacctgatcagcaccctgaagcagtggagaagcgaggtggacgagaagagacaggtgttccacgccctggaggacgagctgcagaaggccaaggccatcagcgacgagatgttcaagacctacaaggagagagacctggacttcgactggcacaaggagaaggccgaccagctggtggagagatggcagaacgtgcacgtgcagatcgacaacagactgagagacctggagggcatcggcaagagcctgaagtactacagagacacctaccaccccctggacgactggatccagcaggtggagaccacccagagaaagatccaggagaaccagcccgagaacagcaagaccctggccacccagctgaaccagcagaagatgctggtgagcgagatcgagatgaagcagagcaagatggacgagtgccagaagtacgccgagcagtacagcgccaccgtgaaggactacgagctgcagaccatgacctacagagccatggtggacagccagcagaagagccccgtgaagagaagaagaatgcagagcagcgccgacctgatcatccaggagttcatggacctgagaaccagatacaccgccctggtgaccctgatgacccagtacatcaagttcgccggcgacagcctgaagagactggaggaggaggagaagagcctggaggaggagaagaaggagcacgtggagaaggccaaggagctgcagaagtgggtgagcaacatcagcaagaccctgaaggacgccgagaaggccggcaagccccccttcagcaagcagaagatcagcagcgaggagatcagcaccaagaaggagcagctgagcgaggccctgcagaccatccagctgttcctggccaagcacggcgacaagatgaccgacgaggagagaaacgagctggagaagcaggtgaagaccctgcaggagagctacaacctgctgttcagcgagagcctgaagcagctgcaggagagccagaccagcggcgacgtgaaggtggaggagaagctggacaaggtgatcgccggcaccatcgaccagaccaccggcgaggtgctgagcgtgttccaggccgtgctgagaggcctgatcgactacgacaccggcatcagactgctggagacccagctgatgatcagcggcctgatcagccccgagctgagaaagtgcttcgacctgaaggacgccaagagccacggcctgatcgacgagcagatcctgtgccagctgaaggagctgagcaaggccaaggagatcatcagcgccgccagccccaccaccatccccgtgctggacgccctggcccagagcatgatcaccgagagcatggccatcaaggtgctggagatcctgctgagcaccggcagcctggtgatccccgccaccggcgagcagctgaccctgcagaaggccttccagcagaacctggtgagcagcgccctgttcagcaaggtgctggagagacagaacatgtgcaaggacctgatcgacccctgcaccagcgagaaggtgagcctgatcgacatggtgcagagaagcaccctgcaggagaacaccggcatgtggctgctgcccgtgagaccccaggagggcggcagaatcaccctgaagtgcggcagaaacatcagcatcctgagagccgcccacgagggcctgatcgacagagagaccatgttcagactgctgagcgcccagctgctgagcggcggcctgatcaacagcaacagcggccagagaatgaccgtggaggaggccgtgagagagggcgtgatcgacagagacaccgccagcagcatcctgacctaccaggtgcagaccggcggcatcatccagagcaaccccgccaagagactgaccgtggacgaggccgtgcagtgcgacctgatcaccagcagcagcgccctgctggtgctggaggcccagagaggctacgtgggcctgatctggccccacagcggcgagatcttccccaccagcagcagcctgcagcaggagctgatcaccaacgagctggcctacaagatcctgaacggcagacagaagatcgccgccctgtacatccccgagagcagccaggtgatcggcctggacgccgccaagcagctgggcatcatcgacaacaacaccgccagcatcctgaagaacatcaccctgcccgacaagatgcccgacctgggcgacctggaggcctgcaagaacgccagaagatggctgagcttctgcaagttccagcccagcaccgtgcacgactacagacaggaggaggacgtgttcgacggcgaggagcccgtgaccacccagaccagcgaggagaccaagaagctgttcctgagctacctgatgatcaacagctacatggacgccaacaccggccagagactgctgctgtacgacggcgacctggacgaggccgtgggcatgctgctggagggctgccacgccgagttcgacggcaacaccgccatcaaggagtgcctggacgtgctgagcagcagcggcgtgttcctgaacaacgccagcggcagagagaaggacgagtgcaccgccacccccagcagcttcaacaagtgccactgcggcgagcccgagcacgaggagacccccgagaacagaaagtgcgccatcgacgaggagttcaacgagatgagaaacaccgtgatcaacagcgagttcagccagagcggcaagctggccagcaccatcagcatcgaccccaaggtgaacagcagccccagcgtgtgcgtgcccagcctgatcagctacctgacccagaccgagctggccgacatcagcatgctgagaagcgacagcgagaacatcctgaccaactacgagaaccagagcagagtggagaccaacgagagagccaacgagtgcagccacagcaagaacatccagaacttccccagcgacctgatcgagaaccccatcatgaagagcaagatgagcaagttctgcggcgtgaacgagaccgagaacgaggacaacaccaacagagacagccccatcttcgactacagccccagactgagcgccctgctgagccacgacaagctgatgcacagccagggcagcttcaacgacacccacacccccgagagcaacggcaacaagtgcgaggcccccgccctgagcttcagcgacaagaccatgctgagcggccagagaatcggcgagaagttccaggaccagttcctgggcatcgccgccatcaacatcagcctgcccggcgagcagtacggccagaagagcctgaacatgatcagcagcaacccccaggtgcagtaccacaacgacaagtacatcagcaacaccagcggcgaggacgagaagacccaccccggcttccagcagatgcccgaggacaaggaggacgagagcgagatcgaggagtacagctgcgccgtgacccccggcggcgacaccgacaacgccatcgtgagcctgacctgcgccacccccctgctggacgagaccatcagcgccagcgactacgagaccagcctgctgaacgaccagcagaacaacaccggcaccgacaccgacagcgacgacgacttctacgacacccccctgttcgaggacgacgaccacgacagcctgctgctggacggcgacgacagagactgcctgcaccccgaggactacgacaccctgcaggaggagaacgacgagaccgccagccccgccgacgtgttctacgacgtgagcaaggagaacgagaacagcatggtgccccagggcgcccccgtgggcagcctgagcgtgaagaacaaggcccactgcctgcaggacttcctgatggacgtggagaaggacgagctggacagcggcgagaagatccacctgaaccccgtgggcagcgacaaggtgaacggccagagcctggagaccggcagcgagagagagtgcaccaacatcctggagggcgacgagagcgacagcctgaccgactacgacatcgtgggcggcaaggagagcttcaccgccagcctgaagttcgacgacagcggcagctggagaggcagaaaggaggagtacgtgaccggccaggagttccacagcgacaccgaccacctggacagcatgcagagcgaggagagctacggcgactacatctacgacagcaacgaccaggacgacgacgacgacgacggcatcgacgaggagggcggcggcatcagagacgagaacggcaagcccagatgccagaacgtggccgaggacatggacatccagctgtgcgccagcatcctgaacgagaacagcgacgagaacgagaacatcaacaccatgatcctgctggacaagatgcacagctgcagcagcctggagaagcagcagagagtgaacgtggtgcagctggccagccccagcgagaacaacctggtgaccgagaagagcaacctgcccgagtacaccaccgagatcgccggcaagagcaaggagaacctgctgaaccacgagatggtgctgaaggacgtgctgccccccatcatcaaggacaccgagagcgagaagaccttcggccccgccagcatcagccacgacaacaacaacatcagcagcaccagcgagctgggcaccgacctggccaacaccaaggtgaagctgatccagggcagcgagctgcccgagctgaccgacagcgtgaagggcaaggacgagtacttcaagaacatgacccccaaggtggacagcagcctggaccacatcatctgcaccgagcccgacctgatcggcaagcccgccgaggagagccacctgagcctgatcgccagcgtgaccgacaaggacccccagggcaacggcagcgacctgatcaagggcagagacggcaagagcgacatcctgatcgaggacgagaccagcatccagaagatgtacctgggcgagggcgaggtgctggtggagggcctggtggaggaggagaacagacacctgaagctgctgcccggcaagaacaccagagacagcttcaagctgatcaacagccagttccccttcccccagatcaccaacaacgaggagctgaaccagaagggcagcctgaagaaggccaccgtgaccctgaaggacgagcccaacaacctgcagatcatcgtgagcaagagccccgtgcagttcgagaacctggaggagatcttcgacaccagcgtgagcaaggagatcagcgacgacatcaccagcgacatcaccagctgggagggcaacacccacttcgaggagagcttcaccgacggccccgagaaggagctggacctgttcacctacctgaagcactgcgccaagaacatcaaggccaaggacgtggccaagcccaacgaggacgtgcccagccacgtgctgatcaccgccccccccatgaaggagcacctgcagctgggcgtgaacaacaccaaggagaagagcaccagcacccagaaggacagccccctgaacgacatgatccagagcaacgacctgtgcagcaaggagagcatcagcggcggcggcaccgagatcagccagttcacccccgagagcatcgaggccaccctgagcatcctgagcagaaagcacgtggaggacgtgggcaagaacgacttcctgcagagcgagagatgcgccaacggcctgggcaacgacaacagcagcaacaccctgaacaccgactacagcttcctggagatcaacaacaagaaggagagaatcgagcagcagctgcccaaggagcaggccctgagccccagaagccaggagaaggaggtgcagatccccgagctgagccaggtgttcgtggaggacgtgaaggacatcctgaagagcagactgaaggagggccacatgaacccccaggaggtggaggagcccagcgcctgcgccgacaccaagatcctgatccagaacctgatcaagagaatcaccaccagccagctggtgaacgaggccagcaccgtgcccagcgacagccagatgagcgacagcagcggcgtgagccccatgaccaacagcagcgagctgaagcccgagagcagagacgaccccttctgcatcggcaacctgaagagcgagctgctgctgaacatcctgaagcaggaccagcacagccagaagatcaccggcgtgttcgagctgatgagagagctgacccacatggagtacgacctggagaagagaggcatcaccagcaaggtgctgcccctgcagctggagaacatcttctacaagctgctggccgacggctacagcgagaagatcgagcacgtgggcgacttcaaccagaaggcctgcagcaccagcgagatgatggaggagaagccccacatcctgggcgacatcaagagcaaggagggcaactactacagccccaacctggagaccgtgaaggagatcggcctggagagcagcaccgtgtgggccagcaccctgcccagagacgagaagctgaaggacctgtgcaacgacttccccagccacctggagtgcaccagcggcagcaaggagatggccagcggcgacagcagcaccgagcagtag

SEQ ID NO: 79923 - DNA, 21741 bp, Artificial Sequence
  Description of Artificial Sequence: Synthetic coding sequence
atgcacagcagcagctacagctacagaagcagcgacagcgtgttcagcaacaccaccagcaccagaaccagcctggacagcaacgagaacctgctgctggtgcactgcggccccaccctgatcaacagctgcatcagcttcggcagcgagagcttcgacggccacagactggagatgctgcagcagatcgccaacagagtgcagagagacagcgtgatctgcgaggacaagctgatcctggccggcaacgccctgcagagcgacagcaagagactggagagcggcgtgcagttccagaacgaggccgagatcgccggctacatcctggagtgcgagaacctgctgagacagcacgtgatcgacgtgcagatcctgatcgacggcaagtactaccaggccgaccagctggtgcagagagtggccaagctgagagacgagatcatggccctgagaaacgagtgcagcagcgtgtacagcaagggcagaatcctgaccaccgagcagaccaagctgatgatcagcggcatcacccagagcctgaacagcggcttcgcccagaccctgcaccccagcctgaccagcggcctgacccagagcctgacccccagcctgaccagcagcagcatgaccagcggcctgagcagcggcatgaccagcagactgacccccagcgtgacccccgcctacacccccggcttccccagcggcctggtgcccaacttcagcagcggcgtggagcccaacagcctgcagaccctgaagctgatgcagatcagaaagcccctgctgaagagcagcctgctggaccagaacctgaccgaggaggagatcaacatgaagttcgtgcaggacctgctgaactgggtggacgagatgcaggtgcagctggacagaaccgagtggggcagcgacctgcccagcgtggagagccacctggagaaccacaagaacgtgcacagagccatcgaggagttcgagagcagcctgaaggaggccaagatcagcgagatccagatgaccgcccccctgaagctgacctacgccgagaagctgcacagactggagagccagtacgccaagctgctgaacaccagcagaaaccaggagagacacctggacaccctgcacaacttcgtgagcagagccaccaacgagctgatctggctgaacgagaaggaggaggaggaggtggcctacgactggagcgagagaaacaccaacatcgccagaaagaaggactaccacgccgagctgatgagagagctggaccagaaggaggagaacatcaagagcgtgcaggagatcgccgagcagctgctgctggagaaccaccccgccagactgaccatcgaggcctacagagccgccatgcagacccagtggagctggatcctgcagctgtgccagtgcgtggagcagcacatcaaggagaacaccgcctacttcgagttcttcaacgacgccaaggaggccaccgactacctgagaaacctgaaggacgccatccagagaaagtacagctgcgacagaagcagcagcatccacaagctggaggacctggtgcaggagagcatggaggagaaggaggagctgctgcagtacaagagcaccatcgccaacctgatgggcaaggccaagaccatcatccagctgaagcccagaaacagcgactgccccctgaagaccagcatccccatcaaggccatctgcgactacagacagatcgagatcaccatctacaaggacgacgagtgcgtgctggccaacaacagccacagagccaagtggaaggtgatcagccccaccggcaacgaggccatggtgcccagcgtgtgcttcaccgtgcccccccccaacaaggaggccgtggacctggccaacagaatcgagcagcagtaccagaacgtgctgaccctgtggcacgagagccacatcaacatgaagagcgtggtgagctggcactacctgatcaacgagatcgacagaatcagagccagcaacgtggccagcatcaagaccatgctgcccggcgagcaccagcaggtgctgagcaacctgcagagcagattcgaggacttcctggaggacagccaggagagccaggtgttcagcggcagcgacatcacccagctggagaaggaggtgaacgtgtgcaagcagtactaccaggagctgctgaagagcgccgagagagaggagcaggaggagagcgtgtacaacctgtacatcagcgaggtgagaaacatcagactgagactggagaactgcgaggacagactgatcagacagatcagaacccccctggagagagacgacctgcacgagagcgtgttcagaatcaccgagcaggagaagctgaagaaggagctggagagactgaaggacgacctgggcaccatcaccaacaagtgcgaggagttcttcagccaggccgccgccagcagcagcgtgcccaccctgagaagcgagctgaacgtggtgctgcagaacatgaaccaggtgtacagcatgagcagcacctacatcgacaagctgaagaccgtgaacctggtgctgaagaacacccaggccgccgaggccctggtgaagctgtacgagaccaagctgtgcgaggaggaggccgtgatcgccgacaagaacaacatcgagaacctgatcagcaccctgaagcagtggagaagcgaggtggacgagaagagacaggtgttccacgccctggaggacgagctgcagaaggccaaggccatcagcgacgagatgttcaagacctacaaggagagagacctggacttcgactggcacaaggagaaggccgaccagctggtggagagatggcagaacgtgcacgtgcagatcgacaacagactgagagacctggagggcatcggcaagagcctgaagtactacagagacacctaccaccccctggacgactggatccagcaggtggagaccacccagagaaagatccaggagaaccagcccgagaacagcaagaccctggccacccagctgaaccagcagaagatgctggtgagcgagatcgagatgaagcagagcaagatggacgagtgccagaagtacgccgagcagtacagcgccaccgtgaaggactacgagctgcagaccatgacctacagagccatggtggacagccagcagaagagccccgtgaagagaagaagaatgcagagcagcgccgacctgatcatccaggagttcatggacctgagaaccagatacaccgccctggtgaccctgatgacccagtacatcaagttcgccggcgacagcctgaagagactggaggaggaggagaagagcctggaggaggagaagaaggagcacgtggagaaggccaaggagctgcagaagtgggtgagcaacatcagcaagaccctgaaggacgccgagaaggccggcaagccccccttcagcaagcagaagatcagcagcgaggagatcagcaccaagaaggagcagctgagcgaggccctgcagaccatccagctgttcctggccaagcacggcgacaagatgaccgacgaggagagaaacgagctggagaagcaggtgaagaccctgcaggagagctacaacctgctgttcagcgagagcctgaagcagctgcaggagagccagaccagcggcgacgtgaaggtggaggagaagctggacaaggtgatcgccggcaccatcgaccagaccaccggcgaggtgctgagcgtgttccaggccgtgctgagaggcctgatcgactacgacaccggcatcagactgctggagacccagctgatgatcagcggcctgatcagccccgagctgagaaagtgcttcgacctgaaggacgccaagagccacggcctgatcgacgagcagatcctgtgccagctgaaggagctgagcaaggccaaggagatcatcagcgccgccagccccaccaccatccccgtgctggacgccctggcccagagcatgatcaccgagagcatggccatcaaggtgctggagatcctgctgagcaccggcagcctggtgatccccgccaccggcgagcagctgaccctgcagaaggccttccagcagaacctggtgagcagcgccctgttcagcaaggtgctggagagacagaacatgtgcaaggacctgatcgacccctgcaccagcgagaaggtgagcctgatcgacatggtgcagagaagcaccctgcaggagaacaccggcatgtggctgctgcccgtgagaccccaggagggcggcagaatcaccctgaagtgcggcagaaacatcagcatcctgagagccgcccacgagggcctgatcgacagagagaccatgttcagactgctgagcgcccagctgctgagcggcggcctgatcaacagcaacagcggccagagaatgaccgtggaggaggccgtgagagagggcgtgatcgacagagacaccgccagcagcatcctgacctaccaggtgcagaccggcggcatcatccagagcaaccccgccaagagactgaccgtggacgaggccgtgcagtgcgacctgatcaccagcagcagcgccctgctggtgctggaggcccagagaggctacgtgggcctgatctggccccacagcggcgagatcttccccaccagcagcagcctgcagcaggagctgatcaccaacgagctggcctacaagatcctgaacggcagacagaagatcgccgccctgtacatccccgagagcagccaggtgatcggcctggacgccgccaagcagctgggcatcatcgacaacaacaccgccagcatcctgaagaacatcaccctgcccgacaagatgcccgacctgggcgacctggaggcctgcaagaacgccagaagatggctgagcttctgcaagttccagcccagcaccgtgcacgactacagacaggaggaggacgtgttcgacggcgaggagcccgtgaccacccagaccagcgaggagaccaagaagctgttcctgagctacctgatgatcaacagctacatggacgccaacaccggccagagactgctgctgtacgacggcgacctggacgaggccgtgggcatgctgctggagggctgccacgccgagttcgacggcaacaccgccatcaaggagtgcctggacgtgctgagcagcagcggcgtgttcctgaacaacgccagcggcagagagaaggacgagtgcaccgccacccccagcagcttcaacaagtgccactgcggcgagcccgagcacgaggagacccccgagaacagaaagtgcgccatcgacgaggagttcaacgagatgagaaacaccgtgatcaacagcgagttcagccagagcggcaagctggccagcaccatcagcatcgaccccaaggtgaacagcagccccagcgtgtgcgtgcccagcctgatcagctacctgacccagaccgagctggccgacatcagcatgctgagaagcgacagcgagaacatcctgaccaactacgagaaccagagcagagtggagaccaacgagagagccaacgagtgcagccacagcaagaacatccagaacttccccagcgacctgatcgagaaccccatcatgaagagcaagatgagcaagttctgcggcgtgaacgagaccgagaacgaggacaacaccaacagagacagccccatcttcgactacagccccagactgagcgccctgctgagccacgacaagctgatgcacagccagggcagcttcaacgacacccacacccccgagagcaacggcaacaagtgcgaggcccccgccctgagcttcagcgacaagaccatgctgagcggccagagaatcggcgagaagttccaggaccagttcctgggcatcgccgccatcaacatcagcctgcccggcgagcagtacggccagaagagcctgaacatgatcagcagcaacccccaggtgcagtaccacaacgacaagtacatcagcaacaccagcggcgaggacgagaagacccaccccggcttccagcagatgcccgaggacaaggaggacgagagcgagatcgaggagtacagctgcgccgtgacccccggcggcgacaccgacaacgccatcgtgagcctgacctgcgccacccccctgctggacgagaccatcagcgccagcgactacgagaccagcctgctgaacgaccagcagaacaacaccggcaccgacaccgacagcgacgacgacttctacgacacccccctgttcgaggacgacgaccacgacagcctgctgctggacggcgacgacagagactgcctgcaccccgaggactacgacaccctgcaggaggagaacgacgagaccgccagccccgccgacgtgttctacgacgtgagcaaggagaacgagaacagcatggtgccccagggcgcccccgtgggcagcctgagcgtgaagaacaaggcccactgcctgcaggacttcctgatggacgtggagaaggacgagctggacagcggcgagaagatccacctgaaccccgtgggcagcgacaaggtgaacggccagagcctggagaccggcagcgagagagagtgcaccaacatcctggagggcgacgagagcgacagcctgaccgactacgacatcgtgggcggcaaggagagcttcaccgccagcctgaagttcgacgacagcggcagctggagaggcagaaaggaggagtacgtgaccggccaggagttccacagcgacaccgaccacctggacagcatgcagagcgaggagagctacggcgactacatctacgacagcaacgaccaggacgacgacgacgacgacggcatcgacgaggagggcggcggcatcagagacgagaacggcaagcccagatgccagaacgtggccgaggacatggacatccagctgtgcgccagcatcctgaacgagaacagcgacgagaacgagaacatcaacaccatgatcctgctggacaagatgcacagctgcagcagcctggagaagcagcagagagtgaacgtggtgcagctggccagccccagcgagaacaacctggtgaccgagaagagcaacctgcccgagtacaccaccgagatcgccggcaagagcaaggagaacctgctgaaccacgagatggtgctgaaggacgtgctgccccccatcatcaaggacaccgagagcgagaagaccttcggccccgccagcatcagccacgacaacaacaacatcagcagcaccagcgagctgggcaccgacctggccaacaccaaggtgaagctgatccagggcagcgagctgcccgagctgaccgacagcgtgaagggcaaggacgagtacttcaagaacatgacccccaaggtggacagcagcctggaccacatcatctgcaccgagcccgacctgatcggcaagcccgccgaggagagccacctgagcctgatcgccagcgtgaccgacaaggacccccagggcaacggcagcgacctgatcaagggcagagacggcaagagcgacatcctgatcgaggacgagaccagcatccagaagatgtacctgggcgagggcgaggtgctggtggagggcctggtggaggaggagaacagacacctgaagctgctgcccggcaagaacaccagagacagcttcaagctgatcaacagccagttccccttcccccagatcaccaacaacgaggagctgaaccagaagggcagcctgaagaaggccaccgtgaccctgaaggacgagcccaacaacctgcagatcatcgtgagcaagagccccgtgcagttcgagaacctggaggagatcttcgacaccagcgtgagcaaggagatcagcgacgacatcaccagcgacatcaccagctgggagggcaacacccacttcgaggagagcttcaccgacggccccgagaaggagctggacctgttcacctacctgaagcactgcgccaagaacatcaaggccaaggacgtggccaagcccaacgaggacgtgcccagccacgtgctgatcaccgccccccccatgaaggagcacctgcagctgggcgtgaacaacaccaaggagaagagcaccagcacccagaaggacagccccctgaacgacatgatccagagcaacgacctgtgcagcaaggagagcatcagcggcggcggcaccgagatcagccagttcacccccgagagcatcgaggccaccctgagcatcctgagcagaaagcacgtggaggacgtgggcaagaacgacttcctgcagagcgagagatgcgccaacggcctgggcaacgacaacagcagcaacaccctgaacaccgactacagcttcctggagatcaacaacaagaaggagagaatcgagcagcagctgcccaaggagcaggccctgagccccagaagccaggagaaggaggtgcagatccccgagctgagccaggtgttcgtggaggacgtgaaggacatcctgaagagcagactgaaggagggccacatgaacccccaggaggtggaggagcccagcgcctgcgccgacaccaagatcctgatccagaacctgatcaagagaatcaccaccagccagctggtgaacgaggccagcaccgtgcccagcgacagccagatgagcgacagcagcggcgtgagccccatgaccaacagcagcgagctgaagcccgagagcagagacgaccccttctgcatcggcaacctgaagagcgagctgctgctgaacatcctgaagcaggaccagcacagccagaagatcaccggcgtgttcgagctgatgagagagctgacccacatggagtacgacctggagaagagaggcatcaccagcaaggtgctgcccctgcagctggagaacatcttctacaagctgctggccgacggctacagcgagaagatcgagcacgtgggcgacttcaaccagaaggcctgcagcaccagcgagatgatggaggagaagccccacatcctgggcgacatcaagagcaaggagggcaactactacagccccaacctggagaccgtgaaggagatcggcctggagagcagcaccgtgtgggccagcaccctgcccagagacgagaagctgaaggacctgtgcaacgacttccccagccacctggagtgcaccagcggcagcaaggagatggccagcggcgacagcagcaccgagcagttcagcagcgagctgcagcagtgcctgcagcacaccgagaagatgcacgagtacctgaccctgctgcaggacatgaagccccccctggacaaccaggagagcctggacaacaacctggaggccctgaagaaccagctgagacagctggagaccttcgagctgggcctggcccccatcgccgtgatcctgagaaaggacatgaagctggccgaggagttcctgaagagcctgcccagcgacttccccagaggccacgtggaggagctgagcatcagccaccagagcctgaagaccgccttcagcagcctgagcaacgtgagcagcgagagaaccaagcagatcatgctggccatcgacagcgagatgagcaagctggccgtgagccacgaggagttcctgcacaagctgaagagcttcagcgactgggtgagcgagaagagcaagagcgtgaaggacatcgagatcgtgaacgtgcaggacagcgagtacgtgaagaagagactggagttcctgaaggccaacaacgtgctgaaggacctgggccacaccaagatgcagctggagaccaccgccttcgacgtgcagttcttcatcagcgagtacgcccaggacctgagccccaaccagagcaagcagctgctgagactgctgaacaccacccagaagtgcttcctggacgtgcaggagagcgtgaccacccaggtggagagactggagacccagctgcacctggagcaggacctggacgaccagaagatcgtggccgagagacagcaggagtacaaggagaagctgcagggcatctgcgacctgctgacccagaccgagaacagactgatcggccaccaggaggccttcatgatcggcgacggcaccgtggagctgaagaagtaccagagcaagcaggaggagctgcagaaggacatgcagggcagcgcccaggccctggccgaggtggtgaagaacaccgagaacttcctgaaggagaacggcgagaagctgagccaggaggacaaggccctgatcgagcagaagctgaacgaggccaagatcaagtgcgagcagctgaacctgaaggccgagcagagcaagaaggagctggacaaggtggtgaccaccgccatcaaggaggagaccgagaaggtggccgccgtgaagcagctggaggagagcaagaccaagatcgagaacctgctggactggctgagcaacgtggacaaggacagcgagagagccggcaccaagcacaagcaggtgatcgagcagaacggcacccacttccaggagggcgacggcaagagcgccatcggcgaggaggacgaggtgaacggcaacctgctggagaccgacgtggacggccaggtgggcaccacccaggagaacctgaaccagcagtaccagaaggtgaaggcccagcacgagaagatcatcagccagcaccaggccgtgatcatcgccacccagagcgcccaggtgctgctggagaagcagggccagtacctgagccccgaggagaaggagaagctgcagaagaacatgaaggagctgaaggtgcactacgagaccgccctggccgagagcgagaagaagatgaagctgacccacagcctgcaggaggagctggagaagttcgacgccgactacaccgagttcgagcactggctgcagcagagcgagcaggagctggagaacctggaggccggcgccgacgacatcaacggcctgatgaccaagctgaagagacagaagagcttcagcgaggacgtgatcagccacaagggcgacctgagatacatcaccatcagcggcaacagagtgctggaggccgccaagagctgcagcaagagagacggcggcaaggtggacaccagcgccacccacagagaggtgcagagaaagctggaccacgccaccgacagattcagaagcctgtacagcaagtgcaacgtgctgggcaacaacctgaaggacctggtggacaagtaccagcactacgaggacgccagctgcggcctgctggccggcctgcaggcctgcgaggccaccgccagcaagcacctgagcgagcccatcgccgtggaccccaagaacctgcagagacagctggaggagaccaaggccctgcagggccagatcagcagccagcaggtggccgtggagaagctgaagaagaccgccgaggtgctgctggacgccagaggcagcctgctgcccgccaagaacgacatccagaagaccctggacgacatcgtgggcagatacgaggacctgagcaagagcgtgaacgagagaaacgagaagctgcagatcaccctgaccagaagcctgagcgtgcaggacggcctggacgagatgctggactggatgggcaacgtggagagcagcctgaaggagcagggccaggtgcccctgaacagcaccgccctgcaggacatcatcagcaagaacatcatgctggagcaggacatcgccggcagacagagcagcatcaacgccatgaacgagaaggtgaagaagttcatggagaccaccgaccccagcaccgccagcagcctgcaggccaagatgaaggacctgagcgccagattcagcgaggccagccacaagcacaaggagaccctggccaagatggaggagctgaagaccaaggtggagctgttcgagaacctgagcgagaagctgcagaccttcctggagaccaagacccaggccctgaccgaggtggacgtgcccggcaaggacgtgaccgagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggacgccttccaggtgctggtgaagagcctgaagagctggatcaaggagaccaccaagaaggtgcccatcgtgcagcccagcttcggcgccgaggacctgggcaagagcctggaggacaccaagaagctgcaggagaagtggagcctgaagacccccgagatccagaaggtgaacaacagcggcatcagcctgtgcaacctgatcagcgccgtgaccacccccgccaaggccatcgccgccgtgaagagcggcggcgccgtgctgaacggcgagggcaccgccaccaacaccgaggagttctgggccaacaagggcctgaccagcatcaagaaggacatgaccgacatcagccacggctacgaggacctgggcctgctgctgaaggacaagatcgccgagctgaacaccaagctgagcaagctgcagaaggcccaggaggagagcagcgccatgatgcagtggctgcagaagatgaacaagaccgccaccaagtggcagcagacccccgcccccaccgacaccgaggccgtgaagacccaggtggagcagaacaagagcttcgaggccgagctgaagcagaacgtgaacaaggtgcaggagctgaaggacaagctgaccgagctgctggaggagaaccccgacacccccgaggcccccagatggaagcagatgctgaccgagatcgacagcaagtggcaggagctgaaccagctgaccatcgacagacagcagaagctggaggagagcagcaacaacctgacccagttccagaccgtggaggcccagctgaagcagtggctggtggagaaggagctgatggtgagcgtgctgggccccctgagcatcgaccccaacatgctgaacacccagagacagcaggtgcagatcctgctgcaggagttcgccaccagaaagccccagtacgagcagctgaccgccgccggccagggcatcctgagcagacccggcgaggaccccagcctgagaggcatcgtgaaggagcagctggccgccgtgacccagaagtgggacagcctgaccggccagctgagcgacagatgcgactggatcgaccaggccatcgtgaagagcacccagtaccagagcctgctgagaagcctgagcgacaagctgagcgacctggacaacaagctgagcagcagcctggccgtgagcacccaccccgacgccatgaaccagcagctggagaccgcccagaagatgaagcaggagatccagcaggagaagaagcagatcaaggtggcccaggccctgtgcgaggacctgagcgccctggtgaaggaggagtacctgaaggccgagctgagcagacagctggagggcatcctgaagagcttcaaggacgtggagcagaaggccgagaaccacgtgcagcacctgcagagcgcctgcgccagcagccaccagttccagcagatgagcagagacttccaggcctggctggacaccaagaaggaggagcagaacaagagccaccccatcagcgccaagctggacgtgctggagagcctgatcaaggaccacaaggacttcagcaagaccctgaccgcccagagccacatgtacgagaagaccatcgccgagggcgagaacctgctgctgaagacccagggcagcgagaaggccgccctgcagctgcagctgaacaccatcaagaccaactgggacaccttcaacaagcaggtgaaggagagagagaacaagctgaaggagagcctggagaaggccctgaagtacaaggagcaggtggagaccctgtggccctggatcgacaagtgccagaacaacctggaggagatcaagttctgcctggaccccgccgagggcgagaacagcatcgccaagctgaagagcctgcagaaggagatggaccagcacttcggcatggtggagctgctgaacaacaccgccaacagcctgctgagcgtgtgcgagatcgacaaggaggtggtgaccgacgagaacaagagcctgatccagaaggtggacatggtgaccgagcagctgcacagcaagaagttctgcctggagaacatgacccagaagttcaaggagttccaggaggtgagcaaggagagcaagagacagctgcagtgcgccaaggagcagctggacatccacgacagcctgggcagccaggcctacagcaacaagtacctgaccatgctgcagacccagcagaagagcctgcaggccctgaagcaccaggtggacctggccaagagactggcccaggacctggtggtggaggccagcgacagcaagggcaccagcgacgtgctgctgcaggtggagaccatcgcccaggagcacagcaccctgagccagcaggtggacgagaagtgcagcttcctggagaccaagctgcagggcatcggccacttccagaacaccatcagagagatgttcagccagttcgccgagttcgacgacgagctggacagcatggcccccgtgggcagagacgccgagaccctgcagaagcagaaggagaccatcaaggccttcctgaagaagctggaggccctgatggccagcaacgacaacgccaacaagacctgcaagatgatgctggccaccgaggagaccagccccgacctggtgggcatcaagagagacctggaggccctgagcaagcagtgcaacaagctgctggacagagcccaggccagagaggagcaggtggagggcaccatcaagagactggaggagttctacagcaagctgaaggagttcagcatcctgctgcagaaggccgaggagcacgaggagagccagggccccgtgggcatggagaccgagaccatcaaccagcagctgaacatgttcaaggtgttccagaaggaggagatcgagcccctgcagggcaagcagcaggacgtgaactggctgggccagggcctgatccagagcgccgccaagagcaccagcacccagggcctggagcacgacctggacgacgtgaacgccagatggaagaccctgaacaagaaggtggcccagagagccgcccagctgcaggaggccctgctgcactgcggcagattccaggacgccctggagagcctgctgagctggatggtggacaccgaggagctggtggccaaccagaagccccccagcgccgagttcaaggtggtgaaggcccagatccaggagcagaagctgctgcagagactgctggacgacagaaagagcaccgtggaggtgatcaagagagagggcgagaagatcgccaccaccgccgagcccgccgacaaggtgaagatcctgaagcagctgagcctgctggacagcagatgggaggccctgctgaacaaggccgagaccagaaacagacagctggagggcatcagcgtggtggcccagcagttccacgagaccctggagcccctgaacgagtggctgaccaccatcgagaagagactggtgaactgcgagcccatcggcacccaggccagcaagctggaggagcagatcgcccagcacaaggccctggaggacgacatcatcaaccacaacaagcacctgcaccaggccgtgagcatcggccagagcctgaaggtgctgagcagcagagaggacaaggacatggtgcagagcaagctggacttcagccaggtgtggtacatcgagatccaggagaagagccacagcagaagcgagctgctgcagcaggccctgtgcaacgccaagatcttcggcgaggacgaggtggagctgatgaactggctgaacgaggtgcacgacaagctgagcaagctgagcgtgcaggactacagcaccgagggcctgtggaagcagcagagcgagctgagagtgctgcaggaggacatcctgctgagaaagcagaacgtggaccaggccctgctgaacggcctggagctgctgaagcagaccaccggcgacgaggtgctgatcatccaggacaagctggaggccatcaaggccagatacaaggacatcaccaagctgagcaccgacgtggccaagaccctggagcaggccctgcagctggccagaagactgcacagcacccacgaggagctgtgcacctggctggacaaggtggaggtggagctgctgagctacgagacccaggtgctgaagggcgaggaggccagccaggcccagatgagacccaaggagctgaagaaggaggccaagaacaacaaggccctgctggacagcctgaacgaggtgagcagcgccctgctggagctggtgccctggagagccagagagggcctggagaagatggtggccgaggacaacgagagatacagactggtgagcgacaccatcacccagaaggtggaggagatcgacgccgccatcctgagaagccagcagttcgaccaggccgccgacgccgagctgagctggatcaccgagaccgagaagaagctgatgagcctgggcgacatcagactggagcaggaccagaccagcgcccagctgcaggtgcagaagaccttcaccatggagatcctgagacacaaggacatcatcgacgacctggtgaagagcggccacaagatcatgaccgcctgcagcgaggaggagaagcagagcatgaagaagaagctggacaaggtgctgaagaactacgacaccatctgccagatcaacagcgagagatacctgcagctggagagagcccagagcctggtgaaccagttctgggagacctacgaggagctgtggccctggctgaccgagacccagagcatcatcagccagctgcccgcccccgccctggagtacgagaccctgagacagcagcaggaggagcacagacagctgagagagctgatcgccgagcacaagccccacatcgacaagatgaacaagaccggcccccagctgctggagctgagccccggcgagggcttcagcatccaggagaagtacgtggccgccgacaccctgtacagccagatcaaggaggacgtgaagaagagagccgtggccctggacgaggccatcagccagagcacccagttccacgacaagatcgaccagatcctggagagcctggagagaatcgtggagagactgagacagccccccagcatcagcgccgaggtggagaagatcaaggagcagatcagcgagaacaagaacgtgagcgtggacatggagaagctgcagcccctgtacgagaccctgaagcagagaggcgaggagatgatcgccagaagcggcggcaccgacaaggacatcagcgccaaggccgtgcaggacaagctggaccagatggtgttcatctgggagaacatccacaccctggtggaggagagagaggccaagctgctggacgtgatggagctggccgagaagttctggtgcgaccacatgagcctgatcgtgaccatcaaggacacccaggacttcatcagagacctggaggaccccggcatcgaccccagcgtggtgaagcagcagcaggaggccgccgagaccatcagagaggagatcgacggcctgcaggaggagctggacatcgtgatcaacctgggcagcgagctgatcgccgcctgcggcgagcccgacaagcccatcgtgaagaagagcatcgacgagctgaacagcgcctgggacagcctgaacaaggcctggaaggacagaatcgacaagctggaggaggccatgcaggccgccgtgcagtaccaggacggcctgcaggccgtgttcgactgggtggacatcgccggcggcaagctggccagcatgagccccatcggcaccgacctggagaccgtgaagcagcagatcgaggagctgaagcagttcaagagcgaggcctaccagcagcagatcgagatggagagactgaaccaccaggccgagctgctgctgaagaaggtgaccgaggagagcgacaagcacaccgtgcaggaccccctgatggagctgaagctgatctgggacagcctggaggagagaatcatcaacagacagcacaagctggagggcgccctgctggccctgggccagttccagcacgccctggacgagctgctggcctggctgacccacaccgagggcctgctgagcgagcagaagcccgtgggcggcgaccccaaggccatcgagatcgagctggccaagcaccacgtgctgcagaacgacgtgctggcccaccagagcaccgtggaggccgtgaacaaggccggcaacgacctgatcgagagcagcgccggcgaggaggccagcaacctgcagaacaagctggaggtgctgaaccagagatggcagaacgtgctggagaagaccgagcagagaaagcagcagctggacggcgccctgagacaggccaagggcttccacggcgagatcgaggacctgcagcagtggctgaccgacaccgagagacacctgctggccagcaagcccctgggcggcctgcccgagaccgccaaggagcagctgaacgtgcacatggaggtgtgcgccgccttcgaggccaaggaggagacctacaagagcctgatgcagaagggccagcagatgctggccagatgccccaagagcgccgagaccaacatcgaccaggacatcaacaacctgaaggagaagtgggagagcgtggagaccaagctgaacgagagaaagaccaagctggaggaggccctgaacctggccatggagttccacaacagcctgcaggacttcatcaactggctgacccaggccgagcagaccctgaacgtggccagcagacccagcctgatcctggacaccgtgctgttccagatcgacgagcacaaggtgttcgccaacgaggtgaacagccacagagagcagatcatcgagctggacaagaccggcacccacctgaagtacttcagccagaagcaggacgtggtgctgatcaagaacctgctgatcagcgtgcagagcagatgggagaaggtggtgcagagactggtggagagaggcagaagcctggacgacgccagaaagagagccaagcagttccacgaggcctggagcaagctgatggagtggctggaggagagcgagaagagcctggacagcgagctggagatcgccaacgaccccgacaagatcaagacccagctggcccagcacaaggagttccagaagagcctgggcgccaagcacagcgtgtacgacaccaccaacagaaccggcagaagcctgaaggagaagaccagcctggccgacgacaacctgaagctggacgacatgctgagcgagctgagagacaagtgggacaccatctgcggcaagagcgtggagagacagaacaagctggaggaggccctgctgttcagcggccagttcaccgacgccctgcaggccctgatcgactggctgtacagagtggagccccagctggccgaggaccagcccgtgcacggcgacatcgacctggtgatgaacctgatcgacaaccacaaggccttccagaaggagctgggcaagagaaccagcagcgtgcaggccctgaagagaagcgccagagagctgatcgagggcagcagagacgacagcagctgggtgaaggtgcagatgcaggagctgagcaccagatgggagaccgtgtgcgccctgagcatcagcaagcagaccagactggaggccgccctgagacaggccgaggagttccacagcgtggtgcacgccctgctggagtggctggccgaggccgagcagaccctgagattccacggcgtgctgcccgacgacgaggacgccctgagaaccctgatcgaccagcacaaggagttcatgaagaagctggaggagaagagagccgagctgaacaaggccaccaccatgggcgacaccgtgctggccatctgccaccccgacagcatcaccaccatcaagcactggatcaccatcatcagagccagattcgaggaggtgctggcctgggccaagcagcaccagcagagactggccagcgccctggccggcctgatcgccaagcaggagctgctggaggccctgctggcctggctgcagtgggccgagaccaccctgaccgacaaggacaaggaggtgatcccccaggagatcgaggaggtgaaggccctgatcgccgagcaccagaccttcatggaggagatgaccagaaagcagcccgacgtggacaaggtgaccaagacctacaagagaagagccgccgaccccagcagcctgcagagccacatccccgtgctggacaagggcagagccggcagaaagagattccccgccagcagcctgtaccccagcggcagccagacccagatcgagaccaagaaccccagagtgaacctgctggtgagcaagtggcagcaggtgtggctgctggccctggagagaagaagaaagctgaacgacgccctggacagactggaggagctgagagagttcgccaacttcgacttcgacatctggagaaagaagtacatgagatggatgaaccacaagaagagcagagtgatggacttcttcagaagaatcgacaaggaccaggacggcaagatcaccagacaggagttcatcgacggcatcctgagcagcaagttccccaccagcagactggagatgagcgccgtggccgacatcttcgacagagacggcgacggctacatcgactactacgagttcgtggccgccctgcaccccaacaaggacgcctacaagcccatcaccgacgccgacaagatcgaggacgaggtgaccagacaggtggccaagtgcaagtgcgccaagagattccaggtggagcagatcggcgacaacaagtacagagtgagcttccagagcaacttcggcgacagccagcagctgagactggtgagaatcctgagaagcaccgtgatggtgagagtgggcggcggctggatggccctggacgagttcctggtgaagaacgacccctgcagagtgcaccaccacggcagcaagatgctgagaagcgagagcaacagcagcatcaccaccacccagcccaccatcgccaagggcagaaccaacatggagctgagagagaagttcatcctggccgacggcgccagccagggcatggccgccttcagacccagaggcagaagaagcagacccagcagcagaggcgccagccccaacagaagcaccagcgtgagcagccaggccgcccaggccgccagcccccaggtgcccgccaccaccacccccaagggcacccccatccagggcagcaagctgagactgcccggctacctgagcggcaagggcttccacagcggcgaggacagcggcctgatcaccaccgccgccgccagagtgagaacccagttcgccgacagcaagaagacccccagcagacccggcagcagagccggcagcaaggccggcagcagagccagcagcagaagaggcagcgacgccagcgacttcgacatcagcgagatccagagcgtgtgcagcgacgtggagaccgtgccccagacccacagacccacccccagagccggcagcagacccagcaccgccaagcccagcaagatccccaccccccagagaaagagccccgccagcaagctggacaagagcagcaagagatag

SEQ ID NO: 79924 - DNA, 768 bp, Artificial Sequence
  Description of Artificial Sequence: Synthetic coding sequence
atgaacaagaccggcccccagctgctggagctgagccccggcgagggcttcagcatccaggagaagtacgtggccgccgacaccctgtacagccagatcaaggaggacgtgaagaagagagccgtggccctggacgaggccatcagccagagcacccagttccacgacaagatcgaccagatcctggagagcctggagagaatcgtggagagactgagacagccccccagcatcagcgccgaggtggagaagatcaaggagcagatcagcgagaacaagaacgtgagcgtggacatggagaagctgcagcccctgtacgagaccctgaagcagagaggcgaggagatgatcgccagaagcggcggcaccgacaaggacatcagcgccaaggccgtgcaggacaagctggaccagatggtgttcatctgggagaacatccacaccctggtggaggagagagaggccaagctgctggacgtgatggagctggccgagaagttctggtgcgaccacatgagcctgatcgtgaccatcaaggacacccaggacttcatcagagacctggaggaccccggcatcgaccccagcgtggtgaagcagcagcaggaggccgccgagaccatcagagaggagatcgacggcctgcaggaggagctggacatcgtgatcaacctgggcagcgagctgatcgccgcctgcggcgagcccgacaagcccatcgtgaagaagagcatcgacgagctgaacagcatgggcttcagcaagtag

SEQ ID NO: 79925 - DNA, 1359 bp, Artificial Sequence
  Description of Artificial Sequence: Synthetic coding sequence
atgttccccgaccagcccgagaagcccctgaacctggcccacatcgtgccccccagacccgtgaccagcatgaacgacaccctgttcagccacagcgtgcccagcagcggcagccccttcatcaccagaagactgcccgagggcatcagcgccagcagccccgtggccgaggagcacagcctgatcaagctgtacgtgaaccagctggaccacggcgccagaagcccccccaaggacagcgaggtggagcagaacaagctgctggccagagccgcccccgccttcctgaagggcaagggcatccagtacagcctgaacgtggccgacagactggccgacgagcacgtgctgatcggcctgtacgtgaacatgctgagaaacaaccccagctgcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaagacccagggcgccggcagccccagaagcagccccagccacaccatcagcagacccatccccatgcccatcagaagcgccagcgcctgcagcacccccacccacaccccccaggacagcctgaccggcgtgggcggcgacgtgcaggaggccttcgcccagagcagcagaagaaacctgagaaacgacctgctggtggccgccgacagcatcaccaacaccatgagcagcctggtgaaggagctgaacagcgaggtgggcagcgagaccgagagcaacgtggacagcgagttcgccagaacccagttcgaggacctggtgcccagccccaccagcgagaaggccttcctggcccagatccacgccagaaagcccggctacatccacagcggcgccaccaccagcaccatgagaggcgacatggtgaccgaggacgccgacccctacgtgcagcccgaggacgagaactacgagaacgacagcgtgagacagctggagaacgagctgcagatggaggagtacctgaagcagaagctgcaggacgaggcctaccaggtgagcctgcagggctag

SEQ ID NO: 79926 - DNA, 1116 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtgccccccagacccgtgaccagcatgaacgacaccctgttcagccacagcgtgcccagcagcggcagccccttcatcaccagaagcagcgacggcgccttcggcggctgcgtgtag

SEQ ID NO: 79927 - DNA, 1188 bp, Artificial Sequence
  Description of Artificial Sequence: Synthetic coding sequence
atgttccccgaccagcccgagaagcccctgaacctggcccacatcgtgccccccagacccgtgaccagcatgaacgacaccctgttcagccacagcgtgcccagcagcggcagccccttcatcaccagaagactgcccgagggcatcagcgccagcagccccgtggccgaggagcacagcctgatcaagctgtacgtgaaccagctggaccacggcgccagaatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaagacccagggcgccggcagccccagaagcagccccagccacaccatcagcagacccatccccatgcccatcagaagcgccagcgcctgcagcacccccacccacaccccccaggacagcctgaccggcgtgggcggcgacgtgcaggaggccttcgcccagagcagcagaagaaacctgagaaacgacctgctggtggccgccgacagcatcaccaacaccatgagcagcctggtgaaggagctgaacagcgaggtgggcagcgagaccgagagcaacgtggacagcgagttcgccagaacccagttcgaggacctggtgcccagccccaccagcgagaaggccttcctggcccagatccacgccagaaagcccggctacatccacagcggcgccaccaccagcaccatgagaggcgacatggtgaccgaggacgccgacccctacgtgcagcccgaggacgagaactacgagaacgacagcgtgagacagctggagaacgagctgcagatggaggagtacctgaagcagaagctgcaggacgaggcctaccaggtgagcctgcagggctag

SEQ ID NO: 79928 - DNA, 2175 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtgccccccagacccgtgaccagcatgaacgacaccctgttcagccacagcgtgcccagcagcggcagccccttcatcaccagaagcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaagacccagggcgccggcagccccagaagcagccccagccacaccatcagcagacccatccccatgcccatcagaagcgccagcgcctgcagcacccccacccacaccccccaggacagcctgaccggcgtgggcggcgacgtgcaggaggccttcgcccagagcagcagaagaaacctgagaaacgacctgctggtggccgccgacagcatcaccaacaccatgagcagcctggtgaaggagctgaacagcgaggtgggcagcgagaccgagagcaacgtggacagcgagttcgccagaacccagttcgaggacctggtgcccagccccaccagcgagaaggccttcctggcccagatccacgccagaaagcccggctacatccacagcggcgccaccaccagcaccatgagaggcgacatggtgaccgaggacgccgacccctacgtgcagcccgaggacgagaactacgagaacgacagcgtgagacagctggagaacgagctgcagatggaggagtacctgaagcagaagctgcaggacgaggcctaccagctgcacgtgagcaccgagaccagactggagcacccctgccccgtgagcgagaccaagtggagagtgctgttctggggcttcgtgttcttcggcggcttcctgagcctggccctgcagatctacttctggggcctgttctag

SEQ ID NO: 79929 - DNA, 912 bp, Artificial Sequence
  Description of Artificial Sequence: Synthetic coding sequence
atgctggagaccctgagagagagactgctgagcgtgcagcaggacttcaccagcggcctgaagaccctgagcgacaagagcagagaggccaaggtgaagagcaagcccagaaccgtgcccttcctgcccaagtacagcgccggcctggagctgctgagcagatacgaggacacctgggccgccctgcacagaagagccaaggactgcgccagcgccggcgagctggtggacagcgaggtggtgatgctgagcgcccactgggagaagaagaagaccagcctggtggagctgcaggagcagctgcagcagctgcccgccctgatcgccgacctggagagcatgaccgccaacctgacccacctggaggccagcttcgaggaggtggagaacaacctgctgcacctggaggacctgtgcggccagtgcgagctggagagatgcaagcacatgcagagccagcagctggagaactacaagaagaacaagagaaaggagctggagaccttcaaggccgagctggacgccgagcacgcccagaaggtgctggagatggagcacacccagcagatgaagctgaaggagagacagaagttcttcgaggaggccttccagcaggacatggagcagtacctgagcaccggctacctgcagatcgccgagagaagagagcccatcggcagcatgagcagcatggaggtgaacgtggacatgctggagcagatggacctgatggacatcagcgaccaggaggccctggacgtgttcctgaacagcggcggcgaggagaacaccgtgctgagccccgccctgggcagagtggacaagctggccctggccgagcccggccagtacagatgccacagcccccccaaggtgagaagagagaaccacctgcccgtgacctacgcctag

SEQ ID NO: 79930 - DNA, 1056 bp, Artificial Sequence
  Description of Artificial Sequence: Synthetic coding sequence
atgctggagaccctgagagagagactgctgagcgtgcagcaggacttcaccagcggcctgaagaccctgagcgacaagagcagagaggccaaggtgaagagcaagcccagaaccgtgcccttcctgcccaagtacagcgccggcctggagctgctgagcagatacgaggacacctgggccgccctgcacagaagagccaaggactgcgccagcgccggcgagctggtggacagcgaggtggtgatgctgagcgcccactgggagaagaagaagaccagcctggtggagctgcaggagcagctgcagcagctgcccgccctgatcgccgacctggagagcatgaccgccaacctgacccacctggaggccagcttcgaggaggtggagaacaacctgctgcacctggaggacctgtgcggccagtgcgagctggagagatgcaagcacatgcagagccagcagctggagaactacaagaagaacaagagaaaggagctggagaccttcaaggccgagctggacgccgagcacgcccagaaggtgctggagatggagcacacccagcagatgaagctgaaggagagacagaagttcttcgaggaggccttccagcaggacatggagcagtacctgagcaccggctacctgcagatcgccgagagaagagagcccatcggcagcatgagcagcatggaggtgaacgtggacatgctggagcagatggacctgatggacatcagcgaccaggaggccctggacgtgttcctgaacagcggcggcgaggagaacaccgtgctgagccccgccctgggccccgagagcagcacctgccagaacgagatcaccctgcaggtgcccaaccccagcgagctgagagccaagccccccagcagcagcagcacctgcaccgacagcgccaccagagacatcagcgagggcggcgagagccccgtggtgcagagcgacgaggaggaggtgcaggtggacaccgccctggccaccagccacaccgacagagaggccacccccgacggcggcgaggacagcgacagctag

SEQ ID NO: 79931 - DNA, 1059 bp, Artificial Sequence
  Description of Artificial Sequence: Synthetic coding sequence
atgctggagaccctgagagagagactgctgagcgtgcagcaggacttcaccagcggcctgaagaccctgagcgacaagagcagagaggccaaggtgaagagcaagcccagaaccgtgcccttcctgcccaagtacagcgccggcctggagctgctgagcagatacgaggacacctgggccgccctgcacagaagagccaaggactgcgccagcgccggcgagctggtggacagcgaggtggtgatgctgagcgcccactgggagaagaagaagaccagcctggtggagctgcaggagcagctgcagcagctgcccgccctgatcgccgacctggagagcatgaccgccaacctgacccacctggaggccagcttcgaggaggtggagaacaacctgctgcacctggaggacctgtgcggccagtgcgagctggagagatgcaagcacatgcagagccagcagctggagaactacaagaagaacaagagaaaggagctggaggtgaccttcagaagcgagctggacgccgagcacgcccagaaggtgctggagatggagcacacccagcagatgaagctgaaggagagacagaagttcttcgaggaggccttccagcaggacatggagcagtacctgagcaccggctacctgcagatcgccgagagaagagagcccatcggcagcatgagcagcatggaggtgaacgtggacatgctggagcagatggacctgatggacatcagcgaccaggaggccctggacgtgttcctgaacagcggcggcgaggagaacaccgtgctgagccccgccctgggccccgagagcagcacctgccagaacgagatcaccctgcaggtgcccaaccccagcgagctgagagccaagccccccagcagcagcagcacctgcaccgacagcgccaccagagacatcagcgagggcggcgagagccccgtggtgcagagcgacgaggaggaggtgcaggtggacaccgccctggccaccagccacaccgacagagaggccacccccgacggcggcgaggacagcgacagctag

SEQ ID NO: 79932 - DNA, 813 bp, Artificial Sequence
  Description of Artificial Sequence: Synthetic coding sequence
atgctgagcgcccactgggagaagaagaagaccagcctggtggagctgcaggagcagctgcagcagctgcccgccctgatcgccgacctggagagcatgaccgccaacctgacccacctggaggccagcttcgaggaggtggagaacaacctgctgcacctggaggacctgtgcggccagtgcgagctggagagatgcaagcacatgcagagccagcagctggagaactacaagaagaacaagagaagaagactgagaaccttcaagaccgagctggacgccgagcacgcccagaaggtgctggagatggagcacacccagcagatgaagctgaaggagagacagaagttcttcgaggaggccttccagcaggacatggagcagtacctgagcaccggctacctgcagatcgccgagagaagagagcccatcggcagcatgagcagcatggaggtgaacgtggacatgctggagcagatggacctgatggacatcagcgaccaggaggccctggacgtgttcctgaacagcggcggcgaggagaacaccgtgctgagccccgccctgggccccgagagcagcacctgccagaacgagatcaccctgcaggtgcccaaccccagcgagctgagagccaagccccccagcagcagcagcacctgcaccgacagcgccaccagagacatcagcgagggcggcgagagccccgtggtgcagagcgacgaggaggaggtgcaggtggacaccgccctggccaccagccacaccgacagagaggccacccccgacggcggcgaggacagcgacagctag

SEQ ID NO: 79933 - DNA, 912 bp, Artificial Sequence
  Description of Artificial Sequence: Synthetic coding sequence
atgctggagaccctgagagagagactgctgagcgtgcagcaggacttcaccagcggcctgaagaccctgagcgacaagagcagagaggccaaggtgaagagcaagcccagaaccgtgcccttcctgcccaagtacagcgccggcctggagctgctgagcagatacgaggacacctgggccgccctgcacagaagagccaaggactgcgccagcgccggcgagctggtggacagcgaggtggtgatgctgagcgcccactgggagaagaagaagaccagcctggtggagctgcaggagcagctgcagcagctgcccgccctgatcgccgacctggagagcatgaccgccaacctgacccacctggaggccagcttcgaggaggtggagaacaacctgctgcacctggaggacctgtgcggccagtgcgagctggagagatgcaagcacatgcagagccagcagctggagaactacaagaagaacaagagcaaggagctgggcaccggcaaggccgagctggacgccgagcacgcccagaaggtgctggagatggagcacacccagcagatgaagctgaaggagagacagaagttcttcgaggaggccttccagcaggacatggagcagtacctgagcaccggctacctgcagatcgccgagagaagagagcccatcggcagcatgagcagcatggaggtgaacgtggacatgctggagcagatggacctgatggacatcagcgaccaggaggccctggacgtgttcctgaacagcggcggcgaggagaacaccgtgctgagccccgccctgggcagagtggacaagctggccctggccgagcccggccagtacagatgccacagcccccccaaggtgagaagagagaaccacctgcccgtgacctacgcctag

SEQ ID NO: 79934 - DNA, 135 bp, Artificial Sequence
  Description of Artificial Sequence: Synthetic coding sequence
atgctggagaccctgagagagagactgctgagcgtgcagcaggacttcaccagcggcctgaagaccctgagcgacaagagcagagaggccaaggtgaagagcaagcccagctggctgaaccaggagcagttctag

SEQ ID NO: 79935 - DNA, 627 bp, Artificial Sequence
  Description of Artificial Sequence: Synthetic coding sequence
atgctggagaccctgagagagagactgctgagcgtgcagcaggacttcaccagcggcctgaagaccctgagcgacaagagcagagaggccaaggtgaagagcaagcccagatacgaggacacctgggccgccctgcacagaagagccaaggactgcgccagcgccggcgagctggtggacagcgaggtggtgatgctgagcgcccactgggagaagaagaagaccagcctggtggagctgcaggagcagctgcagcagctgcccgccctgatcgccgacctggagagcatgaccgccaacctgacccacctggaggccagcttcgaggaggtggagaacaacctgctgcacctggaggacctgtgcggccagtgcgagctggagagatgcaagcacatgcagagccagcagctggagaactacaagaagaacaagagaaaggagctggagaccttcaaggccgagctggacgccgagcacgcccagaaggtgctggagatggagcacacccagcagatgaagctgaaggagagacagaagttcttcgaggaggccttccagcaggacatggagcagtacctgagcaccggctacctgcagatcgccgagagaagaggcgacccctag

SEQ ID NO: 79936 - DNA, 2235 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtgctggacaacatgccccccagacccgtgaccagcatgaacgacaccctgttcagccacagcgtgcccagcagcggcagccccttcatcaccagaagcagcccccccaaggacagcgaggtggagcagaacaagctgctggccagagccgcccccgccttcctgaagggcaagggcatccagtacagcctgaacgtggccgacagactggccgacgagcacgtgctgatcggcctgtacgtgaacatgctgagaaacaaccccagctgcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaagacccagggcgccggcagccccagaagcagccccagccacaccatcagcagacccatccccatgcccatcagaagcgccagcgcctgcagcacccccacccacaccccccaggacagcctgaccggcgtgggcggcgacgtgcaggaggccttcgcccagagcagcagaagaaacctgagaaacgacctgctggtggccgccgacagcatcaccaacaccatgagcagcctggtgaaggagctgaacagcgaggtgggcagcgagaccgagagcaacgtggacagcgagttcgccagaacccagttcgaggacctggtgcccagccccaccagcgagaaggccttcctggcccagatccacgccagaaagcccggctacatccacagcggcgccaccaccagcaccatgagaggcgacatggtgaccgaggacgccgacccctacgtgcagcccgaggacgagaactacgagaacgacagcgtgagacagctggagaacgagctgcagatggaggagtacctgaagcagaagctgcaggacgaggcctaccaggtgagcctgcagggctag

SEQ ID NO: 79937 - DNA, 1713 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtggacacctggccccccagacccgtgaccagcatgaacgacaccctgttcagccacagcgtgcccagcagcggcagccccttcatcaccagaagcagcccccccaaggacagcgaggtggagcagaacaagctgctggccagagccgcccccgccttcctgaagggcaagggcatccagtacagcctgaacgtggccgacagactggccgacgagcacgtgctgatcggcctgtacgtgaacatgctgagaaacaaccccagctgcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaaggaggaggagctgaagcagggcgtgagctacgtgccctactgcagaagctag

SEQ ID NO: 79938 - DNA, 2061 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtggacacctggccccccagacccgtgaccagcatgaacgacaccctgttcagccacagcgtgcccagcagcggcagccccttcatcaccagaagcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaagacccagggcgccggcagccccagaagcagccccagccacaccatcagcagacccatccccatgcccatcagaagcgccagcgcctgcagcacccccacccacaccccccaggacagcctgaccggcgtgggcggcgacgtgcaggaggccttcgcccagagcagcagaagaaacctgagaaacgacctgctggtggccgccgacagcatcaccaacaccatgagcagcctggtgaaggagctgaacagcgaggtgggcagcgagaccgagagcaacgtggacagcgagttcgccagaacccagttcgaggacctggtgcccagccccaccagcgagaaggccttcctggcccagatccacgccagaaagcccggctacatccacagcggcgccaccaccagcaccatgagaggcgacatggtgaccgaggacgccgacccctacgtgcagcccgaggacgagaactacgagaacgacagcgtgagacagctggagaacgagctgcagatggaggagtacctgaagcagaagctgcaggacgaggcctaccaggtgagcctgcagggctag

SEQ ID NO: 79939 - DNA, 1125 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtggacacctggccccccagacccgtgaccagcatgaacgacaccctgttcagccacagcgtgcccagcagcggcagccccttcatcaccagaagcagcgacggcgccttcggcggctgcgtgtag

SEQ ID NO: 79940 - DNA, 1704 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtgccccccagacccgtgaccagcatgaacgacaccctgttcagccacagcgtgcccagcagcggcagccccttcatcaccagaagcagcccccccaaggacagcgaggtggagcagaacaagctgctggccagagccgcccccgccttcctgaagggcaagggcatccagtacagcctgaacgtggccgacagactggccgacgagcacgtgctgatcggcctgtacgtgaacatgctgagaaacaaccccagctgcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaaggaggaggagctgaagcagggcgtgagctacgtgccctactgcagaagctag

SEQ ID NO: 79941 - DNA, 1176 bp, Artificial Sequence
  Description of Artificial Sequence: Synthetic coding sequence
atgttccccgaccagcccgagaagcccctgaacctggcccacatcgtgccccccagacccgtgaccagcatgaacgacaccctgttcagccacagcgtgcccagcagcggcagccccttcatcaccagaagcagcccccccaaggacagcgaggtggagcagaacaagctgctggccagagccgcccccgccttcctgaagggcaagggcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaagacccagggcgccggcagccccagaagcagccccagccacaccatcagcagacccatccccatgcccatcagaagcgccagcgcctgcagcacccccacccacaccccccaggacagcctgaccggcgtgggcggcgacgtgcaggaggccttcgcccagagcagcagaagaaacctgagaaacgacctgctggtggccgccgacagcatcaccaacaccatgagcagcctggtgaaggagctgaacagcgaggtgggcagcgagaccgagagcaacgtggacagcgagttcgccagaacccagttcgaggacctggtgcccagccccaccagcgagaaggccttcctggcccagatccacgccagaaagcccggctacatccacagcggcgccaccaccagcaccatgagaggcgacatggtgaccgaggacgccgacccctacgtgcagcccgaggacgagaactacgagaacgacagcgtgagacagctggagaacgagctgcagatggaggagtacctgaagcagaagctgcaggacgaggcctaccaggtgagcctgcagggctag

SEQ ID NO: 79942 - DNA, 2232 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtggacacctggccccccagacccgtgaccagcatgaacgacaccctgttcagccacagcgtgcccagcagcggcagccccttcatcaccagaagcagcccccccaaggacagcgaggtggagcagaacaagctgctggccagagccgcccccgccttcctgaagggcaagggcatccagtacagcctgaacgtggccgacagactggccgacgagcacgtgctgatcggcctgtacgtgaacatgctgagaaacaaccccagctgcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaagacccagggcgccggcagccccagaagcagccccagccacaccatcagcagacccatccccatgcccatcagaagcgccagcgcctgcagcacccccacccacaccccccaggacagcctgaccggcgtgggcggcgacgtgcaggaggccttcgcccagagcagcagaagaaacctgagaaacgacctgctggtggccgccgacagcatcaccaacaccatgagcagcctggtgaaggagctgaacagcgaggtgggcagcgagaccgagagcaacgtggacagcgagttcgccagaacccagttcgaggacctggtgcccagccccaccagcgagaaggccttcctggcccagatccacgccagaaagcccggctacatccacagcggcgccaccaccagcaccatgagaggcgacatggtgaccgaggacgccgacccctacgtgcagcccgaggacgagaactacgagaacgacagcgtgagacagctggagaacgagctgcagatggaggagtacctgaagcagaagctgcaggacgaggcctaccaggtgagcctgcagggctag

SEQ ID NO: 79943 - DNA, 2073 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtgccccccagacccgtgaccagcatgaacgacaccctgttcagccacagcgtgcccagcagcggcagccccttcatcaccagaagcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaaggaggaggagctgaagcagggcacccagggcgccggcagccccagaagcagccccagccacaccatcagcagacccatccccatgcccatcagaagcgccagcgcctgcagcacccccacccacaccccccaggacagcctgaccggcgtgggcggcgacgtgcaggaggccttcgcccagagcagcagaagaaacctgagaaacgacctgctggtggccgccgacagcatcaccaacaccatgagcagcctggtgaaggagctgaacagcgaggtgggcagcgagaccgagagcaacgtggacagcgagttcgccagaacccagttcgaggacctggtgcccagccccaccagcgagaaggccttcctggcccagatccacgccagaaagcccggctacatccacagcggcgccaccaccagcaccatgagaggcgacatggtgaccgaggacgccgacccctacgtgcagcccgaggacgagaactacgagaacgacagcgtgagacagctggagaacgagctgcagatggaggagtacctgaagcagaagctgcaggacgaggcctaccaggtgagcctgcagggctag

SEQ ID NO: 79944 - DNA, 2061 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtgtgcttcagaccccccagacccgtgaccagcatgaacgacaccctgttcagccacagcgtgcccagcagcggcagccccttcatcaccagaagcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaagacccagggcgccggcagccccagaagcagccccagccacaccatcagcagacccatccccatgcccatcagaagcgccagcgcctgcagcacccccacccacaccccccaggacagcctgaccggcgtgggcggcgacgtgcaggaggccttcgcccagagcagcagaagaaacctgagaaacgacctgctggtggccgccgacagcatcaccaacaccatgagcagcctggtgaaggagctgaacagcgaggtgggcagcgagaccgagagcaacgtggacagcgagttcgccagaacccagttcgaggacctggtgcccagccccaccagcgagaaggccttcctggcccagatccacgccagaaagcccggctacatccacagcggcgccaccaccagcaccatgagaggcgacatggtgaccgaggacgccgacccctacgtgcagcccgaggacgagaactacgagaacgacagcgtgagacagctggagaacgagctgcagatggaggagtacctgaagcagaagctgcaggacgaggcctaccaggtgagcctgcagggctag

SEQ ID NO: 79945 - DNA, 2232 bp, Artificial Sequence
  Description of Artificial Sequence: Synthetic coding sequence
atgatcgaggacagcggcaagagaggcaacaccatggccgagagaagacagctgttcgccgagatgagagcccaggacctggacagaatcagactgagcacctacagaaccgcctgcaagctgagattcgtgcagaagaagtgcaacctgcacctggtggacatctggaacgtgatcgaggccctgagagagaacgccctgaacaacctggaccccaacaccgagctgaacgtgagcagactggaggccgtgctgagcaccatcttctaccagctgaacaagagaatgcccaccacccaccagatccacgtggagcagagcatcagcctgctgctgaacttcctgctggccgccttcgaccccgagggccacggcaagatcagcgtgttcgccgtgaagatggccctggccaccctgtgcggcggcaagatcatggacaagctgagatacatcttcagcatgatcagcgacagcagcggcgtgatggtgtacggcagatacgaccagttcctgagagaggtgctgaagctgcccaccgccgtgttcgagggccccagcttcggctacaccgagcagagcgccagaagctgcttcagccagcagaagaaggtgaccctgaacggcttcctggacaccctgatgagcgacccccccccccagtgcctggtgtggctgcccctgctgcacagactggccaacgtggagaacgtgttccaccccgtggagtgcagctactgccacagcgagagcatgatgggcttcagatacagatgccagcagtgccacaactaccagctgtgccaggactgcttctggagaggccacgccggcggcagccacagcaaccagcaccagatgaaggagtacaccagctggaagagccccgccaagaagctgaccaacgccctgagcaagagcctgagctgcgccagcagcagagagcccctgcaccccatgttccccgaccagcccgagaagcccctgaacctggcccacatcgtgtgcttcagaccccccagacccgtgaccagcatgaacgacaccctgttcagccacagcgtgcccagcagcggcagccccttcatcaccagaagcagcccccccaaggacagcgaggtggagcagaacaagctgctggccagagccgcccccgccttcctgaagggcaagggcatccagtacagcctgaacgtggccgacagactggccgacgagcacgtgctgatcggcctgtacgtgaacatgctgagaaacaaccccagctgcatgctggagagcagcaacagactggacgaggagcacagactgatcgccagatacgccgccagactggccgccgagagcagcagcagccagcccccccagcagagaagcgcccccgacatcagcttcaccatcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggagggcctgatgaagctgctgaagacccagggcgccggcagccccagaagcagccccagccacaccatcagcagacccatccccatgcccatcagaagcgccagcgcctgcagcacccccacccacaccccccaggacagcctgaccggcgtgggcggcgacgtgcaggaggccttcgcccagagcagcagaagaaacctgagaaacgacctgctggtggccgccgacagcatcaccaacaccatgagcagcctggtgaaggagctgaacagcgaggtgggcagcgagaccgagagcaacgtggacagcgagttcgccagaacccagttcgaggacctggtgcccagccccaccagcgagaaggccttcctggcccagatccacgccagaaagcccggctacatccacagcggcgccaccaccagcaccatgagaggcgacatggtgaccgaggacgccgacccctacgtgcagcccgaggacgagaactacgagaacgacagcgtgagacagctggagaacgagctgcagatggaggagtacctgaagcagaagctgcaggacgaggcctaccaggtgagcctgcagggctag

SEQ ID NO: 79946 - DNA, 2232 bp, Artificial Sequence; identical to SEQ ID NO: 79942
  Description of Artificial Sequence: Synthetic coding sequence

SEQ ID NO: 79947 - DNA, 1176 bp, Artificial Sequence; identical to SEQ ID NO: 79941
  Description of Artificial Sequence: Synthetic coding sequence

SEQ ID NO: 79948 - DNA, 1116 bp, Artificial Sequence; identical to SEQ ID NO: 79926
  Description of Artificial Sequence: Synthetic coding sequence

SEQ ID NO: 79949 - DNA, 1794 bp, Artificial Sequence
  Description of Artificial Sequence: Synthetic coding sequence
atgatcgaggagagcggcaacaagagaaagaccatggccgagaagagacagctgttcatcgagatgagagcccagaacttcgacgtgatcagactgagcacctacagaaccgcctgcaagctgagattcgtgcagaagagatgcaacctgcacctggtggacatctggaacatgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgaaggccatgctggccaccatgtgcggcggcaagatgctggacaagctgagatacgtgttcagccagatgagcgacagcaacggcctgatgatcttcagcaagttcgaccagttcctgaaggaggtgctgaagctgcccaccgccgtgttcgagggccccagcttcggctacaccgagcacagcgtgagaacctgcttcccccagcagagaaagatcatgctgaacatgttcctggacaccatgatggccgacccccccccccagtgcctggtgtggctgcccctgatgcacagactggcccacgtggagaacgtgttccaccccgtggagtgcagctactgcagatgcgagagcatgatgggcttcagatacagatgccagcagtgccacaactaccagctgtgccagaactgcttctggagaggccacgccggcggcccccacagcaaccagcaccagatgaaggagcacagcagctggaagagccccgccaagaagctgagccacgccatcagcaagagcctgggctgcgtgcccaccagagagcccccccaccccgtgttccccgagcagcccgagaagcccctggacctggcccacatcgtgccccccagacccctgaccaacatgaacgacaccatggtgagccacatgagcagcggcgtgcccacccccaccaagagactgcagtacagccaggacatccccagccacctggccgacgagcacgccctgatcgccagctacgtggccagactgcagcactgcgccagagtgctggacagccccagcagactggacgaggagcacagactgatcgccagatacgccgccagactggccgccgaggccggcaacgtgaccagaccccccaccgacctgagcttcaacttcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggaggagctgatgaagctgctgaaggaggccgaggccagagagagcgcccaggccaccggcagcccccacaccagccccacccacggcggcggcagacccatgcccatgcccgtgagaagcaccagcgccggcagcacccccacccactgcccccaggacagcctgagcggcgtgggcggcgacgtgcaggaggccttcgcccaggccgaggagggcgccgaggaggaggaggagaagatgcagaacggcaaggacagaggctag

SEQ ID NO: 79950 - DNA, 567 bp, Artificial Sequence
  Description of Artificial Sequence: Synthetic coding sequence
atgatcgaggagagcggcaacaagagaaagaccatggccgagaagagacagctgttcatcgagatgagagcccagaacttcgacgtgatcagactgagcacctacagaaccgcctgcaagctgagattcgtgcagaagagatgcaacctgcacctggtggacatctggaacatgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgaaggccatgctggccaccatgtgcggcggcaagatgctggacaagctgagatacgtgttcagccagatgagcgacagcaacggcctgatgatcttcagcaagttcgaccagttcctgaaggaggtgctgaagctgcccaccgccgtgttcgagggccccagcttcggctag

SEQ ID NO: 79951 - DNA, 399 bp, Artificial Sequence
  Description of Artificial Sequence: Synthetic coding sequence
atgatcgaggagagcggcaacaagagaaagaccatggccgagaagagacagctgttcatcgagatgagagcccagaacttcgacgtgatcagactgagcacctacagaaccgcctgcaagctgagattcgtgcagaagagatgcaacctgcacctggtggacatctggaacatgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgtag

SEQ ID NO: 79952 - DNA, 450 bp, Artificial Sequence
  Description of Artificial Sequence: Synthetic coding sequence
atgatcgaggagagcggcaacaagagaaagaccatggccgagaagagacagctgttcatcgagatgagagcccagaacttcgacgtgatcagactgagcacctacagaaccgcctgcaagctgagattcgtgcagaagagatgcaacctgcacctggtggacatctggaacatgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgaaggccatgctggccaccatgtgcggcggcaagatgctggacaagctgagatag

SEQ ID NO: 79953 - DNA, 1794 bp, Artificial Sequence
  Description of Artificial Sequence: Synthetic coding sequence
atgatcgaggagagcggcaacaagagaaagaccatggccgagaagagacagctgttcatcgagatgagagcccagaacttcgacgtgatcagactgagcacctacagaaccgcctgcaagctgagattcgtgcagaagagatgcaacctgcacctggtggacatctggaacatgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgaaggccatgctggccaccatgtgcggcggcaagatgctggacaagctgagatacgtgttcagccagatgagcgacagcaacggcctgatgatcttcagcaagttcgaccagttcctgaaggaggtgctgaagctgcccaccgccgtgttcgagggccccagcttcggctacaccgagcacagcgtgagaacctgcttcccccagcagagaaagatcatgctgaacatgttcctggacaccatgatggccgacccccccccccagtgcctggtgtggctgcccctgatgcacagactggcccacgtggagaacgtgttccaccccgtggagtgcagctactgcagatgcgagagcatgatgggcttcagatacagatgccagcagtgccacaactaccagctgtgccagaactgcttctggagaggccacgccggcggcccccacagcaaccagcaccagatgaaggagcacagcagctggaagagccccgccaagaagctgagccacgccatcagcaagagcctgggctgcgtgcccaccagagagcccccccaccccgtgttccccgagcagcccgagaagcccctggacctggcccacatcgtgccccccagacccctgaccaacatgaacgacaccatggtgagccacatgagcagcggcgtgcccacccccaccaagagactgcagtacagccaggacatccccagccacctggccgacgagcacgccctgatcgccagctacgtggccagactgcagcactgcgccagagtgctggacagccccagcagactggacgaggagcacagactgatcgccagatacgccgccagactggccgccgaggccggcaacgtgaccagaccccccaccgacctgagcttcaacttcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggaggagctgatgaagctgctgaaggaggaggagcagaagcaggccgcccaggccaccggcagcccccacaccagccccacccacggcggcggcagacccatgcccatgcccgtgagaagcaccagcgccggcagcacccccacccactgcccccaggacagcctgagcggcgtgggcggcgacgtgcaggaggccttcgcccaggccgaggagggcgccgaggaggaggaggagaagatgcagaacggcaaggacagaggctag

SEQ ID NO: 79954 - DNA, 1683 bp, Artificial Sequence
  Description of Artificial Sequence: Synthetic coding sequence
atgatcgaggagagcggcaacaagagaaagaccatggccgagaagagacagctgttcatcgagatgagagcccagaacttcgacgtgatcagactgagcacctacagaaccgcctgcaagctgagattcgtgcagaagagatgcaacctgcacctggtggacatctggaacatgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgaaggccatgctggccaccatgtgcggcggcaagatgctggacaagctgagatacgtgttcagccagatgagcgacagcaacggcctgatgatcttcagcaagttcgaccagttcctgaaggaggtgctgaagctgcccaccgccgtgttcgagggccccagcttcggctacaccgagcacagcgtgagaacctgcttcccccagcagagaaagatcatgctgaacatgttcctggacaccatgatggccgacccccccccccagtgcctggtgtggctgcccctgatgcacagactggcccacgtggagaacgtgttccaccccgtggagtgcagctactgcagatgcgagagcatgatgggcttcagatacagatgccagcagtgccacaactaccagctgtgccagaactgcttctggagaggccacgccggcggcccccacagcaaccagcaccagatgaaggagcacagcagctggaagagccccgccaagaagctgagccacgccatcagcaagagcctgggctgcgtgcccaccagagagcccccccaccccgtgttccccgagcagcccgagaagcccctggacctggcccacatcgtgccccccagacccctgaccaacatgaacgacaccatggtgagccacatgagcagcggcgtgcccacccccaccaagagcgtgctggacagccccagcagactggacgaggagcacagactgatcgccagatacgccgccagactggccgccgaggccggcaacgtgaccagaccccccaccgacctgagcttcaacttcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggaggagctgatgaagctgctgaaggcccaggccaccggcagcccccacaccagccccacccacggcggcggcagacccatgcccatgcccgtgagaagcaccagcgccggcagcacccccacccactgcccccaggacagcctgagcggcgtgggcggcgacgtgcaggaggccttcgcccaggccgaggagggcgccgaggaggaggaggagaagatgcagaacggcaaggacagaggctag

SEQ ID NO: 79955 - DNA, 1884 bp, Artificial Sequence
  Description of Artificial Sequence: Synthetic coding sequence
atgatcgaggagagcggcaacaagagaaagaccatggccgagaagagacagctgttcatcgagatgagagcccagaacttcgacgtgatcagactgagcacctacagaaccgcctgcaagctgagattcgtgcagaagagatgcaacctgcacctggtggacatctggaacatgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgaaggccatgctggccaccatgtgcggcggcaagatgctggacaagctgagatacgtgttcagccagatgagcgacagcaacggcctgatgatcttcagcaagttcgaccagttcctgaaggaggtgctgaagctgcccaccgccgtgttcgagggccccagcttcggctacaccgagcacagcgtgagaacctgcttcccccagcagagaaagatcatgctgaacatgttcctggacaccatgatggccgacccccccccccagtgcctggtgtggctgcccctgatgcacagactggcccacgtggagaacgtgttccaccccgtggagtgcagctactgcagatgcgagagcatgatgggcttcagatacagatgccagcagtgccacaactaccagctgtgccagaactgcttctggagaggccacgccggcggcccccacagcaaccagcaccagatgaaggagcacagcagctggaagagccccgccaagaagctgagccacgccatcagcaagagcctgggctgcgtgcccaccagagagcccccccaccccgtgttccccgagcagcccgagaagcccctggacctggcccacatcgtgccccccagacccctgaccaacatgaacgacaccatggtgagccacatgagcagcggcgtgcccacccccaccaagagactgcagtacagccaggacatccccagccacctggccgacgagcacgccctgatcgccagctacgtggccagactgcagcactgcgccagagtgctggacagccccagcagactggacgaggagcacagactgatcgccagatacgccgccagactggccgccgaggccggcaacgtgaccagaccccccaccgacctgagcttcaacttcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggaggagctgatgaagctgctgaaggaggaggagcagaagcaggccgcccaggccaccggcagcccccacaccagccccacccacggcggcggcagacccatgcccatgcccgtgagaagcaccagcgccggcagcacccccacccactgcccccaggacagcctgagcggcgtgggcggcgacgtgcaggaggccttcgcccagggcaccagaagaaacctgagaaacgacctgctggtggccgccgacagcatcaccaacaccatgagcagcctggtgaaggagctgcacagcgccgaggagggcgccgaggaggaggaggagaagatgcagaacggcaaggacagaggctag

SEQ ID NO: 79956 - DNA, 1704 bp, Artificial Sequence
  Description of Artificial Sequence: Synthetic coding sequence
atgatcgaggagagcggcaacaagagaaagaccatggccgagaagagacagctgttcatcgagatgagagcccagaacttcgacgtgatcagactgagcacctacagaaccgcctgcaagctgagattcgtgcagaagagatgcaacctgcacctggtggacatctggaacatgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgaaggccatgctggccaccatgtgcggcggcaagatgctggacaagctgagatacgtgttcagccagatgagcgacagcaacggcctgatgatcttcagcaagttcgaccagttcctgaaggaggtgctgaagctgcccaccgccgtgttcgagggccccagcttcggctacaccgagcacagcgtgagaacctgcttcccccagcagagaaagatcatgctgaacatgttcctggacaccatgatggccgacccccccccccagtgcctggtgtggctgcccctgatgcacagactggcccacgtggagaacgtgttccaccccgtggagtgcagctactgcagatgcgagagcatgatgggcttcagatacagatgccagcagtgccacaactaccagctgtgccagaactgcttctggagaggccacgccggcggcccccacagcaaccagcaccagatgaaggagcacagcagctggaagagccccgccaagaagctgagccacgccatcagcaagagcctgggctgcgtgcccaccagagagcccccccaccccgtgttccccgagcagcccgagaagcccctggacctggcccacatcgtgccccccagacccctgaccaacatgaacgacaccatggtgagccacatgagcagcggcgtgcccacccccaccaagagcgtgctggacagccccagcagactggacgaggagcacagactgatcgccagatacgccgccagactggccgccgaggccggcaacgtgaccagaccccccaccgacctgagcttcaacttcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggaggagctgatgaagctgctgaaggaggaggagcagaagcaggccgcccaggccaccggcagcccccacaccagccccacccacggcggcggcagacccatgcccatgcccgtgagaagcaccagcgccggcagcacccccacccactgcccccaggacagcctgagcggcgtgggcggcgacgtgcaggaggccttcgcccaggccgaggagggcgccgaggaggaggaggagaagatgcagaacggcaaggacagaggctag

SEQ ID NO: 79957 - DNA, 1773 bp, Artificial Sequence
  Description of Artificial Sequence: Synthetic coding sequence
atgatcgaggagagcggcaacaagagaaagaccatggccgagaagagacagctgttcatcgagatgagagcccagaacttcgacgtgatcagactgagcacctacagaaccgcctgcaagctgagattcgtgcagaagagatgcaacctgcacctggtggacatctggaacatgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgaaggccatgctggccaccatgtgcggcggcaagatgctggacaagctgagatacgtgttcagccagatgagcgacagcaacggcctgatgatcttcagcaagttcgaccagttcctgaaggaggtgctgaagctgcccaccgccgtgttcgagggccccagcttcggctacaccgagcacagcgtgagaacctgcttcccccagcagagaaagatcatgctgaacatgttcctggacaccatgatggccgacccccccccccagtgcctggtgtggctgcccctgatgcacagactggcccacgtggagaacgtgttccaccccgtggagtgcagctactgcagatgcgagagcatgatgggcttcagatacagatgccagcagtgccacaactaccagctgtgccagaactgcttctggagaggccacgccggcggcccccacagcaaccagcaccagatgaaggagcacagcagctggaagagccccgccaagaagctgagccacgccatcagcaagagcctgggctgcgtgcccaccagagagcccccccaccccgtgttccccgagcagcccgagaagcccctggacctggcccacatcgtgccccccagacccctgaccaacatgaacgacaccatggtgagccacatgagcagcggcgtgcccacccccaccaagagcgtgctggacagccccagcagactggacgaggagcacagactgatcgccagatacgccgccagactggccgccgaggccggcaacgtgaccagaccccccaccgacctgagcttcaacttcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggaggagctgatgaagctgctgaaggcccaggccaccggcagcccccacaccagccccacccacggcggcggcagacccatgcccatgcccgtgagaagcaccagcgccggcagcacccccacccactgcccccaggacagcctgagcggcgtgggcggcgacgtgcaggaggccttcgcccagggcaccagaagaaacctgagaaacgacctgctggtggccgccgacagcatcaccaacaccatgagcagcctggtgaaggagctgcacagcgccgaggagggcgccgaggaggaggaggagaagatgcagaacggcaaggacagaggctag

SEQ ID NO: 79958 - DNA, 1830 bp, Artificial Sequence
  Description of Artificial Sequence: Synthetic coding sequence
atgatcgaggagagcggcaacaagagaaagaccatggccgagaagagacagctgttcatcgagatgagagcccagaacttcgacgtgatcagactgagcacctacagaaccgcctgcaagctgagattcgtgcagaagagatgcaacctgcacctggtggacatctggaacatgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgaaggccatgctggccaccatgtgcggcggcaagatgctggacaagctgagatacgtgttcagccagatgagcgacagcaacggcctgatgatcttcagcaagttcgaccagttcctgaaggaggtgctgaagctgcccaccgccgtgttcgagggccccagcttcggctacaccgagcacagcgtgagaacctgcttcccccagcagagaaagatcatgctgaacatgttcctggacaccatgatggccgacccccccccccagtgcctggtgtggctgcccctgatgcacagactggcccacgtggagaacgtgttccaccccgtggagtgcagctactgcagatgcgagagcatgatgggcttcagatacagatgccagcagtgccacaactaccagctgtgccagaactgcttctggagaggccacgccggcggcccccacagcaaccagcaccagatgaaggagcacagcagctggaagagccccgccaagaagctgagccacgccatcagcaagagcctgggctgcgtgcccaccagagagcccccccaccccgtgttccccgagcagcccgagaagcccctggacctggcccacatcgtgccccccagacccctgaccaacatgaacgacaccatggtgagccacatgagcagcggcgtgcccacccccaccaagagactgcagtacagccaggacatccccagccacctggccgacgagcacgccctgatcgccagctacgtggccagactgcagcactgcgccagagtgctggacagccccagcagactggacgaggagcacagactgatcgccagatacgccgccagactggccgccgaggccggcaacgtgaccagaccccccaccgacctgagcttcaacttcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggaggagctgatgaagctgctgaaggaggaggagcagaagcaggccgcccaggccaccggcagcccccacaccagccccacccacggcggcggcagacccatgcccatgcccgtgagaagcaccagcgccggcagcacccccacccactgcccccaggacagcctgagcggcgtgggcggcgacgtgcaggaggccttcgcccagggcaccagaagaaacctgagaaacgacctgctggtggccgccgacagcatcaccaacaccatgagcagcctggtgaaggagctgcacagcggctag

SEQ ID NO: 79959 - DNA, 1638 bp, Artificial Sequence
  Description of Artificial Sequence: Synthetic coding sequence
atgatcgaggccttcagagacaacggcctgaacaccctggaccacaccaccgagatcagcgtgagcagactggagaccgtgatcagcagcatctactaccagctgaacaagagactgcccagcacccaccagatcagcgtggagcagagcatcagcctgctgctgaacttcatgatcgccgcctacgacagcgagggcagaggcaagctgaccgtgttcagcgtgaaggccatgctggccaccatgtgcggcggcaagatgctggacaagctgagatacgtgttcagccagatgagcgacagcaacggcctgatgatcttcagcaagttcgaccagttcctgaaggaggtgctgaagctgcccaccgccgtgttcgagggccccagcttcggctacaccgagcacagcgtgagaacctgcttcccccagcagagaaagatcatgctgaacatgttcctggacaccatgatggccgacccccccccccagtgcctggtgtggctgcccctgatgcacagactggcccacgtggagaacgtgttccaccccgtggagtgcagctactgcagatgcgagagcatgatgggcttcagatacagatgccagcagtgccacaactaccagctgtgccagaactgcttctggagaggccacgccggcggcccccacagcaaccagcaccagatgaaggagcacagcagctggaagagccccgccaagaagctgagccacgccatcagcaagagcctgggctgcgtgcccaccagagagcccccccaccccgtgttccccgagcagcccgagaagcccctggacctggcccacatcgtgccccccagacccctgaccaacatgaacgacaccatggtgagccacatgagcagcggcgtgcccacccccaccaagagactgcagtacagccaggacatccccagccacctggccgacgagcacgccctgatcgccagctacgtggccagactgcagcactgcgccagagtgctggacagccccagcagactggacgaggagcacagactgatcgccagatacgccgccagactggccgccgaggccggcaacgtgaccagaccccccaccgacctgagcttcaacttcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggaggagctgatgaagctgctgaaggcccaggccaccggcagcccccacaccagccccacccacggcggcggcagacccatgcccatgcccgtgagaagcaccagcgccggcagcacccccacccactgcccccaggacagcctgagcggcgtgggcggcgacgtgcaggaggccttcgcccagggcaccagaagaaacctgagaaacgacctgctggtggccgccgacagcatcaccaacaccatgagcagcctggtgaaggagctgcacagcggctag

SEQ ID NO: 79960 - DNA, 960 bp, Artificial Sequence
  Description of Artificial Sequence: Synthetic coding sequence
atgaccgacgtgttcagccagatgagcgacagcaacggcctgatgatcttcagcaagttcgaccagttcctgaaggaggtgctgaagctgcccaccgccgtgttcgagggccccagcttcggctacaccgagcacagcgtgagaacctgcttcccccagcagagaaagatcatgctgaacatgttcctggacaccatgatggccgacccccccccccagtgcctggtgtggctgcccctgatgcacagactggcccacgtggagaacgtgttccaccccgtggagtgcagctactgcagatgcgagagcatgatgggcttcagatacagatgccagcagtgccacaactaccagctgtgccagaactgcttctggagaggccacgccggcggcccccacagcaaccagcaccagatgaaggagcacagcagctggaagagccccgccaagaagctgagccacgccatcagcaagagcctgggctgcgtgcccaccagagagcccccccaccccgtgttccccgagcagcccgagaagcccctggacctggcccacatcgtgccccccagacccctgaccaacatgaacgacaccatggtgagccacatgagcagcggcgtgcccacccccaccaagagactgcagtacagccaggacatccccagccacctggccgacgagcacgccctgatcgccagctacgtggccagactgcagcactgcgccagagtgctggacagccccagcagactggacgaggagcacagactgatcgccagatacgccgccagactggccgccgaggccggcaacgtgaccagaccccccaccgacctgagcttcaacttcgacgccaacaagcagcagagacagctgatcgccgagctggagaacaagaacagagagatcctgcaggagatccagagactgagactggagcacgagcaggccagccagtag

SEQ ID NO: 79961 - DNA, 1251 bp, Artificial Sequence
  Description of Artificial Sequence: Synthetic coding sequence
atgctgaacatgttcctggacaccatgatggccgacccccccccccagtgcctggtgtggctgcccctgatgcacagactggcccacgtggagaacgtgttccaccccgtggagtgcagctactgcagatgcgagagcatgatgggcttcagatacagatgccagcagtgccacaactaccagctgtgccagaactgcttctggagaggccacgccggcggcccccacagcaaccagcaccagatgaaggagcacagcagctggaagagccccgccaagaagctgagccacgccatcagcaagagcctgggctgcgtgcccaccagagagcccccccaccccgtgttccccgagcagcccgagaagcccctggacctggcccacatcgtgccccccagacccctgaccaacatgaacgacaccatggtgagccacatgagcagcggcgtgcccacccccaccaagagactgcagtacagccaggacatccccagccacctggccgacgagcacgccctgatcgccagctacgtggccagactgcagcactgcgccagagtgctggacagccccagcagactggacgaggagcacagactgatcgccagatacgccgccagactggccgccgaggccggcaacgtgaccagaccccccaccgacctgagcttcaacttcgacgccaacaagcagcagagacagctgatcgccgagctggagaacaagaacagagagatcctgcaggagatccagagactgagactggagcacgagcaggccagccagcccacccccgagaaggcccagcagaaccccaccctgctggccgagctgagactgctgagacagagaaaggacgagctggagcagagaatgagcgccctgcaggagagcagaagagagctgatggtgcagctggaggagctgatgaagctgctgaaggcccaggccaccggcagcccccacaccagccccacccacggcggcggcagacccatgcccatgcccgtgagaagcaccagcgccggcagcacccccacccactgcccccaggacagcctgagcggcgtgggcggcgacgtgcaggaggccttcgcccagggcaccagaagaaacctgagaaacgacctgctggtggccgccgacagcatcaccaacaccatgagcagcctggtgaaggagctgcacagcgccgaggagggcgccgaggaggaggaggagaagatgcagaacggcaaggacagaggctag

SEQ ID NO: 79962 - DNA, 2688 bp, Artificial Sequence
  Description of Artificial Sequence: Synthetic coding sequence
atgagaatgagcgtgggcctgagcctgctgctgcccctgagcggcagaaccttcctgctgctgctgagcgtggtgatggcccagagccactggcccagcgagcccagcgaggccgtgagagactgggagaaccagctggaggccagcatgcacagcgtgctgagcgacctgcacgaggccgtgcccaccgtggtgggcatccccgacggcaccgccgtggtgggcagaagcttcagagtgaccatccccaccgacctgatcgccagcagcggcgacatcatcaaggtgagcgccgccggcaaggaggccctgcccagctggctgcactgggacagccagagccacaccctggagggcctgcccctggacaccgacaagggcgtgcactacatcagcgtgagcgccaccagactgggcgccaacggcagccacatcccccagaccagcagcgtgttcagcatcgaggtgtaccccgaggaccacagcgagctgcagagcgtgagaaccgccagccccgaccccggcgaggtggtgagcagcgcctgcgccgccgacgagcccgtgaccgtgctgaccgtgatcctggacgccgacctgaccaagatgacccccaagcagagaatcgacctgctgcacagaatgagaagcttcagcgaggtggagctgcacaacatgaagctggtgcccgtggtgaacaacagactgttcgacatgagcgccttcatggccggccccggcaacgccaagaaggtggtggagaacggcgccctgctgagctggaagctgggctgcagcctgaaccagaacagcgtgcccgacatccacggcgtggaggcccccgccagagagggcgccatgagcgcccagctgggctaccccgtggtgggctggcacatcgccaacaagaagccccccctgcccaagagagtgagaagacagatccacgccacccccacccccgtgaccgccatcggcccccccaccaccgccatccaggagccccccagcagaatcgtgcccacccccaccagccccgccatcgccccccccaccgagaccatggccccccccgtgagagaccccgtgcccggcaagcccaccgtgaccatcagaaccagaggcgccatcatccagacccccaccctgggccccatccagcccaccagagtgagcgaggccggcaccaccgtgcccggccagatcagacccaccatgaccatccccggctacgtggagcccaccgccgtggccaccccccccaccaccaccaccaagaagcccagagtgagcacccccaagcccgccacccccagcaccgacagcaccaccaccaccaccagaagacccaccaagaagcccagaacccccagacccgtgcccagagtgaccaccaaggtgagcatcaccagactggagaccgccagcccccccaccagaatcagaaccaccaccagcggcgtgcccagaggcggcgagcccaaccagagacccgagctgaagaaccacatcgacagagtggacgcctgggtgggcacctacttcgaggtgaagatccccagcgacaccttctacgaccacgaggacaccaccaccgacaagctgaagctgaccctgaagctgagagagcagcagctggtgggcgagaagagctgggtgcagttcaacagcaacagccagctgatgtacggcctgcccgacagcagccacgtgggcaagcacgagtacttcatgcacgccaccgacaagggcggcctgagcgccgtggacgccttcgagatccacgtgcacagaagaccccagggcgacagagcccccgccagattcaaggccaagttcgtgggcgaccccgccctggtgctgaacgacatccacaagaagatcgccctggtgaagaagctggccttcgccttcggcgacagaaactgcagcaccatcaccctgcagaacatcaccagaggcagcatcgtggtggagtggaccaacaacaccctgcccctggagccctgccccaaggagcagatcgccggcctgagcagaagaatcgccgaggacgacggcaagcccagacccgccttcagcaacgccctggagcccgacttcaaggccaccagcatcaccgtgaccggcagcggcagctgcagacacctgcagttcatccccgtggtgccccccagaagagtgcccagcgaggccccccccaccgaggtgcccgacagagaccccgagaagagcagcgaggacgacgtgtacctgcacaccgtgatccccgccgtggtggtggccgccatcctgctgatcgccggcatcatcgccatgatctgctacagaaagaagagaaagggcaagctgaccctggaggaccaggccaccttcatcaagaagggcgtgcccatcatcttcgccgacgagctggacgacagcaagcccccccccagcagcagcatgcccctgatcctgcaggaggagaaggcccccctgcccccccccgagtaccccaaccagagcgtgcccgagaccacccccctgaaccaggacaccatgggcgagtacacccccctgagagacgaggaccccaacgcccccccctaccagccccccccccccttcaccgcccccatggagggcaagggcagcagacccaagaacatgaccccctacagaagcccccccccctacgtgcccccctag

SEQ ID NO: 79963 - DNA, 432 bp, Artificial Sequence
  Description of Artificial Sequence: Synthetic coding sequence
atgacccccaagcagagaatcgacctgctgcacagaatgagaagcttcagcgaggtggagctgcacaacatgaagctggtgcccgtggtgaacaacagactgttcgacatgagcgccttcatggccggccccggcaacgccaagaaggtggtggagaacggcgccctgctgagctggaagctgggctgcagcctgaaccagaacagcgtgcccgacatccacggcgtggaggcccccgccagagagggcgccatgagcgcccagctgggctaccccgtggtgggctggcacatcgccaacaagaagccccccgccctgagcggcccccccaagccccagagcagctggagagacttcggcgacttcttcatcttcatcttctgcctgaccgccttcggcctgttcatcgagaacagcagcctgcacttctag

SEQ ID NO: 79964 - DNA, 267 bp, Artificial Sequence
  Description of Artificial Sequence: Synthetic coding sequence
atgagaatgagcgtgggcctgagcctgctgctgcccctgagcggcagaaccttcctgctgctgctgagcgtggtgatggcccagagccactggcccagcgagcccagcgaggccgtgagagactgggagaaccagctggaggccagcatgcacagcgtgctgagcgacctgcacgaggccgtgcccaccgtggtgggcatccccgacggcaccgccgtggtgggcagaagcttcagagtgaccatccccaccgacctgatcgcctag

SEQ ID NO: 79965 - DNA, 48 bp, Artificial Sequence
  Description of Artificial Sequence: Synthetic coding sequence
atgagaatgagcgtgggcctgagcctgctgctgcccctgagcggctag

SEQ ID NO: 79966 - DNA, 321 bp, Artificial Sequence
  Description of Artificial Sequence: Synthetic coding sequence
atgagaatgagcgtgggcctgagcctgctgctgcccctgagcggcagaaccttcctgctgctgctgagcgtggtgatggcccagagccactggcccagcgagcccagcgaggccgtgagagactgggagaaccagctggaggccagcatgcacagcgtgctgagcgacctgcacgaggccgtgcccaccgtggtgggcatccccgacggcaccgccgtggtgggcagaagcttcagagtgaccatccccaccgacctgatcgccagcagcggcgacatcatcaaggtgagcgccgccggcaaggaggccctgcccagctag

SEQ ID NO: 79967 - DNA, 291 bp, Artificial Sequence
  Description of Artificial Sequence: Synthetic coding sequence
atgagaatgagcgtgggcctgagcctgctgctgcccctgagcggcagaaccttcctgctgctgctgagcgtggtgatggcccagagccactggcccagcgagcccagcgaggccgtgagagactgggagaaccagctggaggccagcatgcacagcgtgctgagcgacctgcacgaggccgtgcccaccgtggtgggcatccccgacggcaccgccgtggtgggcagaagcttcagagtgaccatccccaccgacctgatcgccagcagcggcgacatcatcaaggtgtag

SEQ ID NO: 79968 - DNA, 30 bp, Artificial Sequence
  Description of Artificial Sequence: Synthetic coding sequence
atgagaatgagcgtgggcctgagcctgtag

SEQ ID NO: 79969 - DNA, 354 bp, Artificial Sequence
  Description of Artificial Sequence: Synthetic coding sequence
atgagaatgagcgtgggcctgagcctgctgctgcccctgagcggcagaaccttcctgctgctgctgagcgtggtgatggcccagagccactggcccagcgagcccagcgaggccgtgagagactgggagaaccagctggaggccagcatgcacagcgtgctgagcgacctgcacgaggccgtgcccaccgtggtgggcatccccgacggcaccgccgtggtgggcagaagcttcagagtgaccatccccaccgacctgatcgccagcagcggcgacatcatcaaggtgagcgccgccggcaaggaggccctgcccagctggctgcactgggacagccagagccacaccctgtag

SEQ ID NO: 79970 - DNA, 159 bp, Artificial Sequence
  Description of Artificial Sequence: Synthetic coding sequence
atgagaatgagcgtgggcctgagcctgctgctgcccctgagcggcagaaccttcctgctgctgctgagcgtggtgatggcccagagccactggcccagcgagcccagcgaggccgtgagagactgggagaaccagctggaggccagcatgcacagctag

SEQ ID NO: 79971 - DNA, 261 bp, Artificial Sequence
  Description of Artificial Sequence: Synthetic coding sequence
atgagaatgagcgtgggcctgagcctgctgctgcccctgagcggcagaaccttcctgctgctgctgagcgtggtgatggcccagagccactggcccagcgagcccagcgaggccgtgagagactgggagaaccagctggaggccagcatgcacagcgtgctgagcgacctgcacgaggccgtgcccaccgtggtgggcatccccgacggcaccgccgtggtgggcagaagcttcagagtgaccatccccaccgacctgtag

SEQ ID NO: 79972 - DNA, 126 bp, Artificial Sequence
  Description of Artificial Sequence: Synthetic coding sequence
atgagaatgagcgtgggcctgagcctgctgctgcccctgagcggcagaaccttcctgctgctgctgagcgtggtgatggcccagagccactggcccagcgagcccagcgaggccgtgagagactag

SEQ ID NO: 79973 - DNA, 2688 bp, Artificial Sequence; identical to SEQ ID NO: 79962
  Description of Artificial Sequence: Synthetic coding sequence

SEQ ID NO: 79974 - DNA, 2688 bp, Artificial Sequence; identical to SEQ ID NO: 79962
  Description of Artificial Sequence: Synthetic coding sequence

SEQ ID NO: 79975 - DNA, 2688 bp, Artificial Sequence; identical to SEQ ID NO: 79962
  Description of Artificial Sequence: Synthetic coding sequence

SEQ ID NO: 79976 - DNA, 2688 bp, Artificial Sequence; identical to SEQ ID NO: 79962
  Description of Artificial Sequence: Synthetic coding sequence

SEQ ID NO: 79977 - DNA, 2688 bp, Artificial Sequence; identical to SEQ ID NO: 79962
  Description of Artificial Sequence: Synthetic coding sequence

SEQ ID NO: 79978 - DNA, 2025 bp, Artificial Sequence
  Description of Artificial Sequence: Synthetic coding sequence
atggccgccggcggcgccgagggcggcagcggccccggcgccgccatgggcgactgcgccgagatcaagagccagttcagaaccagagagggcttctacaagctgctgcccggcgacggcgccgccagaagaagcggccccgccagcgcccagacccccgtgcccccccagcccccccagcccccccccggccccgccagcgccagcggccccggcgccgccggccccgccagcagccccccccccgccggccccggccccggccccgccctgcccgccgtgagactgagcctggtgagactgggcgagcccgacagcgccggcgccggcgagccccccgccacccccgccggcctgggcagcggcggcgacagagtgtgcttcaacctgggcagagagctgtacttctaccccggctgctgcagaagaggcagccagagaagcatcgacctgaacaagcccatcgacaagagaatctacaagggcacccagcccacctgccacgacttcaaccagttcaccgccgccaccgagaccatcagcctgctggtgggcttcagcgccggccaggtgcagtacctggacctgatcaagaaggacaccagcaagctgttcaacgaggagagactgatcgacaagaccaaggtgacctacctgaagtggctgcccgagagcgagagcctgttcctggccagccacgccagcggccacctgtacctgtacaacgtgagccacccctgcgccagcgcccccccccagtacagcctgctgaagcagggcgagggcttcagcgtgtacgccgccaagagcaaggcccccagaaaccccctggccaagtgggccgtgggcgagggccccctgaacgagttcgccttcagccccgacggcagacacctggcctgcgtgagccaggacggctgcctgagagtgttccacttcgacagcatgctgctgagaggcctgatgaagagctacttcggcggcctgctgtgcgtgtgctggagccccgacggcagatacgtggtgaccggcggcgaggacgacctggtgaccgtgtggagcttcaccgagggcagagtggtggccagaggccacggccacaagagctgggtgaacgccgtggccttcgacccctacaccaccagagccgaggaggccgccaccgccgccggcgccgacggcgagagaagcggcgaggaggaggaggaggagcccgaggccgccggcaccggcagcgccggcggcgcccccctgagccccctgcccaaggccggcagcatcacctacagattcggcagcgccggccaggacacccagttctgcctgtgggacctgaccgaggacgtgctgtacccccacccccccctggccagaaccagaaccctgcccggcacccccggcaccaccccccccgccgccagcagcagcagaggcggcgagcccggccccggccccctgcccagaagcctgagcagaagcaacagcctgccccaccccgccggcggcggcaaggccggcggccccggcgtggccgccgagcccggcacccccttcagcatcggcagattcgccaccctgaccctgcaggagagaagagacagaggcgccgagaaggagcacaagagataccacagcctgggcaacatcagcagaggcggcagcggcggcagcggcagcggcggcgagaagcccagcggccccgtgcccagaagcagactggaccccgccaaggtgctgggcaccgccctgtgccccagaatccacgaggtgcccctgctggagcccctggtgtgcaagaagatcgcccaggagagactgaccgtgctgctgttcctggaggactgcatcatcaccgcctgccaggagggcctgatctgcacctgggccagacccggcaaggccttcaccgacgaggagaccgaggcccagaccggcgagggcagctggcccagaagccccagcaagagcgtggtggagggcatcagcagccagcccggcaacagccccagcggcaccgtggtgtag

SEQ ID NO: 79979 - DNA, 1890 bp, Artificial Sequence
  Description of Artificial Sequence: Synthetic coding sequence
atgagcgccgaggtgagactgagaagactgcagcagctggtgctggaccccggcttcctgggcctggagcccctgctggacctgctgctgggcgtgcaccaggagctgggcgccagcgagctggcccaggacaagtacgtggccgacttcctgcagtgggccgagcccatcgtggtgagactgaaggaggtgagactgcagagagacgacttcgagatcctgaaggtgatcggcagaggcgccttcagcgaggtggccgtggtgaagatgaagcagaccggccaggtgtacgccatgaagatcatgaacaagtgggacatgctgaagagaggcgaggtgagctgcttcagagaggagagagacgtgctggtgaacggcgacagaagatggatcacccagctgcacttcgccttccaggacgagaactacctgtacctggtgatggagtactacgtgggcggcgacctgctgaccctgctgagcaagttcggcgagagaatccccgccgagatggccagattctacctggccgagatcgtgatggccatcgacagcgtgcacagactgggctacgtgcacagagacatcaagcccgacaacatcctgctggacagatgcggccacatcagactggccgacttcggcagctgcctgaagctgagagccgacggcaccgtgagaagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggccagagacttcatccagagactgctgtgcccccccgagaccagactgggcagaggcggcgccggcgacttcagaacccaccccttcttcttcggcctggactgggacggcctgagagacagcgtgccccccttcacccccgacttcgagggcgccaccgacacctgcaacttcgacctggtggaggacggcctgaccgccatggtgagcggcggcggcgagaccctgagcgacatcagagagggcgcccccctgggcgtgcacctgcccttcgtgggctacagctacagctgcatggccctgagagacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgagagagctgcaggaggccctggaggaggaggtgctgaccagacagagcctgagcagagagatggaggccatcagaaccgacaaccagaacttcgccagccagctgagagaggccgaggccagaaacagagacctggaggcccacgtgagacagctgcaggagagaatggagctgctgcaggccgagggcgccaccgccgtgaccggcgtgcccagccccagagccaccgacccccccagccacctggacggcccccccgccgtggccgtgggccagtgccccctggtgggccccggccccatgcacagaagacacctgctgctgcccgccagagtgcccagacccggcctgagcgaggccctgagcctgctgctgttcgccgtggtgctgagcagagccgccgccctgggctgcatcggcctggtggcccacgccggccagctgaccgccgtgtggagaagacccggcgccgccagagccccctag

SEQ ID NO: 79980 - DNA, 1968 bp, Artificial Sequence
  Description of Artificial Sequence: Synthetic coding sequence
atggtgctgcccgtgcagcacgtgagcagaggcgccgccgaggccgcccccgccgccggcgtgggccccggcctgcccggcgccggcgcccccgccagacccagccccggcagaccccccggcgccggcagactgagaaccggccccggccaggtgagaggcagactgctggccgtgggccccaagagcagagtgttccagagcgtggtgcaggagccccccgccagcgagagcagagccgagcccatcgtggtgagactgaaggaggtgagactgcagagagacgacttcgagatcctgaaggtgatcggcagaggcgccttcagcgaggtggccgtggtgaagatgaagcagaccggccaggtgtacgccatgaagatcatgaacaagtgggacatgctgaagagaggcgaggtgagctgcttcagagaggagagagacgtgctggtgaacggcgacagaagatggatcacccagctgcacttcgccttccaggacgagaactacctgtacctggtgatggagtactacgtgggcggcgacctgctgaccctgctgagcaagttcggcgagagaatccccgccgagatggccagattctacctggccgagatcgtgatggccatcgacagcgtgcacagactgggctacgtgcacagagacatcaagcccgacaacatcctgctggacagatgcggccacatcagactggccgacttcggcagctgcctgaagctgagagccgacggcaccgtgagaagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggccagagacttcatccagagactgctgtgcccccccgagaccagactgggcagaggcggcgccggcgacttcagaacccaccccttcttcttcggcctggactgggacggcctgagagacagcgtgccccccttcacccccgacttcgagggcgccaccgacacctgcaacttcgacctggtggaggacggcctgaccgccatggtgagcggcggcggcgagaccctgagcgacatcagagagggcgcccccctgggcgtgcacctgcccttcgtgggctacagctacagctgcatggccctgagagacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgagagagctgcaggaggccctggaggaggaggtgctgaccagacagagcctgagcagagagatggaggccatcagaaccgacaaccagaacttcgccagccagctgagagaggccgaggccagaaacagagacctggaggcccacgtgagacagctgcaggagagaatggagctgctgcaggccgagggcgccaccgccgtgaccggcgtgcccagccccagagccaccgacccccccagccacctggacggcccccccgccgtggccgtgggccagtgccccctggtgggccccggccccatgcacagaagacacctgctgctgcccgccagagtgcccagacccggcctgagcgaggccctgagcctgctgctgttcgccgtggtgctgagcagagccgccgccctgggctgcatcggcctggtggcccacgccggccagctgaccgccgtgtggagaagacccggcgccgccagagccccctag

SEQ ID NO: 79981 - DNA, 1920 bp, Artificial Sequence
  Description of Artificial Sequence: Synthetic coding sequence
atgggcggccacttctggccccccgagccctacaccgtgttcatgtggggcagcccctgggaggccgacagccccagagtgaagctgagaggcagagagaagggcagacagaccgagggcggcgccttccccctggtgagcagcgccctgagcggcgaccccagattcttcagccccaccaccccccccgccgagcccatcgtggtgagactgaaggaggtgagactgcagagagacgacttcgagatcctgaaggtgatcggcagaggcgccttcagcgaggtggccgtggtgaagatgaagcagaccggccaggtgtacgccatgaagatcatgaacaagtgggacatgctgaagagaggcgaggtgagctgcttcagagaggagagagacgtgctggtgaacggcgacagaagatggatcacccagctgcacttcgccttccaggacgagaactacctgtacctggtgatggagtactacgtgggcggcgacctgctgaccctgctgagcaagttcggcgagagaatccccgccgagatggccagattctacctggccgagatcgtgatggccatcgacagcgtgcacagactgggctacgtgcacagagacatcaagcccgacaacatcctgctggacagatgcggccacatcagactggccgacttcggcagctgcctgaagctgagagccgacggcaccgtgagaagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggccagagacttcatccagagactgctgtgcccccccgagaccagactgggcagaggcggcgccggcgacttcagaacccaccccttcttcttcggcctggactgggacggcctgagagacagcgtgccccccttcacccccgacttcgagggcgccaccgacacctgcaacttcgacctggtggaggacggcctgaccgccatggtgagcggcggcggcgagaccctgagcgacatcagagagggcgcccccctgggcgtgcacctgcccttcgtgggctacagctacagctgcatggccctgagagacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgagagagctgcaggaggccctggaggaggaggtgctgaccagacagagcctgagcagagagatggaggccatcagaaccgacaaccagaacttcgccagccagctgagagaggccgaggccagaaacagagacctggaggcccacgtgagacagctgcaggagagaatggagctgctgcaggccgagggcgccaccgccgtgaccggcgtgcccagccccagagccaccgacccccccagccacctggacggcccccccgccgtggccgtgggccagtgccccctggtgggccccggccccatgcacagaagacacctgctgctgcccgccagagtgcccagacccggcctgagcgaggccctgagcctgctgctgttcgccgtggtgctgagcagagccgccgccctgggctgcatcggcctggtggcccacgccggccagctgaccgccgtgtggagaagacccggcgccgccagagccccctag

SEQ ID NO: 79982 - DNA, 1830 bp, Artificial Sequence
  Description of Artificial Sequence: Synthetic coding sequence
atgggcggccacttctggccccccgagccctacaccgtgttcatgtggggcagcccctgggaggccgacagccccagagtgaagctgagaggcagagagaagggcagacagaccgagggcggcgccttccccctggtgagcagcgccctgagcggcgaccccagattcttcagccccaccaccccccccgccgagcccatcgtggtgagactgaaggaggtgagactgcagagagacgacttcgagatcctgaaggtgatcggcagaggcgccttcagcgaggtggccgtggtgaagatgaagcagaccggccaggtgtacgccatgaagatcatgaacaagtgggacatgctgaagagaggcgaggtgagctgcttcagagaggagagagacgtgctggtgaacggcgacagaagatggatcacccagctgcacttcgccttccaggacgagaactacctgtacctggtgatggagtactacgtgggcggcgacctgctgaccctgctgagcaagttcggcgagagaatccccgccgagatggccagattctacctggccgagatcgtgatggccatcgacagcgtgcacagactgggctacgtgcacagagacatcaagcccgacaacatcctgctggacagatgcggccacatcagactggccgacttcggcagctgcctgaagctgagagccgacggcaccgtgagaagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggccagagacttcatccagagactgctgtgcccccccgagaccagactgggcagaggcggcgccggcgacttcagaacccaccccttcttcttcggcctggactgggacggcctgagagacagcgtgccccccttcacccccgacttcgagggcgccaccgacacctgcaacttcgacctggtggaggacggcctgaccgccatggtgagcggcggcggcgagaccctgagcgacatcagagagggcgcccccctgggcgtgcacctgcccttcgtgggctacagctacagctgcatggccctgagagacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgagagagctgcaggaggccctggaggaggaggtgctgaccagacagagcctgagcagagagatggaggccatcagaaccgacaaccagaacttcgccagccagctgagagaggccgaggccagaaacagagacctggaggcccacgtgagacagctgcaggagagaatggagctgctgcaggccgagggcgccaccgccgtgaccggcgtgcccagccccagagccaccgacccccccagccacgtgcccagacccggcctgagcgaggccctgagcctgctgctgttcgccgtggtgctgagcagagccgccgccctgggctgcatcggcctggtggcccacgccggccagctgaccgccgtgtggagaagacccggcgccgccagagccccctag

SEQ ID NO: 79983 - DNA, 1593 bp, Artificial Sequence
  Description of Artificial Sequence: Synthetic coding sequence
atgagcgccgaggtgagactgagaagactgcagcagctggtgctggaccccggcttcctgggcctggagcccctgctggacctgctgctgggcgtgcaccaggagctgggcgccagcgagctggcccaggacaagtacgtggccgacttcctgcagtgggccgagcccatcgtggtgagactgaaggaggtgagactgcagagagacgacttcgagatcctgaaggtgatcggcagaggcgccttcagcgaggtggccgtggtgaagatgaagcagaccggccaggtgtacgccatgaagatcatgaacaagtgggacatgctgaagagaggcgaggtgagctgcttcagagaggagagagacgtgctggtgaacggcgacagaagatggatcacccagctgcacttcgccttccaggacgagaactacctgtacctggtgatggagtactacgtgggcggcgacctgctgaccctgctgagcaagttcggcgagagaatccccgccgagatggccagattctacctggccgagatcgtgatggccatcgacagcgtgcacagactgggctacgtgcacagagacatcaagcccgacaacatcctgctggacagatgcggccacatcagactggccgacttcggcagctgcctgaagctgagagccgacggcaccgtgagaagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggccagagacttcatccagagactgctgtgcccccccgagaccagactgggcagaggcggcgccggcgacttcagaacccaccccttcttcttcggcctggactgggacggcctgagagacagcgtgccccccttcacccccgacttcgagggcgccaccgacacctgcaacttcgacctggtggaggacggcctgaccgccatggagaccctgagcgacatcagagagggcgcccccctgggcgtgcacctgcccttcgtgggctacagctacagctgcatggccctgagagacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgagagagctgcaggaggccctggaggaggaggtgctgaccagacagagcctgagcagagagatggaggccatcagaaccgacaaccagaacttcgccagccagctgagagaggccgaggccagaaacagagacctggaggcccacgtgagacagctgcaggagagaatggagctgctgcaggccgagggcgccaccggcccctag

SEQ ID NO: 79984 - DNA, 1866 bp, Artificial Sequence
  Description of Artificial Sequence: Synthetic coding sequence
atgagcgccgaggtgagactgagaagactgcagcagctggtgctggaccccggcttcctgggcctggagcccctgctggacctgctgctgggcgtgcaccaggagctgggcgccagcgagctggcccaggacaagtacgtggccgacttcctgcagtgggccgagcccatcgtggtgagactgaaggaggtgagactgcagagagacgacttcgagatcctgaaggtgatcggcagaggcgccttcagcgaggtggccgtggtgaagatgaagcagaccggccaggtgtacgccatgaagatcatgaacaagtgggacatgctgaagagaggcgaggtgagctgcttcagagaggagagagacgtgctggtgaacggcgacagaagatggatcacccagctgcacttcgccttccaggacgagaactacctgtacctggtgatggagtactacgtgggcggcgacctgctgaccctgctgagcaagttcggcgagagaatccccgccgagatggccagattctacctggccgagatcgtgatggccatcgacagcgtgcacagactgggctacgtgcacagagacatcaagcccgacaacatcctgctggacagatgcggccacatcagactggccgacttcggcagctgcctgaagctgagagccgacggcaccgtgagaagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggccagagacttcatccagagactgctgtgcccccccgagaccagactgggcagaggcggcgccggcgacttcagaacccaccccttcttcttcggcctggactgggacggcctgagagacagcgtgccccccttcacccccgacttcgagggcgccaccgacacctgcaacttcgacctggtggaggacggcctgaccgccatggagaccctgagcgacatcagagagggcgcccccctgggcgtgcacctgcccttcgtgggctacagctacagctgcatggccctgagagacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgagagagctgcaggaggccctggaggaggaggtgctgaccagacagagcctgagcagagagatggaggccatcagaaccgacaaccagaacttcgccagccagctgagagaggccgaggccagaaacagagacctggaggcccacgtgagacagctgcaggagagaatggagctgctgcaggccgagggcgccaccgccgtgaccggcgtgcccagccccagagccaccgacccccccagccacctggacggccccccctggctgtgggccagcgccagatggtggggccagatgcacagaagacacctgctgctgcccgccagagtgcccagacccggcctgagcgaggccctgagcctgctgctgttcgccgtggtgctgagcagagccgccgccctgggctgcatcggcctggtggcccacgccggccagctgaccgccgtgtggagaagacccggcgccgccagagccccctag

SEQ ID NO: 79985 - DNA, 1875 bp, Artificial Sequence
  Description of Artificial Sequence: Synthetic coding sequence
atgagcgccgaggtgagactgagaagactgcagcagctggtgctggaccccggcttcctgggcctggagcccctgctggacctgctgctgggcgtgcaccaggagctgggcgccagcgagctggcccaggacaagtacgtggccgacttcctgcagtgggccgagcccatcgtggtgagactgaaggaggtgagactgcagagagacgacttcgagatcctgaaggtgatcggcagaggcgccttcagcgaggtggccgtggtgaagatgaagcagaccggccaggtgtacgccatgaagatcatgaacaagtgggacatgctgaagagaggcgaggtgagctgcttcagagaggagagagacgtgctggtgaacggcgacagaagatggatcacccagctgcacttcgccttccaggacgagaactacctgtacctggtgatggagtactacgtgggcggcgacctgctgaccctgctgagcaagttcggcgagagaatccccgccgagatggccagattctacctggccgagatcgtgatggccatcgacagcgtgcacagactgggctacgtgcacagagacatcaagcccgacaacatcctgctggacagatgcggccacatcagactggccgacttcggcagctgcctgaagctgagagccgacggcaccgtgagaagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggccagagacttcatccagagactgctgtgcccccccgagaccagactgggcagaggcggcgccggcgacttcagaacccaccccttcttcttcggcctggactgggacggcctgagagacagcgtgccccccttcacccccgacttcgagggcgccaccgacacctgcaacttcgacctggtggaggacggcctgaccgccatggagaccctgagcgacatcagagagggcgcccccctgggcgtgcacctgcccttcgtgggctacagctacagctgcatggccctgagagacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgagagagctgcaggaggccctggaggaggaggtgctgaccagacagagcctgagcagagagatggaggccatcagaaccgacaaccagaacttcgccagccagctgagagaggccgaggccagaaacagagacctggaggcccacgtgagacagctgcaggagagaatggagctgctgcaggccgagggcgccaccgccgtgaccggcgtgcccagccccagagccaccgacccccccagccacctggacggcccccccgccgtggccgtgggccagtgccccctggtgggccccggccccatgcacagaagacacctgctgctgcccgccagagtgcccagacccggcctgagcgaggccctgagcctgctgctgttcgccgtggtgctgagcagagccgccgccctgggctgcatcggcctggtggcccacgccggccagctgaccgccgtgtggagaagacccggcgccgccagagccccctag

SEQ ID NO: 79986 - DNA, 1878 bp, Artificial Sequence
  Description of Artificial Sequence: Synthetic coding sequence
atgagcgccgaggtgagactgagaagactgcagcagctggtgctggaccccggcttcctgggcctggagcccctgctggacctgctgctgggcgtgcaccaggagctgggcgccagcgagctggcccaggacaagtacgtggccgacttcctgcagtgggccgagcccatcgtggtgagactgaaggaggtgagactgcagagagacgacttcgagatcctgaaggtgatcggcagaggcgccttcagcgaggtggccgtggtgaagatgaagcagaccggccaggtgtacgccatgaagatcatgaacaagtgggacatgctgaagagaggcgaggtgagctgcttcagagaggagagagacgtgctggtgaacggcgacagaagatggatcacccagctgcacttcgccttccaggacgagaactacctgtacctggtgatggagtactacgtgggcggcgacctgctgaccctgctgagcaagttcggcgagagaatccccgccgagatggccagattctacctggccgagatcgtgatggccatcgacagcgtgcacagactgggctacgtgcacagagacatcaagcccgacaacatcctgctggacagatgcggccacatcagactggccgacttcggcagctgcctgaagctgagagccgacggcaccgtgagaagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggccagagacttcatccagagactgctgtgcccccccgagaccagactgggcagaggcggcgccggcgacttcagaacccaccccttcttcttcggcctggactgggacggcctgagagacagcgtgccccccttcacccccgacttcgagggcgccaccgacacctgcaacttcgacctggtggaggacggcctgaccgccatggagaccctgagcgacatcagagagggcgcccccctgggcgtgcacctgcccttcgtgggctacagctacagctgcatggccctgagagacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgagagagctgcaggaggccctggaggaggaggtgctgaccagacagagcctgagcagagagatggaggccatcagaaccgacaaccagaacttcgccagccagctgagagaggccgaggccagaaacagagacctggaggcccacgtgagacagctgcaggagagaatggagctgctgcaggccgagggcgccaccgccgtgaccggcgtgcccagccccagagccaccgacccccccagccacatggcccccagaccctggctgtgggccagcgccagatggtggggccaggccccctgcaccgccgccacctgctgcagcctgcccggcagcctgggcctggcctacagaagaagattcccctgcagctgcagccccctgttctgcctggtgccccccccctgggccgccctgggctggtggcccacccccgccaacagcccccagagcggcgccgcccaggagccccccgccctgcccgagccctag

SEQ ID NO: 79987 - DNA, 129 bp, Artificial Sequence
  Description of Artificial Sequence: Synthetic coding sequence
atggagctgctgcaggccgagggcgccaccgccagatggccccccggcagaggctgcggccccgtgcccgccggcggcgccagaccccacgccccccccccccccgccgccccctgccagggcccctag

SEQ ID NO: 79988 - DNA, 3402 bp, Artificial Sequence
  Description of Artificial Sequence: Synthetic coding sequence
atgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagaccaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggccacaacgtgggcagcctgttccacatggccgacgacctgggcagagccatggagagcctggtgagcgtgatgaccgacgaggagggcgccgagtag

SEQ ID NO: 79989 - DNA, 11058 bp, Artificial Sequence
  Description of Artificial Sequence: Synthetic coding sequence
atgctgtggtgggaggaggtggaggactgctacgagagagaggacgtgcagaagaagaccttcaccaagtgggtgaacgcccagttcagcaagttcggcaagcagcacatcgagaacctgttcagcgacctgcaggacggcagaagactgctggacctgctggagggcctgaccggccagaagctgcccaaggagaagggcagcaccagagtgcacgccctgaacaacgtgaacaaggccctgagagtgctgcagaacaacaacgtggacctggtgaacatcggcagcaccgacatcgtggacggcaaccacaagctgaccctgggcctgatctggaacatcatcctgcactggcaggtgaagaacgtgatgaagaacatcatggccggcctgcagcagaccaacagcgagaagatcctgctgagctgggtgagacagagcaccagaaactacccccaggtgaacgtgatcaacttcaccaccagctggagcgacggcctggccctgaacgccctgatccacagccacagacccgacctgttcgactggaacagcgtggtgtgccagcagagcgccacccagagactggagcacgccttcaacatcgccagataccagctgggcatcgagaagctgctggaccccgaggacgtggacaccacctaccccgacaagaagagcatcctgatgtacatcaccagcctgttccaggtgctgccccagcaggtgagcatcgaggccatccaggaggtggagatgctgcccagaccccccaaggtgaccaaggaggagcacttccagctgcaccaccagatgcactacagccagcagatcaccgtgagcctggcccagggctacgagagaaccagcagccccaagcccagattcaagagctacgcctacacccaggccgcctacgtgaccaccagcgaccccaccagaagccccttccccagccagcacctggaggcccccgaggacaagagcttcggcagcagcctgatggagagcgaggtgaacctggacagataccagaccgccctggaggaggtgctgagctggctgctgagcgccgaggacaccctgcaggcccagggcgagatcagcaacgacgtggaggtggtgaaggaccagttccacacccacgagggctacatgatggacctgaccgcccaccagggcagagtgggcaacatcctgcagctgggcagcaagctgatcggcaccggcaagctgagcgaggacgaggagaccgaggtgcaggagcagatgaacctgctgaacagcagatgggagtgcctgagagtggccagcatggagaagcagagcaacctgcacagagtgctgatggacctgcagaaccagaagctgaaggagctgaacgactggctgaccaagaccgaggagagaaccagaaagatggaggaggagcccctgggccccgacctggaggacctgaagagacaggtgcagcagcacaaggtgctgcaggaggacctggagcaggagcaggtgagagtgaacagcctgacccacatggtggtggtggtggacgagagcagcggcgaccacgccaccgccgccctggaggagcagctgaaggtgctgggcgacagatgggccaacatctgcagatggaccgaggacagatgggtgctgctgcaggacatcctgctgaagtggcagagactgaccgaggagcagtgcctgttcagcgcctggctgagcgagaaggaggacgccgtgaacaagatccacaccaccggcttcaaggaccagaacgagatgctgagcagcctgcagaagctggccgtgctgaaggccgacctggagaagaagaagcagagcatgggcaagctgtacagcctgaagcaggacctgctgagcaccctgaagaacaagagcgtgacccagaagaccgaggcctggctggacaacttcgccagatgctgggacaacctggtgcagaagctggagaagagcaccgcccagatcagccaggccgtgaccaccacccagcccagcctgacccagaccaccgtgatggagaccgtgaccaccgtgaccaccagagagcagatcctggtgaagcacgcccaggaggagctgccccccccccccccccagaagaagagacagatcaccgtggacagcgagatcagaaagagactggacgtggacatcaccgagctgcacagctggatcaccagaagcgaggccgtgctgcagagccccgagttcgccatcttcagaaaggagggcaacttcagcgacctgaaggagaaggtgaacgccatcgagagagagaaggccgagaagttcagaaagctgcaggacgccagcagaagcgcccaggccctggtggagcagatggtgaacgagggcgtgaacgccgacagcatcaagcaggccagcgagcagctgaacagcagatggatcgagttctgccagctgctgagcgagagactgaactggctggagtaccagaacaacatcatcgccttctacaaccagctgcagcagctggagcagatgaccaccaccgccgagaactggctgaagatccagcccaccacccccagcgagcccaccgccatcaagagccagctgaagatctgcaaggacgaggtgaacagactgagcgacctgcagccccagatcgagagactgaagatccagagcatcgccctgaaggagaagggccagggccccatgttcctggacgccgacttcgtggccttcaccaaccacttcaagcaggtgttcagcgacgtgcaggccagagagaaggagctgcagaccatcttcgacaccctgccccccatgagataccaggagaccatgagcgccatcagaacctgggtgcagcagagcgagaccaagctgagcatcccccagctgagcgtgaccgactacgagatcatggagcagagactgggcgagctgcaggccctgcagagcagcctgcaggagcagcagagcggcctgtactacctgagcaccaccgtgaaggagatgagcaagaaggcccccagcgagatcagcagaaagtaccagagcgagttcgaggagatcgagggcagatggaagaagctgagcagccagctggtggagcactgccagaagctggaggagcagatgaacaagctgagaaagatccagaaccacatccagaccctgaagaagtggatggccgaggtggacgtgttcctgaaggaggagtggcccgccctgggcgacagcgagatcctgaagaagcagctgaagcagtgcagactgctggtgagcgacatccagaccatccagcccagcctgaacagcgtgaacgagggcggccagaagatcaagaacgaggccgagcccgagttcgccagcagactggagaccgagctgaaggagctgaacacccagtgggaccacatgtgccagcaggtgtacgccagaaaggaggccctgaagggcggcctggagaagaccgtgagcctgcagaaggacctgagcgagatgcacgagtggatgacccaggccgaggaggagtacctggagagagacttcgagtacaagacccccgacgagctgcagaaggccgtggaggagatgaagagagccaaggaggaggcccagcagaaggaggccaaggtgaagctgctgaccgagagcgtgaacagcgtgatcgcccaggccccccccgtggcccaggaggccctgaagaaggagctggagaccctgaccaccaactaccagtggctgtgcaccagactgaacggcaagtgcaagaccctggaggaggtgtgggcctgctggcacgagctgctgagctacctggagaaggccaacaagtggctgaacgaggtggagttcaagctgaagaccaccgagaacatccccggcggcgccgaggagatcagcgaggtgctggacagcctggagaacctgatgagacacagcgaggacaaccccaaccagatcagaatcctggcccagaccctgaccgacggcggcgtgatggacgagctgatcaacgaggagctggagaccttcaacagcagatggagagagctgcacgaggaggccgtgagaagacagaagctgctggagcagagcatccagagcgcccaggagaccgagaagagcctgcacctgatccaggagagcctgaccttcatcgacaagcagctggccgcctacatcgccgacaaggtggacgccgcccagatgccccaggaggcccagaagatccagagcgacctgaccagccacgagatcagcctggaggagatgaagaagcacaaccagggcaaggaggccgcccagagagtgctgagccagatcgacgtggcccagaagaagctgcaggacgtgagcatgaagttcagactgttccagaagcccgccaacttcgagcagagactgcaggagagcaagatgatcctggacgaggtgaagatgcacctgcccgccctggagaccaagagcgtggagcaggaggtggtgcagagccagctgaaccactgcgtgaacctgtacaagagcctgagcgaggtgaagagcgaggtggagatggtgatcaagaccggcagacagatcgtgcagaagaagcagaccgagaaccccaaggagctggacgagagagtgaccgccctgaagctgcactacaacgagctgggcgccaaggtgaccgagagaaagcagcagctggagaagtgcctgaagctgagcagaaagatgagaaaggagatgaacgtgctgaccgagtggctggccgccaccgacatggagctgaccaagagaagcgccgtggagggcatgcccagcaacctggacagcgaggtggcctggggcaaggccacccagaaggagatcgagaagcagaaggtgcacctgaagagcatcaccgaggtgggcgaggccctgaagaccgtgctgggcaagaaggagaccctggtggaggacaagctgagcctgctgaacagcaactggatcgccgtgaccagcagagccgaggagtggctgaacctgctgctggagtaccagaagcacatggagaccttcgaccagaacgtggaccacatcaccaagtggatcatccaggccgacaccctgctggacgagagcgagaagaagaagccccagcagaaggaggacgtgctgaagagactgaaggccgagctgaacgacatcagacccaaggtggacagcaccagagaccaggccgccaacctgatggccaacagaggcgaccactgcagaaagctggtggagccccagatcagcgagctgaaccacagattcgccgccatcagccacagaatcaagaccggcaaggccagcatccccctgaaggagctggagcagttcaacagcgacatccagaagctgctggagcccctggaggccgagatccagcagggcgtgaacctgaaggaggaggacttcaacaaggacatgaacgaggacaacgagggcaccgtgaaggagctgctgcagagaggcgacaacctgcagcagagaatcaccgacgagagaaagagagaggagatcaagatcaagcagcagctgctgcagaccaagcacaacgccctgaaggacctgagaagccagagaagaaagaaggccctggagatcagccaccagtggtaccagtacaagagacaggccgacgacctgctgaagtgcctggacgacatcgagaagaagctggccagcctgcccgagcccagagacgagagaaagatcaaggagatcgacagagagctgcagaagaagaaggaggagctgaacgccgtgagaagacaggccgagggcctgagcgaggacggcgccgccatggccgtggagcccacccagatccagctgagcaagagatggagagagatcgagagcaagttcgcccagttcagaagactgaacttcgcccagatccacaccgtgagagaggagaccatgatggtgatgaccgaggacatgcccctggagatcagctacgtgcccagcacctacctgaccgagatcacccacgtgagccaggccctgctggaggtggagcagctgctgaacgcccccgacctgtgcgccaaggacttcgaggacctgttcaagcaggaggagagcctgaagaacatcaaggacagcctgcagcagagcagcggcagaatcgacatcatccacagcaagaagaccgccgccctgcagagcgccacccccgtggagagagtgaagctgcaggaggccctgagccagctggacttccagtgggagaaggtgaacaagatgtacaaggacagacagggcagattcgacagaagcgtggagaagtggagaagattccactacgacatcaagatcttcaaccagtggctgaccgaggccgagcagttcctgagaaagacccagatccccgagaactgggagcacgccaagtacaagtggtacctgaaggagctgcaggacggcatcggccagagacagaccgtggtgagaaccctgaacgccaccggcgaggagatcatccagcagagcagcaagaccgacgccagcatcctgcaggagaagctgggcagcctgaacctgagatggcaggaggtgtgcaagcagctgagcgacagaaagaagagactggaggagcagaagaacatcctgagcgagttccagagagacctgaacgagttcgtgctgtggctggaggaggccgacaacatcgccagcatccccctggagcccggcaaggagcagcagctgaaggagaagctggagcaggtgaagctgctggtggaggagctgcccctgagacagggcatcctgaagcagctgaacgagaccggcggccccgtgctggtgagcgcccccatcagccccgaggagcaggacaagctggagaacaagctgaagcagaccaacctgcagtggatcaaggtgagcagagccctgcccgagaagcagggcgagatcgaggcccagatcaaggacctgggccagctggagaagaagctggaggacctggaggagcagctgaaccacctgctgctgtggctgagccccatcagaaaccagctggagatctacaaccagcccaaccaggagggccccttcgacgtgaaggagaccgagatcgccgtgcaggccaagcagcccgacgtggaggagatcctgagcaagggccagcacctgtacaaggagaagcccgccacccagcccgtgaagagaaagctggaggacctgagcagcgagtggaaggccgtgaacagactgctgcaggagctgagagccaagcagcccgacctggcccccggcctgaccaccatcggcgccagccccacccagaccgtgaccctggtgacccagcccgtggtgaccaaggagaccgccatcagcaagctggagatgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggcagaaacacccccggcaagcccatgagagaggacaccatgtag

SEQ ID NO: 79990 - DNA, 3693 bp, Artificial Sequence
  Description of Artificial Sequence: Synthetic coding sequence
atgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggccacaacgtgggcagcctgttccacatggccgacgacctgggcagagccatggagagcctggtgagcgtgatgaccgacgaggagggcgccgagtag

SEQ ID NO: 79991 - DNA, 1869 bp, Artificial Sequence
  Description of Artificial Sequence: Synthetic coding sequence
atgagagagcagctgaagggccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggccacaacgtgggcagcctgttccacatggccgacgacctgggcagagccatggagagcctggtgagcgtgatgaccgacgaggagggcgccgagtag

SEQ ID NO: 79992 - DNA, 11046 bp, Artificial Sequence
  Description of Artificial Sequence: Synthetic coding sequence
atgagcgaggtgagcagcgacgagagagaggacgtgcagaagaagaccttcaccaagtgggtgaacgcccagttcagcaagttcggcaagcagcacatcgagaacctgttcagcgacctgcaggacggcagaagactgctggacctgctggagggcctgaccggccagaagctgcccaaggagaagggcagcaccagagtgcacgccctgaacaacgtgaacaaggccctgagagtgctgcagaacaacaacgtggacctggtgaacatcggcagcaccgacatcgtggacggcaaccacaagctgaccctgggcctgatctggaacatcatcctgcactggcaggtgaagaacgtgatgaagaacatcatggccggcctgcagcagaccaacagcgagaagatcctgctgagctgggtgagacagagcaccagaaactacccccaggtgaacgtgatcaacttcaccaccagctggagcgacggcctggccctgaacgccctgatccacagccacagacccgacctgttcgactggaacagcgtggtgtgccagcagagcgccacccagagactggagcacgccttcaacatcgccagataccagctgggcatcgagaagctgctggaccccgaggacgtggacaccacctaccccgacaagaagagcatcctgatgtacatcaccagcctgttccaggtgctgccccagcaggtgagcatcgaggccatccaggaggtggagatgctgcccagaccccccaaggtgaccaaggaggagcacttccagctgcaccaccagatgcactacagccagcagatcaccgtgagcctggcccagggctacgagagaaccagcagccccaagcccagattcaagagctacgcctacacccaggccgcctacgtgaccaccagcgaccccaccagaagccccttccccagccagcacctggaggcccccgaggacaagagcttcggcagcagcctgatggagagcgaggtgaacctggacagataccagaccgccctggaggaggtgctgagctggctgctgagcgccgaggacaccctgcaggcccagggcgagatcagcaacgacgtggaggtggtgaaggaccagttccacacccacgagggctacatgatggacctgaccgcccaccagggcagagtgggcaacatcctgcagctgggcagcaagctgatcggcaccggcaagctgagcgaggacgaggagaccgaggtgcaggagcagatgaacctgctgaacagcagatgggagtgcctgagagtggccagcatggagaagcagagcaacctgcacagagtgctgatggacctgcagaaccagaagctgaaggagctgaacgactggctgaccaagaccgaggagagaaccagaaagatggaggaggagcccctgggccccgacctggaggacctgaagagacaggtgcagcagcacaaggtgctgcaggaggacctggagcaggagcaggtgagagtgaacagcctgacccacatggtggtggtggtggacgagagcagcggcgaccacgccaccgccgccctggaggagcagctgaaggtgctgggcgacagatgggccaacatctgcagatggaccgaggacagatgggtgctgctgcaggacatcctgctgaagtggcagagactgaccgaggagcagtgcctgttcagcgcctggctgagcgagaaggaggacgccgtgaacaagatccacaccaccggcttcaaggaccagaacgagatgctgagcagcctgcagaagctggccgtgctgaaggccgacctggagaagaagaagcagagcatgggcaagctgtacagcctgaagcaggacctgctgagcaccctgaagaacaagagcgtgacccagaagaccgaggcctggctggacaacttcgccagatgctgggacaacctggtgcagaagctggagaagagcaccgcccagatcagccaggccgtgaccaccacccagcccagcctgacccagaccaccgtgatggagaccgtgaccaccgtgaccaccagagagcagatcctggtgaagcacgcccaggaggagctgccccccccccccccccagaagaagagacagatcaccgtggacagcgagatcagaaagagactggacgtggacatcaccgagctgcacagctggatcaccagaagcgaggccgtgctgcagagccccgagttcgccatcttcagaaaggagggcaacttcagcgacctgaaggagaaggtgaacgccatcgagagagagaaggccgagaagttcagaaagctgcaggacgccagcagaagcgcccaggccctggtggagcagatggtgaacgagggcgtgaacgccgacagcatcaagcaggccagcgagcagctgaacagcagatggatcgagttctgccagctgctgagcgagagactgaactggctggagtaccagaacaacatcatcgccttctacaaccagctgcagcagctggagcagatgaccaccaccgccgagaactggctgaagatccagcccaccacccccagcgagcccaccgccatcaagagccagctgaagatctgcaaggacgaggtgaacagactgagcgacctgcagccccagatcgagagactgaagatccagagcatcgccctgaaggagaagggccagggccccatgttcctggacgccgacttcgtggccttcaccaaccacttcaagcaggtgttcagcgacgtgcaggccagagagaaggagctgcagaccatcttcgacaccctgccccccatgagataccaggagaccatgagcgccatcagaacctgggtgcagcagagcgagaccaagctgagcatcccccagctgagcgtgaccgactacgagatcatggagcagagactgggcgagctgcaggccctgcagagcagcctgcaggagcagcagagcggcctgtactacctgagcaccaccgtgaaggagatgagcaagaaggcccccagcgagatcagcagaaagtaccagagcgagttcgaggagatcgagggcagatggaagaagctgagcagccagctggtggagcactgccagaagctggaggagcagatgaacaagctgagaaagatccagaaccacatccagaccctgaagaagtggatggccgaggtggacgtgttcctgaaggaggagtggcccgccctgggcgacagcgagatcctgaagaagcagctgaagcagtgcagactgctggtgagcgacatccagaccatccagcccagcctgaacagcgtgaacgagggcggccagaagatcaagaacgaggccgagcccgagttcgccagcagactggagaccgagctgaaggagctgaacacccagtgggaccacatgtgccagcaggtgtacgccagaaaggaggccctgaagggcggcctggagaagaccgtgagcctgcagaaggacctgagcgagatgcacgagtggatgacccaggccgaggaggagtacctggagagagacttcgagtacaagacccccgacgagctgcagaaggccgtggaggagatgaagagagccaaggaggaggcccagcagaaggaggccaaggtgaagctgctgaccgagagcgtgaacagcgtgatcgcccaggccccccccgtggcccaggaggccctgaagaaggagctggagaccctgaccaccaactaccagtggctgtgcaccagactgaacggcaagtgcaagaccctggaggaggtgtgggcctgctggcacgagctgctgagctacctggagaaggccaacaagtggctgaacgaggtggagttcaagctgaagaccaccgagaacatccccggcggcgccgaggagatcagcgaggtgctggacagcctggagaacctgatgagacacagcgaggacaaccccaaccagatcagaatcctggcccagaccctgaccgacggcggcgtgatggacgagctgatcaacgaggagctggagaccttcaacagcagatggagagagctgcacgaggaggccgtgagaagacagaagctgctggagcagagcatccagagcgcccaggagaccgagaagagcctgcacctgatccaggagagcctgaccttcatcgacaagcagctggccgcctacatcgccgacaaggtggacgccgcccagatgccccaggaggcccagaagatccagagcgacctgaccagccacgagatcagcctggaggagatgaagaagcacaaccagggcaaggaggccgcccagagagtgctgagccagatcgacgtggcccagaagaagctgcaggacgtgagcatgaagttcagactgttccagaagcccgccaacttcgagcagagactgcaggagagcaagatgatcctggacgaggtgaagatgcacctgcccgccctggagaccaagagcgtggagcaggaggtggtgcagagccagctgaaccactgcgtgaacctgtacaagagcctgagcgaggtgaagagcgaggtggagatggtgatcaagaccggcagacagatcgtgcagaagaagcagaccgagaaccccaaggagctggacgagagagtgaccgccctgaagctgcactacaacgagctgggcgccaaggtgaccgagagaaagcagcagctggagaagtgcctgaagctgagcagaaagatgagaaaggagatgaacgtgctgaccgagtggctggccgccaccgacatggagctgaccaagagaagcgccgtggagggcatgcccagcaacctggacagcgaggtggcctggggcaaggccacccagaaggagatcgagaagcagaaggtgcacctgaagagcatcaccgaggtgggcgaggccctgaagaccgtgctgggcaagaaggagaccctggtggaggacaagctgagcctgctgaacagcaactggatcgccgtgaccagcagagccgaggagtggctgaacctgctgctggagtaccagaagcacatggagaccttcgaccagaacgtggaccacatcaccaagtggatcatccaggccgacaccctgctggacgagagcgagaagaagaagccccagcagaaggaggacgtgctgaagagactgaaggccgagctgaacgacatcagacccaaggtggacagcaccagagaccaggccgccaacctgatggccaacagaggcgaccactgcagaaagctggtggagccccagatcagcgagctgaaccacagattcgccgccatcagccacagaatcaagaccggcaaggccagcatccccctgaaggagctggagcagttcaacagcgacatccagaagctgctggagcccctggaggccgagatccagcagggcgtgaacctgaaggaggaggacttcaacaaggacatgaacgaggacaacgagggcaccgtgaaggagctgctgcagagaggcgacaacctgcagcagagaatcaccgacgagagaaagagagaggagatcaagatcaagcagcagctgctgcagaccaagcacaacgccctgaaggacctgagaagccagagaagaaagaaggccctggagatcagccaccagtggtaccagtacaagagacaggccgacgacctgctgaagtgcctggacgacatcgagaagaagctggccagcctgcccgagcccagagacgagagaaagatcaaggagatcgacagagagctgcagaagaagaaggaggagctgaacgccgtgagaagacaggccgagggcctgagcgaggacggcgccgccatggccgtggagcccacccagatccagctgagcaagagatggagagagatcgagagcaagttcgcccagttcagaagactgaacttcgcccagatccacaccgtgagagaggagaccatgatggtgatgaccgaggacatgcccctggagatcagctacgtgcccagcacctacctgaccgagatcacccacgtgagccaggccctgctggaggtggagcagctgctgaacgcccccgacctgtgcgccaaggacttcgaggacctgttcaagcaggaggagagcctgaagaacatcaaggacagcctgcagcagagcagcggcagaatcgacatcatccacagcaagaagaccgccgccctgcagagcgccacccccgtggagagagtgaagctgcaggaggccctgagccagctggacttccagtgggagaaggtgaacaagatgtacaaggacagacagggcagattcgacagaagcgtggagaagtggagaagattccactacgacatcaagatcttcaaccagtggctgaccgaggccgagcagttcctgagaaagacccagatccccgagaactgggagcacgccaagtacaagtggtacctgaaggagctgcaggacggcatcggccagagacagaccgtggtgagaaccctgaacgccaccggcgaggagatcatccagcagagcagcaagaccgacgccagcatcctgcaggagaagctgggcagcctgaacctgagatggcaggaggtgtgcaagcagctgagcgacagaaagaagagactggaggagcagaagaacatcctgagcgagttccagagagacctgaacgagttcgtgctgtggctggaggaggccgacaacatcgccagcatccccctggagcccggcaaggagcagcagctgaaggagaagctggagcaggtgaagctgctggtggaggagctgcccctgagacagggcatcctgaagcagctgaacgagaccggcggccccgtgctggtgagcgcccccatcagccccgaggagcaggacaagctggagaacaagctgaagcagaccaacctgcagtggatcaaggtgagcagagccctgcccgagaagcagggcgagatcgaggcccagatcaaggacctgggccagctggagaagaagctggaggacctggaggagcagctgaaccacctgctgctgtggctgagccccatcagaaaccagctggagatctacaaccagcccaaccaggagggccccttcgacgtgaaggagaccgagatcgccgtgcaggccaagcagcccgacgtggaggagatcctgagcaagggccagcacctgtacaaggagaagcccgccacccagcccgtgaagagaaagctggaggacctgagcagcgagtggaaggccgtgaacagactgctgcaggagctgagagccaagcagcccgacctggcccccggcctgaccaccatcggcgccagccccacccagaccgtgaccctggtgacccagcccgtggtgaccaaggagaccgccatcagcaagctggagatgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggcagaaacacccccggcaagcccatgagagaggacaccatgtag

SEQ ID NO: 79993 - DNA, 7035 bp, Artificial Sequence
  Description of Artificial Sequence: Synthetic coding sequence
atgaccgagatgatcctgctgatcttcttccccgcctacttcctgaacgccgtgagaagacagaagctgctggagcagagcatccagagcgcccaggagaccgagaagagcctgcacctgatccaggagagcctgaccttcatcgacaagcagctggccgcctacatcgccgacaaggtggacgccgcccagatgccccaggaggcccagaagatccagagcgacctgaccagccacgagatcagcctggaggagatgaagaagcacaaccagggcaaggaggccgcccagagagtgctgagccagatcgacgtggcccagaagaagctgcaggacgtgagcatgaagttcagactgttccagaagcccgccaacttcgagcagagactgcaggagagcaagatgatcctggacgaggtgaagatgcacctgcccgccctggagaccaagagcgtggagcaggaggtggtgcagagccagctgaaccactgcgtgaacctgtacaagagcctgagcgaggtgaagagcgaggtggagatggtgatcaagaccggcagacagatcgtgcagaagaagcagaccgagaaccccaaggagctggacgagagagtgaccgccctgaagctgcactacaacgagctgggcgccaaggtgaccgagagaaagcagcagctggagaagtgcctgaagctgagcagaaagatgagaaaggagatgaacgtgctgaccgagtggctggccgccaccgacatggagctgaccaagagaagcgccgtggagggcatgcccagcaacctggacagcgaggtggcctggggcaaggccacccagaaggagatcgagaagcagaaggtgcacctgaagagcatcaccgaggtgggcgaggccctgaagaccgtgctgggcaagaaggagaccctggtggaggacaagctgagcctgctgaacagcaactggatcgccgtgaccagcagagccgaggagtggctgaacctgctgctggagtaccagaagcacatggagaccttcgaccagaacgtggaccacatcaccaagtggatcatccaggccgacaccctgctggacgagagcgagaagaagaagccccagcagaaggaggacgtgctgaagagactgaaggccgagctgaacgacatcagacccaaggtggacagcaccagagaccaggccgccaacctgatggccaacagaggcgaccactgcagaaagctggtggagccccagatcagcgagctgaaccacagattcgccgccatcagccacagaatcaagaccggcaaggccagcatccccctgaaggagctggagcagttcaacagcgacatccagaagctgctggagcccctggaggccgagatccagcagggcgtgaacctgaaggaggaggacttcaacaaggacatgaacgaggacaacgagggcaccgtgaaggagctgctgcagagaggcgacaacctgcagcagagaatcaccgacgagagaaagagagaggagatcaagatcaagcagcagctgctgcagaccaagcacaacgccctgaaggacctgagaagccagagaagaaagaaggccctggagatcagccaccagtggtaccagtacaagagacaggccgacgacctgctgaagtgcctggacgacatcgagaagaagctggccagcctgcccgagcccagagacgagagaaagatcaaggagatcgacagagagctgcagaagaagaaggaggagctgaacgccgtgagaagacaggccgagggcctgagcgaggacggcgccgccatggccgtggagcccacccagatccagctgagcaagagatggagagagatcgagagcaagttcgcccagttcagaagactgaacttcgcccagatccacaccgtgagagaggagaccatgatggtgatgaccgaggacatgcccctggagatcagctacgtgcccagcacctacctgaccgagatcacccacgtgagccaggccctgctggaggtggagcagctgctgaacgcccccgacctgtgcgccaaggacttcgaggacctgttcaagcaggaggagagcctgaagaacatcaaggacagcctgcagcagagcagcggcagaatcgacatcatccacagcaagaagaccgccgccctgcagagcgccacccccgtggagagagtgaagctgcaggaggccctgagccagctggacttccagtgggagaaggtgaacaagatgtacaaggacagacagggcagattcgacagaagcgtggagaagtggagaagattccactacgacatcaagatcttcaaccagtggctgaccgaggccgagcagttcctgagaaagacccagatccccgagaactgggagcacgccaagtacaagtggtacctgaaggagctgcaggacggcatcggccagagacagaccgtggtgagaaccctgaacgccaccggcgaggagatcatccagcagagcagcaagaccgacgccagcatcctgcaggagaagctgggcagcctgaacctgagatggcaggaggtgtgcaagcagctgagcgacagaaagaagagactggaggagcagaagaacatcctgagcgagttccagagagacctgaacgagttcgtgctgtggctggaggaggccgacaacatcgccagcatccccctggagcccggcaaggagcagcagctgaaggagaagctggagcaggtgaagctgctggtggaggagctgcccctgagacagggcatcctgaagcagctgaacgagaccggcggccccgtgctggtgagcgcccccatcagccccgaggagcaggacaagctggagaacaagctgaagcagaccaacctgcagtggatcaaggtgagcagagccctgcccgagaagcagggcgagatcgaggcccagatcaaggacctgggccagctggagaagaagctggaggacctggaggagcagctgaaccacctgctgctgtggctgagccccatcagaaaccagctggagatctacaaccagcccaaccaggagggccccttcgacgtgaaggagaccgagatcgccgtgcaggccaagcagcccgacgtggaggagatcctgagcaagggccagcacctgtacaaggagaagcccgccacccagcccgtgaagagaaagctggaggacctgagcagcgagtggaaggccgtgaacagactgctgcaggagctgagagccaagcagcccgacctggcccccggcctgaccaccatcggcgccagccccacccagaccgtgaccctggtgacccagcccgtggtgaccaaggagaccgccatcagcaagctggagatgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggcagaaacacccccggcaagcccatgagagaggacaccccctag

SEQ ID NO: 79994 - DNA, 7026 bp, Artificial Sequence
  Description of Artificial Sequence: Synthetic coding sequence
atgagcgccagaaagctgagaaacctgagctacaagaaggccgtgagaagacagaagctgctggagcagagcatccagagcgcccaggagaccgagaagagcctgcacctgatccaggagagcctgaccttcatcgacaagcagctggccgcctacatcgccgacaaggtggacgccgcccagatgccccaggaggcccagaagatccagagcgacctgaccagccacgagatcagcctggaggagatgaagaagcacaaccagggcaaggaggccgcccagagagtgctgagccagatcgacgtggcccagaagaagctgcaggacgtgagcatgaagttcagactgttccagaagcccgccaacttcgagcagagactgcaggagagcaagatgatcctggacgaggtgaagatgcacctgcccgccctggagaccaagagcgtggagcaggaggtggtgcagagccagctgaaccactgcgtgaacctgtacaagagcctgagcgaggtgaagagcgaggtggagatggtgatcaagaccggcagacagatcgtgcagaagaagcagaccgagaaccccaaggagctggacgagagagtgaccgccctgaagctgcactacaacgagctgggcgccaaggtgaccgagagaaagcagcagctggagaagtgcctgaagctgagcagaaagatgagaaaggagatgaacgtgctgaccgagtggctggccgccaccgacatggagctgaccaagagaagcgccgtggagggcatgcccagcaacctggacagcgaggtggcctggggcaaggccacccagaaggagatcgagaagcagaaggtgcacctgaagagcatcaccgaggtgggcgaggccctgaagaccgtgctgggcaagaaggagaccctggtggaggacaagctgagcctgctgaacagcaactggatcgccgtgaccagcagagccgaggagtggctgaacctgctgctggagtaccagaagcacatggagaccttcgaccagaacgtggaccacatcaccaagtggatcatccaggccgacaccctgctggacgagagcgagaagaagaagccccagcagaaggaggacgtgctgaagagactgaaggccgagctgaacgacatcagacccaaggtggacagcaccagagaccaggccgccaacctgatggccaacagaggcgaccactgcagaaagctggtggagccccagatcagcgagctgaaccacagattcgccgccatcagccacagaatcaagaccggcaaggccagcatccccctgaaggagctggagcagttcaacagcgacatccagaagctgctggagcccctggaggccgagatccagcagggcgtgaacctgaaggaggaggacttcaacaaggacatgaacgaggacaacgagggcaccgtgaaggagctgctgcagagaggcgacaacctgcagcagagaatcaccgacgagagaaagagagaggagatcaagatcaagcagcagctgctgcagaccaagcacaacgccctgaaggacctgagaagccagagaagaaagaaggccctggagatcagccaccagtggtaccagtacaagagacaggccgacgacctgctgaagtgcctggacgacatcgagaagaagctggccagcctgcccgagcccagagacgagagaaagatcaaggagatcgacagagagctgcagaagaagaaggaggagctgaacgccgtgagaagacaggccgagggcctgagcgaggacggcgccgccatggccgtggagcccacccagatccagctgagcaagagatggagagagatcgagagcaagttcgcccagttcagaagactgaacttcgcccagatccacaccgtgagagaggagaccatgatggtgatgaccgaggacatgcccctggagatcagctacgtgcccagcacctacctgaccgagatcacccacgtgagccaggccctgctggaggtggagcagctgctgaacgcccccgacctgtgcgccaaggacttcgaggacctgttcaagcaggaggagagcctgaagaacatcaaggacagcctgcagcagagcagcggcagaatcgacatcatccacagcaagaagaccgccgccctgcagagcgccacccccgtggagagagtgaagctgcaggaggccctgagccagctggacttccagtgggagaaggtgaacaagatgtacaaggacagacagggcagattcgacagaagcgtggagaagtggagaagattccactacgacatcaagatcttcaaccagtggctgaccgaggccgagcagttcctgagaaagacccagatccccgagaactgggagcacgccaagtacaagtggtacctgaaggagctgcaggacggcatcggccagagacagaccgtggtgagaaccctgaacgccaccggcgaggagatcatccagcagagcagcaagaccgacgccagcatcctgcaggagaagctgggcagcctgaacctgagatggcaggaggtgtgcaagcagctgagcgacagaaagaagagactggaggagcagaagaacatcctgagcgagttccagagagacctgaacgagttcgtgctgtggctggaggaggccgacaacatcgccagcatccccctggagcccggcaaggagcagcagctgaaggagaagctggagcaggtgaagctgctggtggaggagctgcccctgagacagggcatcctgaagcagctgaacgagaccggcggccccgtgctggtgagcgcccccatcagccccgaggagcaggacaagctggagaacaagctgaagcagaccaacctgcagtggatcaaggtgagcagagccctgcccgagaagcagggcgagatcgaggcccagatcaaggacctgggccagctggagaagaagctggaggacctggaggagcagctgaaccacctgctgctgtggctgagccccatcagaaaccagctggagatctacaaccagcccaaccaggagggccccttcgacgtgaaggagaccgagatcgccgtgcaggccaagcagcccgacgtggaggagatcctgagcaagggccagcacctgtacaaggagaagcccgccacccagcccgtgaagagaaagctggaggacctgagcagcgagtggaaggccgtgaacagactgctgcaggagctgagagccaagcagcccgacctggcccccggcctgaccaccatcggcgccagccccacccagaccgtgaccctggtgacccagcccgtggtgaccaaggagaccgccatcagcaagctggagatgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggcagaaacacccccggcaagcccatgagagaggacaccccctag

SEQ ID NO: 79995 - DNA, 1854 bp, Artificial Sequence
  Description of Artificial Sequence: Synthetic coding sequence
atgagagagcagctgaagggccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggcagaaacacccccggcaagcccatgagagaggacaccatgtag

SEQ ID NO: 79996 - DNA, 3678 bp, Artificial Sequence
  Description of Artificial Sequence: Synthetic coding sequence
atgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggcagaaacacccccggcaagcccatgagagaggacaccatgtag

SEQ ID NO: 79997 - DNA, 1908 bp, Artificial Sequence
  Description of Artificial Sequence: Synthetic coding sequence
atgagagagcagctgaagggccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggccacaacgtgggcagcctgttccacatggccgacgacctgggcagagccatggagagcctggtgagcgtgatgaccgacgaggagggcgccgagtag

SEQ ID NO: 79998 - DNA, 3732 bp, Artificial Sequence
  Description of Artificial Sequence: Synthetic coding sequence
atgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggccacaacgtgggcagcctgttccacatggccgacgacctgggcagagccatggagagcctggtgagcgtgatgaccgacgaggagggcgccgagtag

SEQ ID NO: 79999 - DNA, 11034 bp, Artificial Sequence
  Description of Artificial Sequence: Synthetic coding sequence
atcctggacgagagagaggacgtgcagaagaagaccttcaccaagtgggtgaacgcccagttcagcaagttcggcaagcagcacatcgagaacctgttcagcgacctgcaggacggcagaagactgctggacctgctggagggcctgaccggccagaagctgcccaaggagaagggcagcaccagagtgcacgccctgaacaacgtgaacaaggccctgagagtgctgcagaacaacaacgtggacctggtgaacatcggcagcaccgacatcgtggacggcaaccacaagctgaccctgggcctgatctggaacatcatcctgcactggcaggtgaagaacgtgatgaagaacatcatggccggcctgcagcagaccaacagcgagaagatcctgctgagctgggtgagacagagcaccagaaactacccccaggtgaacgtgatcaacttcaccaccagctggagcgacggcctggccctgaacgccctgatccacagccacagacccgacctgttcgactggaacagcgtggtgtgccagcagagcgccacccagagactggagcacgccttcaacatcgccagataccagctgggcatcgagaagctgctggaccccgaggacgtggacaccacctaccccgacaagaagagcatcctgatgtacatcaccagcctgttccaggtgctgccccagcaggtgagcatcgaggccatccaggaggtggagatgctgcccagaccccccaaggtgaccaaggaggagcacttccagctgcaccaccagatgcactacagccagcagatcaccgtgagcctggcccagggctacgagagaaccagcagccccaagcccagattcaagagctacgcctacacccaggccgcctacgtgaccaccagcgaccccaccagaagccccttccccagccagcacctggaggcccccgaggacaagagcttcggcagcagcctgatggagagcgaggtgaacctggacagataccagaccgccctggaggaggtgctgagctggctgctgagcgccgaggacaccctgcaggcccagggcgagatcagcaacgacgtggaggtggtgaaggaccagttccacacccacgagggctacatgatggacctgaccgcccaccagggcagagtgggcaacatcctgcagctgggcagcaagctgatcggcaccggcaagctgagcgaggacgaggagaccgaggtgcaggagcagatgaacctgctgaacagcagatgggagtgcctgagagtggccagcatggagaagcagagcaacctgcacagagtgctgatggacctgcagaaccagaagctgaaggagctgaacgactggctgaccaagaccgaggagagaaccagaaagatggaggaggagcccctgggccccgacctggaggacctgaagagacaggtgcagcagcacaaggtgctgcaggaggacctggagcaggagcaggtgagagtgaacagcctgacccacatggtggtggtggtggacgagagcagcggcgaccacgccaccgccgccctggaggagcagctgaaggtgctgggcgacagatgggccaacatctgcagatggaccgaggacagatgggtgctgctgcaggacatcctgctgaagtggcagagactgaccgaggagcagtgcctgttcagcgcctggctgagcgagaaggaggacgccgtgaacaagatccacaccaccggcttcaaggaccagaacgagatgctgagcagcctgcagaagctggccgtgctgaaggccgacctggagaagaagaagcagagcatgggcaagctgtacagcctgaagcaggacctgctgagcaccctgaagaacaagagcgtgacccagaagaccgaggcctggctggacaacttcgccagatgctgggacaacctggtgcagaagctggagaagagcaccgcccagatcagccaggccgtgaccaccacccagcccagcctgacccagaccaccgtgatggagaccgtgaccaccgtgaccaccagagagcagatcctggtgaagcacgcccaggaggagctgccccccccccccccccagaagaagagacagatcaccgtggacagcgagatcagaaagagactggacgtggacatcaccgagctgcacagctggatcaccagaagcgaggccgtgctgcagagccccgagttcgccatcttcagaaaggagggcaacttcagcgacctgaaggagaaggtgaacgccatcgagagagagaaggccgagaagttcagaaagctgcaggacgccagcagaagcgcccaggccctggtggagcagatggtgaacgagggcgtgaacgccgacagcatcaagcaggccagcgagcagctgaacagcagatggatcgagttctgccagctgctgagcgagagactgaactggctggagtaccagaacaacatcatcgccttctacaaccagctgcagcagctggagcagatgaccaccaccgccgagaactggctgaagatccagcccaccacccccagcgagcccaccgccatcaagagccagctgaagatctgcaaggacgaggtgaacagactgagcgacctgcagccccagatcgagagactgaagatccagagcatcgccctgaaggagaagggccagggccccatgttcctggacgccgacttcgtggccttcaccaaccacttcaagcaggtgttcagcgacgtgcaggccagagagaaggagctgcagaccatcttcgacaccctgccccccatgagataccaggagaccatgagcgccatcagaacctgggtgcagcagagcgagaccaagctgagcatcccccagctgagcgtgaccgactacgagatcatggagcagagactgggcgagctgcaggccctgcagagcagcctgcaggagcagcagagcggcctgtactacctgagcaccaccgtgaaggagatgagcaagaaggcccccagcgagatcagcagaaagtaccagagcgagttcgaggagatcgagggcagatggaagaagctgagcagccagctggtggagcactgccagaagctggaggagcagatgaacaagctgagaaagatccagaaccacatccagaccctgaagaagtggatggccgaggtggacgtgttcctgaaggaggagtggcccgccctgggcgacagcgagatcctgaagaagcagctgaagcagtgcagactgctggtgagcgacatccagaccatccagcccagcctgaacagcgtgaacgagggcggccagaagatcaagaacgaggccgagcccgagttcgccagcagactggagaccgagctgaaggagctgaacacccagtgggaccacatgtgccagcaggtgtacgccagaaaggaggccctgaagggcggcctggagaagaccgtgagcctgcagaaggacctgagcgagatgcacgagtggatgacccaggccgaggaggagtacctggagagagacttcgagtacaagacccccgacgagctgcagaaggccgtggaggagatgaagagagccaaggaggaggcccagcagaaggaggccaaggtgaagctgctgaccgagagcgtgaacagcgtgatcgcccaggccccccccgtggcccaggaggccctgaagaaggagctggagaccctgaccaccaactaccagtggctgtgcaccagactgaacggcaagtgcaagaccctggaggaggtgtgggcctgctggcacgagctgctgagctacctggagaaggccaacaagtggctgaacgaggtggagttcaagctgaagaccaccgagaacatccccggcggcgccgaggagatcagcgaggtgctggacagcctggagaacctgatgagacacagcgaggacaaccccaaccagatcagaatcctggcccagaccctgaccgacggcggcgtgatggacgagctgatcaacgaggagctggagaccttcaacagcagatggagagagctgcacgaggaggccgtgagaagacagaagctgctggagcagagcatccagagcgcccaggagaccgagaagagcctgcacctgatccaggagagcctgaccttcatcgacaagcagctggccgcctacatcgccgacaaggtggacgccgcccagatgccccaggaggcccagaagatccagagcgacctgaccagccacgagatcagcctggaggagatgaagaagcacaaccagggcaaggaggccgcccagagagtgctgagccagatcgacgtggcccagaagaagctgcaggacgtgagcatgaagttcagactgttccagaagcccgccaacttcgagcagagactgcaggagagcaagatgatcctggacgaggtgaagatgcacctgcccgccctggagaccaagagcgtggagcaggaggtggtgcagagccagctgaaccactgcgtgaacctgtacaagagcctgagcgaggtgaagagcgaggtggagatggtgatcaagaccggcagacagatcgtgcagaagaagcagaccgagaaccccaaggagctggacgagagagtgaccgccctgaagctgcactacaacgagctgggcgccaaggtgaccgagagaaagcagcagctggagaagtgcctgaagctgagcagaaagatgagaaaggagatgaacgtgctgaccgagtggctggccgccaccgacatggagctgaccaagagaagcgccgtggagggcatgcccagcaacctggacagcgaggtggcctggggcaaggccacccagaaggagatcgagaagcagaaggtgcacctgaagagcatcaccgaggtgggcgaggccctgaagaccgtgctgggcaagaaggagaccctggtggaggacaagctgagcctgctgaacagcaactggatcgccgtgaccagcagagccgaggagtggctgaacctgctgctggagtaccagaagcacatggagaccttcgaccagaacgtggaccacatcaccaagtggatcatccaggccgacaccctgctggacgagagcgagaagaagaagccccagcagaaggaggacgtgctgaagagactgaaggccgagctgaacgacatcagacccaaggtggacagcaccagagaccaggccgccaacctgatggccaacagaggcgaccactgcagaaagctggtggagccccagatcagcgagctgaaccacagattcgccgccatcagccacagaatcaagaccggcaaggccagcatccccctgaaggagctggagcagttcaacagcgacatccagaagctgctggagcccctggaggccgagatccagcagggcgtgaacctgaaggaggaggacttcaacaaggacatgaacgaggacaacgagggcaccgtgaaggagctgctgcagagaggcgacaacctgcagcagagaatcaccgacgagagaaagagagaggagatcaagatcaagcagcagctgctgcagaccaagcacaacgccctgaaggacctgagaagccagagaagaaagaaggccctggagatcagccaccagtggtaccagtacaagagacaggccgacgacctgctgaagtgcctggacgacatcgagaagaagctggccagcctgcccgagcccagagacgagagaaagatcaaggagatcgacagagagctgcagaagaagaaggaggagctgaacgccgtgagaagacaggccgagggcctgagcgaggacggcgccgccatggccgtggagcccacccagatccagctgagcaagagatggagagagatcgagagcaagttcgcccagttcagaagactgaacttcgcccagatccacaccgtgagagaggagaccatgatggtgatgaccgaggacatgcccctggagatcagctacgtgcccagcacctacctgaccgagatcacccacgtgagccaggccctgctggaggtggagcagctgctgaacgcccccgacctgtgcgccaaggacttcgaggacctgttcaagcaggaggagagcctgaagaacatcaaggacagcctgcagcagagcagcggcagaatcgacatcatccacagcaagaagaccgccgccctgcagagcgccacccccgtggagagagtgaagctgcaggaggccctgagccagctggacttccagtgggagaaggtgaacaagatgtacaaggacagacagggcagattcgacagaagcgtggagaagtggagaagattccactacgacatcaagatcttcaaccagtggctgaccgaggccgagcagttcctgagaaagacccagatccccgagaactgggagcacgccaagtacaagtggtacctgaaggagctgcaggacggcatcggccagagacagaccgtggtgagaaccctgaacgccaccggcgaggagatcatccagcagagcagcaagaccgacgccagcatcctgcaggagaagctgggcagcctgaacctgagatggcaggaggtgtgcaagcagctgagcgacagaaagaagagactggaggagcagaagaacatcctgagcgagttccagagagacctgaacgagttcgtgctgtggctggaggaggccgacaacatcgccagcatccccctggagcccggcaaggagcagcagctgaaggagaagctggagcaggtgaagctgctggtggaggagctgcccctgagacagggcatcctgaagcagctgaacgagaccggcggccccgtgctggtgagcgcccccatcagccccgaggagcaggacaagctggagaacaagctgaagcagaccaacctgcagtggatcaaggtgagcagagccctgcccgagaagcagggcgagatcgaggcccagatcaaggacctgggccagctggagaagaagctggaggacctggaggagcagctgaaccacctgctgctgtggctgagccccatcagaaaccagctggagatctacaaccagcccaaccaggagggccccttcgacgtgaaggagaccgagatcgccgtgcaggccaagcagcccgacgtggaggagatcctgagcaagggccagcacctgtacaaggagaagcccgccacccagcccgtgaagagaaagctggaggacctgagcagcgagtggaaggccgtgaacagactgctgcaggagctgagagccaagcagcccgacctggcccccggcctgaccaccatcggcgccagccccacccagaccgtgaccctggtgacccagcccgtggtgaccaaggagaccgccatcagcaagctggagatgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggcagaaacacccccggcaagcccatgagagaggacaccccctag

SEQ ID NO: 80000 - DNA, 10689 bp, Artificial Sequence
  Description of Artificial Sequence: Synthetic coding sequence
atgaagaacatcatggccggcctgcagcagaccaacagcgagaagatcctgctgagctgggtgagacagagcaccagaaactacccccaggtgaacgtgatcaacttcaccaccagctggagcgacggcctggccctgaacgccctgatccacagccacagacccgacctgttcgactggaacagcgtggtgtgccagcagagcgccacccagagactggagcacgccttcaacatcgccagataccagctgggcatcgagaagctgctggaccccgaggacgtggacaccacctaccccgacaagaagagcatcctgatgtacatcaccagcctgttccaggtgctgccccagcaggtgagcatcgaggccatccaggaggtggagatgctgcccagaccccccaaggtgaccaaggaggagcacttccagctgcaccaccagatgcactacagccagcagatcaccgtgagcctggcccagggctacgagagaaccagcagccccaagcccagattcaagagctacgcctacacccaggccgcctacgtgaccaccagcgaccccaccagaagccccttccccagccagcacctggaggcccccgaggacaagagcttcggcagcagcctgatggagagcgaggtgaacctggacagataccagaccgccctggaggaggtgctgagctggctgctgagcgccgaggacaccctgcaggcccagggcgagatcagcaacgacgtggaggtggtgaaggaccagttccacacccacgagggctacatgatggacctgaccgcccaccagggcagagtgggcaacatcctgcagctgggcagcaagctgatcggcaccggcaagctgagcgaggacgaggagaccgaggtgcaggagcagatgaacctgctgaacagcagatgggagtgcctgagagtggccagcatggagaagcagagcaacctgcacagagtgctgatggacctgcagaaccagaagctgaaggagctgaacgactggctgaccaagaccgaggagagaaccagaaagatggaggaggagcccctgggccccgacctggaggacctgaagagacaggtgcagcagcacaaggtgctgcaggaggacctggagcaggagcaggtgagagtgaacagcctgacccacatggtggtggtggtggacgagagcagcggcgaccacgccaccgccgccctggaggagcagctgaaggtgctgggcgacagatgggccaacatctgcagatggaccgaggacagatgggtgctgctgcaggacatcctgctgaagtggcagagactgaccgaggagcagtgcctgttcagcgcctggctgagcgagaaggaggacgccgtgaacaagatccacaccaccggcttcaaggaccagaacgagatgctgagcagcctgcagaagctggccgtgctgaaggccgacctggagaagaagaagcagagcatgggcaagctgtacagcctgaagcaggacctgctgagcaccctgaagaacaagagcgtgacccagaagaccgaggcctggctggacaacttcgccagatgctgggacaacctggtgcagaagctggagaagagcaccgcccagatcagccaggccgtgaccaccacccagcccagcctgacccagaccaccgtgatggagaccgtgaccaccgtgaccaccagagagcagatcctggtgaagcacgcccaggaggagctgccccccccccccccccagaagaagagacagatcaccgtggacagcgagatcagaaagagactggacgtggacatcaccgagctgcacagctggatcaccagaagcgaggccgtgctgcagagccccgagttcgccatcttcagaaaggagggcaacttcagcgacctgaaggagaaggtgaacgccatcgagagagagaaggccgagaagttcagaaagctgcaggacgccagcagaagcgcccaggccctggtggagcagatggtgaacgagggcgtgaacgccgacagcatcaagcaggccagcgagcagctgaacagcagatggatcgagttctgccagctgctgagcgagagactgaactggctggagtaccagaacaacatcatcgccttctacaaccagctgcagcagctggagcagatgaccaccaccgccgagaactggctgaagatccagcccaccacccccagcgagcccaccgccatcaagagccagctgaagatctgcaaggacgaggtgaacagactgagcgacctgcagccccagatcgagagactgaagatccagagcatcgccctgaaggagaagggccagggccccatgttcctggacgccgacttcgtggccttcaccaaccacttcaagcaggtgttcagcgacgtgcaggccagagagaaggagctgcagaccatcttcgacaccctgccccccatgagataccaggagaccatgagcgccatcagaacctgggtgcagcagagcgagaccaagctgagcatcccccagctgagcgtgaccgactacgagatcatggagcagagactgggcgagctgcaggccctgcagagcagcctgcaggagcagcagagcggcctgtactacctgagcaccaccgtgaaggagatgagcaagaaggcccccagcgagatcagcagaaagtaccagagcgagttcgaggagatcgagggcagatggaagaagctgagcagccagctggtggagcactgccagaagctggaggagcagatgaacaagctgagaaagatccagaaccacatccagaccctgaagaagtggatggccgaggtggacgtgttcctgaaggaggagtggcccgccctgggcgacagcgagatcctgaagaagcagctgaagcagtgcagactgctggtgagcgacatccagaccatccagcccagcctgaacagcgtgaacgagggcggccagaagatcaagaacgaggccgagcccgagttcgccagcagactggagaccgagctgaaggagctgaacacccagtgggaccacatgtgccagcaggtgtacgccagaaaggaggccctgaagggcggcctggagaagaccgtgagcctgcagaaggacctgagcgagatgcacgagtggatgacccaggccgaggaggagtacctggagagagacttcgagtacaagacccccgacgagctgcagaaggccgtggaggagatgaagagagccaaggaggaggcccagcagaaggaggccaaggtgaagctgctgaccgagagcgtgaacagcgtgatcgcccaggccccccccgtggcccaggaggccctgaagaaggagctggagaccctgaccaccaactaccagtggctgtgcaccagactgaacggcaagtgcaagaccctggaggaggtgtgggcctgctggcacgagctgctgagctacctggagaaggccaacaagtggctgaacgaggtggagttcaagctgaagaccaccgagaacatccccggcggcgccgaggagatcagcgaggtgctggacagcctggagaacctgatgagacacagcgaggacaaccccaaccagatcagaatcctggcccagaccctgaccgacggcggcgtgatggacgagctgatcaacgaggagctggagaccttcaacagcagatggagagagctgcacgaggaggccgtgagaagacagaagctgctggagcagagcatccagagcgcccaggagaccgagaagagcctgcacctgatccaggagagcctgaccttcatcgacaagcagctggccgcctacatcgccgacaaggtggacgccgcccagatgccccaggaggcccagaagatccagagcgacctgaccagccacgagatcagcctggaggagatgaagaagcacaaccagggcaaggaggccgcccagagagtgctgagccagatcgacgtggcccagaagaagctgcaggacgtgagcatgaagttcagactgttccagaagcccgccaacttcgagcagagactgcaggagagcaagatgatcctggacgaggtgaagatgcacctgcccgccctggagaccaagagcgtggagcaggaggtggtgcagagccagctgaaccactgcgtgaacctgtacaagagcctgagcgaggtgaagagcgaggtggagatggtgatcaagaccggcagacagatcgtgcagaagaagcagaccgagaaccccaaggagctggacgagagagtgaccgccctgaagctgcactacaacgagctgggcgccaaggtgaccgagagaaagcagcagctggagaagtgcctgaagctgagcagaaagatgagaaaggagatgaacgtgctgaccgagtggctggccgccaccgacatggagctgaccaagagaagcgccgtggagggcatgcccagcaacctggacagcgaggtggcctggggcaaggccacccagaaggagatcgagaagcagaaggtgcacctgaagagcatcaccgaggtgggcgaggccctgaagaccgtgctgggcaagaaggagaccctggtggaggacaagctgagcctgctgaacagcaactggatcgccgtgaccagcagagccgaggagtggctgaacctgctgctggagtaccagaagcacatggagaccttcgaccagaacgtggaccacatcaccaagtggatcatccaggccgacaccctgctggacgagagcgagaagaagaagccccagcagaaggaggacgtgctgaagagactgaaggccgagctgaacgacatcagacccaaggtggacagcaccagagaccaggccgccaacctgatggccaacagaggcgaccactgcagaaagctggtggagccccagatcagcgagctgaaccacagattcgccgccatcagccacagaatcaagaccggcaaggccagcatccccctgaaggagctggagcagttcaacagcgacatccagaagctgctggagcccctggaggccgagatccagcagggcgtgaacctgaaggaggaggacttcaacaaggacatgaacgaggacaacgagggcaccgtgaaggagctgctgcagagaggcgacaacctgcagcagagaatcaccgacgagagaaagagagaggagatcaagatcaagcagcagctgctgcagaccaagcacaacgccctgaaggacctgagaagccagagaagaaagaaggccctggagatcagccaccagtggtaccagtacaagagacaggccgacgacctgctgaagtgcctggacgacatcgagaagaagctggccagcctgcccgagcccagagacgagagaaagatcaaggagatcgacagagagctgcagaagaagaaggaggagctgaacgccgtgagaagacaggccgagggcctgagcgaggacggcgccgccatggccgtggagcccacccagatccagctgagcaagagatggagagagatcgagagcaagttcgcccagttcagaagactgaacttcgcccagatccacaccgtgagagaggagaccatgatggtgatgaccgaggacatgcccctggagatcagctacgtgcccagcacctacctgaccgagatcacccacgtgagccaggccctgctggaggtggagcagctgctgaacgcccccgacctgtgcgccaaggacttcgaggacctgttcaagcaggaggagagcctgaagaacatcaaggacagcctgcagcagagcagcggcagaatcgacatcatccacagcaagaagaccgccgccctgcagagcgccacccccgtggagagagtgaagctgcaggaggccctgagccagctggacttccagtgggagaaggtgaacaagatgtacaaggacagacagggcagattcgacagaagcgtggagaagtggagaagattccactacgacatcaagatcttcaaccagtggctgaccgaggccgagcagttcctgagaaagacccagatccccgagaactgggagcacgccaagtacaagtggtacctgatcgccctgaaggacggcatcggccagagacagaccgtggtgagaaccctgaacgccaccggcgaggagatcatccagcagagcagcaagaccgacgccagcatcctgcaggagaagctgggcagcctgaacctgagatggcaggaggtgtgcaagcagctgagcgacagaaagaagagactggaggagcagaagaacatcctgagcgagttccagagagacctgaacgagttcgtgctgtggctggaggaggccgacaacatcgccagcatccccctggagcccggcaaggagcagcagctgaaggagaagctggagcaggtgaagctgctggtggaggagctgcccctgagacagggcatcctgaagcagctgaacgagaccggcggccccgtgctggtgagcgcccccatcagccccgaggagcaggacaagctggagaacaagctgaagcagaccaacctgcagtggatcaaggtgagcagagccctgcccgagaagcagggcgagatcgaggcccagatcaaggacctgggccagctggagaagaagctggaggacctggaggagcagctgaaccacctgctgctgtggctgagccccatcagaaaccagctggagatctacaaccagcccaaccaggagggccccttcgacgtgaaggagaccgagatcgccgtgcaggccaagcagcccgacgtggaggagatcctgagcaagggccagcacctgtacaaggagaagcccgccacccagcccgtgaagagaaagctggaggacctgagcagcgagtggaaggccgtgaacagactgctgcaggagctgagagccaagcagcccgacctggcccccggcctgaccaccatcggcgccagccccacccagaccgtgaccctggtgacccagcccgtggtgaccaaggagaccgccatcagcaagctggagatgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggcagaaacacccccggcaagcccatgagagaggacaccatgtag

SEQ ID NO: 80001 - DNA, 3348 bp, Artificial Sequence
  Description of Artificial Sequence: Synthetic coding sequence
atgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagaccaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggcagaaacacccccggcaagcccatgagagaggacaccatgtag

SEQ ID NO: 80002 - DNA, 11058 bp, Artificial Sequence
  Description of Artificial Sequence: Synthetic coding sequence
atgctgtggtgggaggaggtggaggactgctacgagagagaggacgtgcagaagaagaccttcaccaagtgggtgaacgcccagttcagcaagttcggcaagcagcacatcgagaacctgttcagcgacctgcaggacggcagaagactgctggacctgctggagggcctgaccggccagaagctgcccaaggagaagggcagcaccagagtgcacgccctgaacaacgtgaacaaggccctgagagtgctgcagaacaacaacgtggacctggtgaacatcggcagcaccgacatcgtggacggcaaccacaagctgaccctgggcctgatctggaacatcatcctgcactggcaggtgaagaacgtgatgaagaacatcatggccggcctgcagcagaccaacagcgagaagatcctgctgagctgggtgagacagagcaccagaaactacccccaggtgaacgtgatcaacttcaccaccagctggagcgacggcctggccctgaacgccctgatccacagccacagacccgacctgttcgactggaacagcgtggtgtgccagcagagcgccacccagagactggagcacgccttcaacatcgccagataccagctgggcatcgagaagctgctggaccccgaggacgtggacaccacctaccccgacaagaagagcatcctgatgtacatcaccagcctgttccaggtgctgccccagcaggtgagcatcgaggccatccaggaggtggagatgctgcccagaccccccaaggtgaccaaggaggagcacttccagctgcaccaccagatgcactacagccagcagatcaccgtgagcctggcccagggctacgagagaaccagcagccccaagcccagattcaagagctacgcctacacccaggccgcctacgtgaccaccagcgaccccaccagaagccccttccccagccagcacctggaggcccccgaggacaagagcttcggcagcagcctgatggagagcgaggtgaacctggacagataccagaccgccctggaggaggtgctgagctggctgctgagcgccgaggacaccctgcaggcccagggcgagatcagcaacgacgtggaggtggtgaaggaccagttccacacccacgagggctacatgatggacctgaccgcccaccagggcagagtgggcaacatcctgcagctgggcagcaagctgatcggcaccggcaagctgagcgaggacgaggagaccgaggtgcaggagcagatgaacctgctgaacagcagatgggagtgcctgagagtggccagcatggagaagcagagcaacctgcacagagtgctgatggacctgcagaaccagaagctgaaggagctgaacgactggctgaccaagaccgaggagagaaccagaaagatggaggaggagcccctgggccccgacctggaggacctgaagagacaggtgcagcagcacaaggtgctgcaggaggacctggagcaggagcaggtgagagtgaacagcctgacccacatggtggtggtggtggacgagagcagcggcgaccacgccaccgccgccctggaggagcagctgaaggtgctgggcgacagatgggccaacatctgcagatggaccgaggacagatgggtgctgctgcaggacatcctgctgaagtggcagagactgaccgaggagcagtgcctgttcagcgcctggctgagcgagaaggaggacgccgtgaacaagatccacaccaccggcttcaaggaccagaacgagatgctgagcagcctgcagaagctggccgtgctgaaggccgacctggagaagaagaagcagagcatgggcaagctgtacagcctgaagcaggacctgctgagcaccctgaagaacaagagcgtgacccagaagaccgaggcctggctggacaacttcgccagatgctgggacaacctggtgcagaagctggagaagagcaccgcccagatcagccaggccgtgaccaccacccagcccagcctgacccagaccaccgtgatggagaccgtgaccaccgtgaccaccagagagcagatcctggtgaagcacgcccaggaggagctgccccccccccccccccagaagaagagacagatcaccgtggacagcgagatcagaaagagactggacgtggacatcaccgagctgcacagctggatcaccagaagcgaggccgtgctgcagagccccgagttcgccatcttcagaaaggagggcaacttcagcgacctgaaggagaaggtgaacgccatcgagagagagaaggccgagaagttcagaaagctgcaggacgccagcagaagcgcccaggccctggtggagcagatggtgaacgagggcgtgaacgccgacagcatcaagcaggccagcgagcagctgaacagcagatggatcgagttctgccagctgctgagcgagagactgaactggctggagtaccagaacaacatcatcgccttctacaaccagctgcagcagctggagcagatgaccaccaccgccgagaactggctgaagatccagcccaccacccccagcgagcccaccgccatcaagagccagctgaagatctgcaaggacgaggtgaacagactgagcgacctgcagccccagatcgagagactgaagatccagagcatcgccctgaaggagaagggccagggccccatgttcctggacgccgacttcgtggccttcaccaaccacttcaagcaggtgttcagcgacgtgcaggccagagagaaggagctgcagaccatcttcgacaccctgccccccatgagataccaggagaccatgagcgccatcagaacctgggtgcagcagagcgagaccaagctgagcatcccccagctgagcgtgaccgactacgagatcatggagcagagactgggcgagctgcaggccctgcagagcagcctgcaggagcagcagagcggcctgtactacctgagcaccaccgtgaaggagatgagcaagaaggcccccagcgagatcagcagaaagtaccagagcgagttcgaggagatcgagggcagatggaagaagctgagcagccagctggtggagcactgccagaagctggaggagcagatgaacaagctgagaaagatccagaaccacatccagaccctgaagaagtggatggccgaggtggacgtgttcctgaaggaggagtggcccgccctgggcgacagcgagatcctgaagaagcagctgaagcagtgcagactgctggtgagcgacatccagaccatccagcccagcctgaacagcgtgaacgagggcggccagaagatcaagaacgaggccgagcccgagttcgccagcagactggagaccgagctgaaggagctgaacacccagtgggaccacatgtgccagcaggtgtacgccagaaaggaggccctgaagggcggcctggagaagaccgtgagcctgcagaaggacctgagcgagatgcacgagtggatgacccaggccgaggaggagtacctggagagagacttcgagtacaagacccccgacgagctgcagaaggccgtggaggagatgaagagagccaaggaggaggcccagcagaaggaggccaaggtgaagctgctgaccgagagcgtgaacagcgtgatcgcccaggccccccccgtggcccaggaggccctgaagaaggagctggagaccctgaccaccaactaccagtggctgtgcaccagactgaacggcaagtgcaagaccctggaggaggtgtgggcctgctggcacgagctgctgagctacctggagaaggccaacaagtggctgaacgaggtggagttcaagctgaagaccaccgagaacatccccggcggcgccgaggagatcagcgaggtgctggacagcctggagaacctgatgagacacagcgaggacaaccccaaccagatcagaatcctggcccagaccctgaccgacggcggcgtgatggacgagctgatcaacgaggagctggagaccttcaacagcagatggagagagctgcacgaggaggccgtgagaagacagaagctgctggagcagagcatccagagcgcccaggagaccgagaagagcctgcacctgatccaggagagcctgaccttcatcgacaagcagctggccgcctacatcgccgacaaggtggacgccgcccagatgccccaggaggcccagaagatccagagcgacctgaccagccacgagatcagcctggaggagatgaagaagcacaaccagggcaaggaggccgcccagagagtgctgagccagatcgacgtggcccagaagaagctgcaggacgtgagcatgaagttcagactgttccagaagcccgccaacttcgagcagagactgcaggagagcaagatgatcctggacgaggtgaagatgcacctgcccgccctggagaccaagagcgtggagcaggaggtggtgcagagccagctgaaccactgcgtgaacctgtacaagagcctgagcgaggtgaagagcgaggtggagatggtgatcaagaccggcagacagatcgtgcagaagaagcagaccgagaaccccaaggagctggacgagagagtgaccgccctgaagctgcactacaacgagctgggcgccaaggtgaccgagagaaagcagcagctggagaagtgcctgaagctgagcagaaagatgagaaaggagatgaacgtgctgaccgagtggctggccgccaccgacatggagctgaccaagagaagcgccgtggagggcatgcccagcaacctggacagcgaggtggcctggggcaaggccacccagaaggagatcgagaagcagaaggtgcacctgaagagcatcaccgaggtgggcgaggccctgaagaccgtgctgggcaagaaggagaccctggtggaggacaagctgagcctgctgaacagcaactggatcgccgtgaccagcagagccgaggagtggctgaacctgctgctggagtaccagaagcacatggagaccttcgaccagaacgtggaccacatcaccaagtggatcatccaggccgacaccctgctggacgagagcgagaagaagaagccccagcagaaggaggacgtgctgaagagactgaaggccgagctgaacgacatcagacccaaggtggacagcaccagagaccaggccgccaacctgatggccaacagaggcgaccactgcagaaagctggtggagccccagatcagcgagctgaaccacagattcgccgccatcagccacagaatcaagaccggcaaggccagcatccccctgaaggagctggagcagttcaacagcgacatccagaagctgctggagcccctggaggccgagatccagcagggcgtgaacctgaaggaggaggacttcaacaaggacatgaacgaggacaacgagggcaccgtgaaggagctgctgcagagaggcgacaacctgcagcagagaatcaccgacgagagaaagagagaggagatcaagatcaagcagcagctgctgcagaccaagcacaacgccctgaaggacctgagaagccagagaagaaagaaggccctggagatcagccaccagtggtaccagtacaagagacaggccgacgacctgctgaagtgcctggacgacatcgagaagaagctggccagcctgcccgagcccagagacgagagaaagatcaaggagatcgacagagagctgcagaagaagaaggaggagctgaacgccgtgagaagacaggccgagggcctgagcgaggacggcgccgccatggccgtggagcccacccagatccagctgagcaagagatggagagagatcgagagcaagttcgcccagttcagaagactgaacttcgcccagatccacaccgtgagagaggagaccatgatggtgatgaccgaggacatgcccctggagatcagctacgtgcccagcacctacctgaccgagatcacccacgtgagccaggccctgctggaggtggagcagctgctgaacgcccccgacctgtgcgccaaggacttcgaggacctgttcaagcaggaggagagcctgaagaacatcaaggacagcctgcagcagagcagcggcagaatcgacatcatccacagcaagaagaccgccgccctgcagagcgccacccccgtggagagagtgaagctgcaggaggccctgagccagctggacttccagtgggagaaggtgaacaagatgtacaaggacagacagggcagattcgacagaagcgtggagaagtggagaagattccactacgacatcaagatcttcaaccagtggctgaccgaggccgagcagttcctgagaaagacccagatccccgagaactgggagcacgccaagtacaagtggtacctgatcgccctgaaggacggcatcggccagagacagaccgtggtgagaaccctgaacgccaccggcgaggagatcatccagcagagcagcaagaccgacgccagcatcctgcaggagaagctgggcagcctgaacctgagatggcaggaggtgtgcaagcagctgagcgacagaaagaagagactggaggagcagaagaacatcctgagcgagttccagagagacctgaacgagttcgtgctgtggctggaggaggccgacaacatcgccagcatccccctggagcccggcaaggagcagcagctgaaggagaagctggagcaggtgaagctgctggtggaggagctgcccctgagacagggcatcctgaagcagctgaacgagaccggcggccccgtgctggtgagcgcccccatcagccccgaggagcaggacaagctggagaacaagctgaagcagaccaacctgcagtggatcaaggtgagcagagccctgcccgagaagcagggcgagatcgaggcccagatcaaggacctgggccagctggagaagaagctggaggacctggaggagcagctgaaccacctgctgctgtggctgagccccatcagaaaccagctggagatctacaaccagcccaaccaggagggccccttcgacgtgaaggagaccgagatcgccgtgcaggccaagcagcccgacgtggaggagatcctgagcaagggccagcacctgtacaaggagaagcccgccacccagcccgtgaagagaaagctggaggacctgagcagcgagtggaaggccgtgaacagactgctgcaggagctgagagccaagcagcccgacctggcccccggcctgaccaccatcggcgccagccccacccagaccgtgaccctggtgacccagcccgtggtgaccaaggagaccgccatcagcaagctggagatgcccagcagcctgatgctggaggtgcccgccctggccgacttcaacagagcctggaccgagctgaccgactggctgagcctgctggaccaggtgatcaagagccagagagtgatggtgggcgacctggaggacatcaacgagatgatcatcaagcagaaggccaccatgcaggacctggagcagagaagaccccagctggaggagctgatcaccgccgcccagaacctgaagaacaagaccagcaaccaggaggccagaaccatcatcaccgacagaatcgagagaatccagaaccagtgggacgaggtgcaggagcacctgcagaacagaagacagcagctgaacgagatgctgaaggacagcacccagtggctggaggccaaggaggaggccgagcaggtgctgggccaggccagagccaagctggagagctggaaggagggcccctacaccgtggacgccatccagaagaagatcaccgagaccaagcagctggccaaggacctgagacagtggcagaccaacgtggacgtggccaacgacctggccctgaagctgctgagagactacagcgccgacgacaccagaaaggtgcacatgatcaccgagaacatcaacgccagctggagaagcatccacaagagagtgagcgagagagaggccgccctggaggagacccacagactgctgcagcagttccccctggacctggagaagttcctggcctggctgaccgaggccgagaccaccgccaacgtgctgcaggacgccaccagaaaggagagactgctggaggacagcaagggcgtgaaggagctgatgaagcagtggcaggacctgcagggcgagatcgaggcccacaccgacgtgtaccacaacctggacgagaacagccagaagatcctgagaagcctggagggcagcgacgacgccgtgctgctgcagagaagactggacaacatgaacttcaagtggagcgagctgagaaagaagagcctgaacatcagaagccacctggaggccagcagcgaccagtggaagagactgcacctgagcctgcaggagctgctggtgtggctgcagctgaaggacgacgagctgagcagacaggcccccatcggcggcgacttccccgccgtgcagaagcagaacgacgtgcacagagccttcaagagagagctgaagaccaaggagcccgtgatcatgagcaccctggagaccgtgagaatcttcctgaccgagcagcccctggagggcctggagaagctgtaccaggagcccagagagctgccccccgaggagagagcccagaacgtgaccagactgctgagaaagcaggccgaggaggtgaacaccgagtgggagaagctgaacctgcacagcgccgactggcagagaaagatcgacgagaccctggagagactgagagagctgcaggaggccaccgacgagctggacctgaagctgagacaggccgaggtgatcaagggcagctggcagcccgtgggcgacctgctgatcgacagcctgcaggaccacctggagaaggtgaaggccctgagaggcgagatcgcccccctgaaggagaacgtgagccacgtgaacgacctggccagacagctgaccaccctgggcatccagctgagcccctacaacctgagcaccctggaggacctgaacaccagatggaagctgctgcaggtggccgtggaggacagagtgagacagctgcacgaggcccacagagacttcggccccgccagccagcacttcctgagcaccagcgtgcagggcccctgggagagagccatcagccccaacaaggtgccctactacatcaaccacgagacccagaccacctgctgggaccaccccaagatgaccgagctgtaccagagcctggccgacctgaacaacgtgagattcagcgcctacagaaccgccatgaagctgagaagactgcagaaggccctgtgcctggacctgctgagcctgagcgccgcctgcgacgccctggaccagcacaacctgaagcagaacgaccagcccatggacatcctgcagatcatcaactgcctgaccaccatctacgacagactggagcaggagcacaacaacctggtgaacgtgcccctgtgcgtggacatgtgcctgaactggctgctgaacgtgtacgacaccggcagaaccggcagaatcagagtgctgagcttcaagaccggcatcatcagcctgtgcaaggcccacctggaggacaagtacagatacctgttcaagcaggtggccagcagcaccggcttctgcgaccagagaagactgggcctgctgctgcacgacagcatccagatccccagacagctgggcgaggtggccagcttcggcggcagcaacatcgagcccagcgtgagaagctgcttccagttcgccaacaacaagcccgagatcgaggccgccctgttcctggactggatgagactggagccccagagcatggtgtggctgcccgtgctgcacagagtggccgccgccgagaccgccaagcaccaggccaagtgcaacatctgcaaggagtgccccatcatcggcttcagatacagaagcctgaagcacttcaactacgacatctgccagagctgcttcttcagcggcagagtggccaagggccacaagatgcactaccccatggtggagtactgcacccccaccaccagcggcgaggacgtgagagacttcgccaaggtgctgaagaacaagttcagaaccaagagatacttcgccaagcaccccagaatgggctacctgcccgtgcagaccgtgctggagggcgacaacatggagacccccgtgaccctgatcaacttctggcccgtggacagcgcccccgccagcagcccccagctgagccacgacgacacccacagcagaatcgagcactacgccagcagactggccgagatggagaacagcaacggcagctacctgaacgacagcatcagccccaacgagagcatcgacgacgagcacctgctgatccagcactactgccagagcctgaaccaggacagccccctgagccagcccagaagccccgcccagatcctgatcagcctggagagcgaggagagaggcgagctggagagaatcctggccgacctggaggaggagaacagaaacctgcaggccgagtacgacagactgaagcagcagcacgagcacaagggcctgagccccctgcccagcccccccgagatgatgcccaccagcccccagagccccagagacgccgagctgatcgccgaggccaagctgctgagacagcacaagggcagactggaggccagaatgcagatcctggaggaccacaacaagcagctggagagccagctgcacagactgagacagctgctggagcagccccaggccgaggccaaggtgaacggcaccaccgtgagcagccccagcaccagcctgcagagaagcgacagcagccagcccatgctgctgagagtggtgggcagccagaccagcgacagcatgggcgaggaggacctgctgagccccccccaggacaccagcaccggcctggaggaggtgatggagcagctgaacaacagcttccccagcagcagaggcagaaacacccccggcaagcccatgagagaggacaccatgtag

SEQ ID NO: 80003 - DNA, 2874 bp, Artificial Sequence
  Description of Artificial Sequence: Synthetic coding sequence
atgcagcccatggtgatgcagggctgcccctacaccctgcccagatgccacgactggcaggccgccgaccagttccaccacagcagcagcctgagaagcacctgcccccacccccaggtgagagccgccgtgaccagccccgcccccccccaggacggcgccggcgtgccctgcctgagcctgaagctgctgaacggcagcgtgggcgccagcggccccctggagccccccgccatgaacctgtgctggaacgagatcaagaagaagagccacaacctgagagccagactggaggccttcagcgaccacagcggcaagctgcagctgcccctgcaggagatcatcgactggctgagccagaaggacgaggagctgagcgcccagctgcccctgcagggcgacgtggccctggtgcagcaggagaaggagacccacgccgccttcatggaggaggtgaagagcagaggcccctacatctacagcgtgctggagagcgcccaggccttcctgagccagcaccccttcgaggagctggaggagccccacagcgagagcaaggacaccagccccaagcagagaatccagaacctgagcagattcgtgtggaagcaggccaccgtggccagcgagctgtgggagaagctgaccgccagatgcgtggaccagcacagacacatcgagagaaccctggagcagctgctggagatccagggcgccatggaggagctgagcaccaccctgagccaggccgagggcgtgagagccacctgggagcccatcggcgacctgttcatcgacagcctgcccgagcacatccaggccatcaagctgttcaaggaggagttcagccccatgaaggacggcgtgaagctggtgaacgacctggcccaccagctggccatcagcgacgtgcacctgagcatggagaacagccaggccctggagcagatcaacgtgagatggaagcagctgcaggccagcgtgagcgagagactgaagcagctgcaggacgcccacagagacttcggccccggcagccagcacttcctgagcagcagcgtgcaggtgccctgggagagagccatcagccccaacaaggtgccctactacatcaaccaccaggcccagaccacctgctgggaccaccccaagatgaccgagctgtaccagaccctggccgacctgaacaacatcaagttcagcgcctacagaaccgccatgaagctgagaagagtgcagaaggccctgagactggacctggtgaccctgaccaccgccctggagatcttcaacgagcacgacctgcaggccagcgagcacgtgatggacgtggtggaggtgatccactgcctgaccgccctgtacgagagactggaggaggagagaggcatcctggtgaacgtgcccctgtgcgtggacatgagcctgaactggctgctgaacgtgttcgacagcggcagaagcggcaagatgagagccctgagcttcaagaccggcatcgcctgcctgtgcggcaccgaggtgaaggagaagctgcagtacctgttcagccaggtggccaacagcggcagccagtgcgaccagagacacctgggcgtgctgctgcacgaggccatccaggtgcccagacagctgggcgaggtggccgccttcggcggcagcaacgtggagcccagcgtgagaagctgcttcagattcagcaccggcaagcccgtgatcgaggccagccagttcctggagtgggtgaacctggagccccagagcatggtgtggctggccgtgctgcacagagtgaccatcgccgagcaggtgaagcaccagaccaagtgcagcatctgcagacagtgccccatcaagggcttcagatacagaagcctgaagcagttcaacgtggacatctgccagacctgcttcctgaccggcagagccagcaagggcaacaagctgcactaccccatcatggagtactacacccccaccaccagcagcgagaacatgagagacttcgccaccaccctgaagaacaagttcagaagcaagcactacttcagcaagcacccccagagaggctacctgcccgtgcagagcgtgctggaggccgactacagcgagacccccgccagcagccccatgtggccccacgccgacacccacagcagaatcgagcacttcgccagcagactggccgagatggagagccagaactgcagcttcttcaacgacagcctgagccccgacgacagcatcgacgaggaccagtacctgctgagacacagcagccccatcaccgacagagagcccgccttcggccagcaggccccctgcagcgtggccaccgagagcaagggcgagctgcagaagatcctggcccacctggaggacgagaacagaatcctgcagggcgagctgagaagactgaagtggcagcacgaggaggccgccgaggcccccagcctggccgacggcagcaccgaggccgccaccgaccacagaaacgaggagctgctggccgaggccagaatcctgagacagcacaagagcagactggagaccagaatgcagatcctggaggaccacaacaagcagctggagagccagctgcagagactgagagagctgctgctgcagccccccaccgagagcgacggcagcggcagcgccggcagcagcctggccagcagcccccagcagagcgagggcagccaccccagagagaagggccagaccacccccgacaccgaggccgccgacgacgtgggcagcaagagccaggacgtgagcctgtgcctggaggacatcatggagaagctgagacacgccttccccagcgtgagaagcagcgacgtgaccgccaacaccctgctggccagctag

SEQ ID NO: 80004 - DNA, 2874 bp, Artificial Sequence; identical to SEQ ID NO: 80003
  Description of Artificial Sequence: Synthetic coding sequence

SEQ ID NO: 80005 - DNA, 2874 bp, Artificial Sequence; identical to SEQ ID NO: 80003
  Description of Artificial Sequence: Synthetic coding sequence

SEQ ID NO: 80006 - DNA, 2640 bp, Artificial Sequence
  Description of Artificial Sequence: Synthetic coding sequence
atgaacctgtgctggaacgagatcaagaagaagagccacaacctgagagccagactggaggccttcagcgaccacagcggcaagctgcagctgcccctgcaggagatcatcgactggctgagccagaaggacgaggagctgagcgcccagctgcccctgcagggcgacgtggccctggtgcagcaggagaaggagacccacgccgccttcatggaggaggtgaagagcagaggcccctacatctacagcgtgctggagagcgcccaggccttcctgagccagcaccccttcgaggagctggaggagccccacagcgagagcaaggacaccagccccaagcagagaatccagaacctgagcagattcgtgtggaagcaggccaccgtggccagcgagctgtgggagaagctgaccgccagatgcgtggaccagcacagacacatcgagagaaccctggagcagctgctggagatccagggcgccatggaggagctgagcaccaccctgagccaggccgagggcgtgagagccacctgggagcccatcggcgacctgttcatcgacagcctgcccgagcacatccaggccatcaagctgttcaaggaggagttcagccccatgaaggacggcgtgaagctggtgaacgacctggcccaccagctggccatcagcgacgtgcacctgagcatggagaacagccaggccctggagcagatcaacgtgagatggaagcagctgcaggccagcgtgagcgagagactgaagcagctgcaggacgcccacagagacttcggccccggcagccagcacttcctgagcagcagcgtgcaggtgccctgggagagagccatcagccccaacaaggtgccctactacatcaaccaccaggcccagaccacctgctgggaccaccccaagatgaccgagctgtaccagaccctggccgacctgaacaacatcaagttcagcgcctacagaaccgccatgaagctgagaagagtgcagaaggccctgagactggacctggtgaccctgaccaccgccctggagatcttcaacgagcacgacctgcaggccagcgagcacgtgatggacgtggtggaggtgatccactgcctgaccgccctgtacgagagactggaggaggagagaggcatcctggtgaacgtgcccctgtgcgtggacatgagcctgaactggctgctgaacgtgttcgacagcggcagaagcggcaagatgagagccctgagcttcaagaccggcatcgcctgcctgtgcggcaccgaggtgaaggagaagctgcagtacctgttcagccaggtggccaacagcggcagccagtgcgaccagagacacctgggcgtgctgctgcacgaggccatccaggtgcccagacagctgggcgaggtggccgccttcggcggcagcaacgtggagcccagcgtgagaagctgcttcagattcagcaccggcaagcccgtgatcgaggccagccagttcctggagtgggtgaacctggagccccagagcatggtgtggctggccgtgctgcacagagtgaccatcgccgagcaggtgaagcaccagaccaagtgcagcatctgcagacagtgccccatcaagggcttcagatacagaagcctgaagcagttcaacgtggacatctgccagacctgcttcctgaccggcagagccagcaagggcaacaagctgcactaccccatcatggagtactacacccccaccaccagcagcgagaacatgagagacttcgccaccaccctgaagaacaagttcagaagcaagcactacttcagcaagcacccccagagaggctacctgcccgtgcagagcgtgctggaggccgactacagcgagacccccgccagcagccccatgtggccccacgccgacacccacagcagaatcgagcacttcgccagcagactggccgagatggagagccagaactgcagcttcttcaacgacagcctgagccccgacgacagcatcgacgaggaccagtacctgctgagacacagcagccccatcaccgacagagagcccgccttcggccagcaggccccctgcagcgtggccaccgagagcaagggcgagctgcagaagatcctggcccacctggaggacgagaacagaatcctgcagggcgagctgagaagactgaagtggcagcacgaggaggccgccgaggcccccagcctggccgacggcagcaccgaggccgccaccgaccacagaaacgaggagctgctggccgaggccagaatcctgagacagcacaagagcagactggagaccagaatgcagatcctggaggaccacaacaagcagctggagagccagctgcagagactgagagagctgctgctgcagccccccaccgagagcgacggcagcggcagcgccggcagcagcctggccagcagcccccagcagagcgagggcagccaccccagagagaagggccagaccacccccgacaccgaggccgccgacgacgtgggcagcaagagccaggacgtgagcctgtgcctggaggacatcatggagaagctgagacacgccttccccagcgtgagaagcagcgacgtgaccgccaacaccctgctggccagctag

SEQ ID NO: 80007 - DNA, 9129 bp, Artificial Sequence
  Description of Artificial Sequence: Synthetic coding sequence
atgcaccacggcaccggcccccagaacgtgcagcaccagctgcagagaagcagagcctgccccggcagcgagggcgaggagcagcccgcccaccccaaccccccccccagccccgccgcccccttcgcccccagcgccagccccagcgccccccagagccccagctaccagatccagcagctgatgaacagaagccccgccaccggccagaacgtgaacatcaccctgcagagcgtgggccccgtggtgggcggcaaccagcagatcaccctggcccccctgcccctgcccagccccaccagccccggcttccagttcagcgcccagcccagaagattcgagcacggcagccccagctacatccaggtgaccagccccctgagccagcaggtgcagacccagagccccacccagcccagccccggccccggccaggccctgcagaacgtgagagccggcgcccccggccccggcctgggcctgtgcagcagcagccccaccggcggcttcgtggacgccagcgtgctggtgagacagatcagcctgagccccagcagcggcggccacttcgtgttccaggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagatggcccagatgagaaagcagtgcctggactaccactaccaggagatgcaggccctgaaggaggtgttcaaggagtacctgatcgagctgttcttcctgcagcacttccagggcaacatgatggacttcctggccttcaagaagaagcactacgcccccctgcaggcctacctgagacagaacgacctggacatcgaggaggaggaggaggaggaggaggaggaggaggagaagagcgaggtgatcaacgacgagcagcaggccctggccggcagcctggtggccggcgccggcagcaccgtggagaccgacctgttcaagagacagcaggccatgcccagcaccggcatggccgagcagagcaagagacccagactggaggtgggccaccagggcgtggtgttccagcaccccggcgccgacgccggcgtgcccctgcagcagctgatgcccaccgcccagggcggcatgccccccaccccccaggccgcccagctggccggccagagacagagccagcagcagtacgaccccagcaccggcccccccgtgcagaacgccgccagcctgcacacccccctgccccagctgcccggcagactgccccccgccggcgtgcccaccgccgccctgagcagcgccctgcagttcgcccagcagccccaggtggtggaggcccagacccagctgcagatccccgtgaagacccagcagcccaacgtgcccatccccgccccccccagcagccagctgcccatcccccccagccagcccgcccagctggccctgcacgtgcccacccccggcaaggtgcaggtgcaggccagccagctgagcagcctgccccagatggtggccagcaccagactgcccgtggaccccgcccccccctgccccagacccctgcccaccagcagcaccagcagcctggcccccgtgagcggcagcggccccggccccagccccgccagaagcagccccgtgaacagacccagcagcgccaccaacaaggccctgagccccgtgaccagcagaacccccggcgtggtggccagcgcccccaccaagccccagagccccgcccagaacgccaccagcagccaggacagcagccaggacaccctgaccgagcagatcaccctggagaaccaggtgcaccagagaatcgccgagctgagaaaggccggcctgtggagccagagaagactgcccaagctgcaggaggcccccagacccaagagccactgggactacctgctggaggagatgcagtggatggccaccgacttcgcccaggagagaagatggaaggtggccgccgccaagaagctggtgagaaccgtggtgagacaccacgaggagaagcagctgagagaggagagaggcaagaaggaggagcagagcagactgagaagaatcgccgccagcaccgccagagagatcgagtgcttctggagcaacatcgagcaggtggtggagatcaagctgagagtggagctggaggagaagagaaagaaggccctgaacctgcagaaggtgagcagaagaggcaaggagctgagacccaagggcttcgacgccctgcaggagagcagcctggacagcggcatgagcggcagaaagagaaaggccagcatcagcctgaccgacgacgaggtggacgacgaggaggagaccatcgaggaggaggaggccaacgagggcgtggtggaccaccagaccgagctgagcaacctggccaaggaggccgagctgcccctgctggacctgatgaagctgtacgagggcgccttcctgcccagcagccagtggcccagacccaagcccgacggcgaggacaccagcggcgaggaggacgccgacgactgccccggcgacagagagagcagaaaggacctggtgctgatcgacagcctgttcatcatggaccagttcaaggccgccgagagaatgaacatcggcaagcccaacgccaaggacatcgccgacgtgaccgccgtggccgaggccatcctgcccaagggcagcgccagagtgaccaccagcgtgaagttcaacgcccccagcctgctgtacggcgccctgagagactaccagaagatcggcctggactggctggccaagctgtacagaaagaacctgaacggcatcctggccgacgaggccggcctgggcaagaccgtgcagatcatcgccttcttcgcccacctggcctgcaacgagggcaactggggcccccacctggtggtggtgagaagctgcaacatcctgaagtgggagctggagctgaagagatggtgccccggcctgaagatcctgagctacatcggcagccacagagagctgaaggccaagagacaggagtgggccgagcccaacagcttccacgtgtgcatcaccagctacacccagttcttcagaggcctgaccgccttcaccagagtgagatggaagtgcctggtgatcgacgagatgcagagagtgaagggcatgaccgagagacactgggaggccgtgttcaccctgcagagccagcagagactgctgctgatcgacagccccctgcacaacaccttcctggagctgtggaccatggtgcacttcctggtgcccggcatcagcagaccctacctgagcagccccctgagagcccccagcgaggagagccaggactactaccacaaggtggtgatcagactgcacagagtgacccagcccttcatcctgagaagaaccaagagagacgtggagaagcagctgaccaagaagtacgagcacgtgctgaagtgcagactgagcaacagacagaaggccctgtacgaggacgtgatcctgcagcccggcacccaggaggccctgaagagcggccacttcgtgaacgtgctgagcatcctggtgagactgcagagaatctgcaaccaccccggcctggtggagcccagacaccccggcagcagctacgtggccggccccctggagtaccccagcgccagcctgatcctgaaggccctggagagagacttctggaaggaggccgacctgagcatgttcgacctgatcggcctggagaacaagatcaccagacacgaggccgagctgctgagcaagaagaagatccccagaaagctgatggaggagatcagcaccagcgccgcccccgccgccagacccgccgccgccaagctgaaggccagcagactgttccagcccgtgcagtacggccagaagcccgagggcagaaccgtggccttccccagcacccacccccccagaaccgccgcccccaccaccgccagcgccgccccccagggccccctgagaggcagaccccccatcgccaccttcagcgccaaccccgaggccaagggcggcgaggtggtgaagatcgcccagctggccagcatcaccggcccccagagcagagtggcccagcccgagacccccgtgaccctgcagttccagggcagcaagttcaccctgagccacagccagctgagacagctgaccgccggccagcccctgcagctgcagggcagcgtgctgcagatcgtgagcgcccccggccagccctacctgagagcccccggccccgtggtgatgcagaccgtgagccaggccggcgccgtgcacggcgccctgggcagcaagccccccgccggcggccccagccccgcccccctgaccccccaggtgggcgtgcccggcagagtggccgtgaacgccctggccgtgggcgagcccggcaccgccagcaagcccgccagccccatcggcggccccacccaggaggagaagaccagactgctgaaggagagactggaccagatctacctggtgaacgagagaagatgcagccaggcccccgtgtacggcagagacctgctgagaatctgcgccctgcccagccacggcagagtgcagtggagaggcagcctggacggcagaagaggcaaggaggccggccccgcccacagctacaccagcagcagcgagagccccagcgagctgatgctgaccctgtgcagatgcggcgagagcctgcaggacgtgatcgacagagtggccttcgtgatcccccccgtggtggccgccccccccagcctgagagtgcccagacccccccccctgtacagccacagaatgagaatcctgagacagggcctgagagagcacgccgccccctacttccagcagctgagacagaccaccgcccccagactgctgcagttccccgagctgagactggtgcagttcgacagcggcaagctggaggccctggccatcctgctgcagaagctgaagagcgagggcagaagagtgctgatcctgagccagatgatcctgatgctggacatcctggagatgttcctgaacttccactacctgacctacgtgagaatcgacgagaacgccagcagcgagcagagacaggagctgatgagaagcttcaacagagacagaagaatcttctgcgccatcctgagcacccacagcagaaccaccggcatcaacctggtggaggccgacaccgtggtgttctacgacaacgacctgaaccccgtgatggacgccaaggcccaggagtggtgcgacagaatcggcagatgcaaggacatccacatctacagactggtgagcggcaacagcatcgaggagaagctgctgaagaacggcaccaaggacctgatcagagaggtggccgcccagggcaacgactacagcatggccttcctgacccagagaaccatccaggagctgttcgaggtgtacagccccatggacgacgccggcttccccgtgaaggccgaggagttcgtggtgctgagccaggagcccagcgtgaccgagaccatcgcccccaagatcgccagacccttcatcgaggccctgaagagcatcgagtacctggaggaggacgcccagaagagcgcccaggagggcgtgctgggcccccacaccgacgccctgagcagcgacagcgagaacatgccctgcgacgaggagcccagccagctggaggagctggccgacttcatggagcagctgacccccatcgagaagtacgccctgaactacctggagctgttccacaccagcatcgagcaggagaaggagagaaacagcgaggacgccgtgatgaccgccgtgagagcctgggagttctggaacctgaagaccctgcaggagagagaggccagactgagactggagcaggaggaggccgagctgctgacctacaccagagaggacgcctacagcatggagtacgtgtacgaggacgtggacggccagaccgaggtgatgcccctgtggaccccccccacccccccccaggacgacagcgacatctacctggacagcgtgatgtgcctgatgtacgaggccacccccatccccgaggccaagctgccccccgtgtacgtgagaaaggagagaaagagacacaagaccgaccccagcgccgccggcagaaagaagaagcagagacacggcgaggccgtggtgccccccagaagcctgttcgacagagccacccccggcctgctgaagatcagaagagagggcaaggagcagaagaagaacatcctgctgaagcagcaggtgcccttcgccaagcccctgcccaccttcgccaagcccaccgccgagcccggccaggacaaccccgagtggctgatcagcgaggactgggccctgctgcaggccgtgaagcagctgctggagctgcccctgaacctgaccatcgtgagccccgcccacacccccaactgggacctggtgagcgacgtggtgaacagctgcagcagaatctacagaagcagcaagcagtgcagaaacagatacgagaacgtgatcatccccagagaggagggcaagagcaagaacaacagacccctgagaaccagccagatctacgcccaggacgagaacgccacccacacccagctgtacaccagccacttcgacctgatgaagatgaccgccggcaagagaagcccccccatcaagcccctgctgggcatgaaccccttccagaagaaccccaagcacgccagcgtgctggccgagagcggcatcaactacgacaagcccctgccccccatccaggtggccagcctgagagccgagagaatcgccaaggagaagaaggccctggccgaccagcagaaggcccagcagcccgccgtggcccagcccccccccccccagccccagccccccccccccccccagcagccccccccccccctgccccagccccaggccgccggcagccagccccccgccggcccccccgccgtgcagccccagccccagccccagccccagacccagccccagcccgtgcaggcccccgccaaggcccagcccgccatcaccaccggcggcagcgccgccgtgctggccggcaccatcaagaccagcgtgaccggcaccagcatgcccaccggcgccgtgagcggcaacgtgatcgtgaacaccatcgccggcgtgcccgccgccaccttccagagcatcaacaagagactggccagccccgtggcccccggcgccctgaccacccccggcggcagcgcccccgcccaggtggtgcacacccagcccccccccagagccgtgggcagccccgccaccgccacccccgacctggtgagcatggccaccacccagggcgtgagagccgtgaccagcgtgaccgccagcgccgtggtgaccaccaacctgacccccgtgcagacccccgccagaagcctggtgccccaggtgagccaggccaccggcgtgcagctgcccggcaagaccatcacccccgcccacttccagctgctgagacagcagcagcagcagcagcagcagcagcagcagcagcagcagcagcagcagcagcagcagcagcagcagcagcagcagcagcagcagaccaccaccaccagccaggtgcaggtgccccagatccagggccaggcccagagccccgcccagatcaaggccgtgggcaagctgacccccgagcacctgatcaagatgcagaagcagaagctgcagatgcccccccagcccccccccccccaggcccagagcgcccccccccagcccaccgcccaggtgcaggtgcagaccagccagcccccccagcagcagagcccccagctgaccaccgtgaccgcccccagacccggcgccctgctgaccggcaccaccgtggccaacctgcaggtggccagactgaccagagtgcccaccagccagctgcaggcccagggccagatgcagacccaggccccccagcccgcccaggtggccctggccaagccccccgtggtgagcgtgcccgccgccgtggtgagcagccccggcgtgaccaccctgcccatgaacgtggccggcatcagcgtggccatcggccagccccagaaggccgccggccagaccgtggtggcccagcccgtgcacatgcagcagctgctgaagctgaagcagcaggccgtgcagcagcagaaggccatccagccccaggccgcccagggccccgccgccgtgcagcagaagatcaccgcccagcagatcaccacccccggcgcccagcagaaggtggcctacgccgcccagcccgccctgaagacccagttcctgaccacccccatcagccaggcccagaagctggccggcgcccagcaggtgcagacccagatccaggtggccaagctgccccaggtggtgcagcagcagacccccgtggccagcatccagcaggtggccagcgccagccagcaggccagcccccagaccgtggccctgacccaggccaccgccgccggccagcaggtgcagatgatccccgccgtgaccgccaccgcccaggtggtgcagcagaagctgatccagcagcaggtggtgaccaccgccagcgcccccctgcagacccccggcgcccccaaccccgcccaggtgcccgccagcagcgacagccccagccagcagcccaagctgcagatgagagtgcccgccgtgagactgaagacccccaccaagcccccctgccagtag

SEQ ID NO: 80008 - DNA, 9261 bp, Artificial Sequence
  Description of Artificial Sequence: Synthetic coding sequence
atgcaccacggcaccggcccccagaacgtgcagcaccagctgcagagaagcagagcctgccccggcagcgagggcgaggagcagcccgcccaccccaaccccccccccagccccgccgcccccttcgcccccagcgccagccccagcgccccccagagccccagctaccagatccagcagctgatgaacagaagccccgccaccggccagaacgtgaacatcaccctgcagagcgtgggccccgtggtgggcggcaaccagcagatcaccctggcccccctgcccctgcccagccccaccagccccggcttccagttcagcgcccagcccagaagattcgagcacggcagccccagctacatccaggtgaccagccccctgagccagcaggtgcagacccagagccccacccagcccagccccggccccggccaggccctgcagaacgtgagagccggcgcccccggccccggcctgggcctgtgcagcagcagccccaccggcggcttcgtggacgccagcgtgctggtgagacagatcagcctgagccccagcagcggcggccacttcgtgttccaggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagatggcccagatgagaaagcagtgcctggactaccactaccaggagatgcaggccctgaaggaggtgttcaaggagtacctgatcgagctgttcttcctgcagcacttccagggcaacatgatggacttcctggccttcaagaagaagcactacgcccccctgcaggcctacctgagacagaacgacctggacatcgaggaggaggaggaggaggaggaggaggaggaggagaagagcgaggtgatcaacgacgagcaggccctggccggcagcctggtggccggcgccggcagcaccgtggagaccgacctgttcaagagacagcaggccatgcccagcaccggcatggccggcggcatgccccccaccccccaggccgcccagctggccggccagagacagagccagcagcagtacgaccccagcaccggcccccccgtgcagaacgccgccagcctgcacacccccctgccccagctgcccggcagactgccccccgccggcgtgcccaccgccgccctgagcagcgccctgcagttcgcccagcagccccaggtggtggaggcccagacccagctgcagatccccgtgaagacccagcagcccaacgtgcccatccccgccccccccagcagccagctgcccatcccccccagccagcccgcccagctggccctgcacgtgcccacccccggcaaggtgcaggtgcaggccagccagctgagcagcctgccccagatggtggccagcaccagactgcccgtggaccccgcccccccctgccccagacccctgcccaccagcagcaccagcagcctggcccccgtgagcggcagcggccccggccccagccccgccagaagcagccccgtgaacagacccagcagcgccaccaacaaggccctgagccccgtgaccagcagaacccccggcgtggtggccagcgcccccaccaagccccagagccccgcccagaacgccaccagcagccaggacagcagccaggacaccctgaccgagcagatcaccctggagaaccaggtgcaccagagaatcgccgagctgagaaaggccggcctgtggagccagagaagactgcccaagctgcaggaggcccccagacccaagagccactgggactacctgctggaggagatgcagtggatggccaccgacttcgcccaggagagaagatggaaggtggccgccgccaagaagctggtgagaaccgtggtgagacaccacgaggagaagcagctgagagaggagagaggcaagaaggaggagcagagcagactgagaagaatcgccgccagcaccgccagagagatcgagtgcttctggagcaacatcgagcaggtggtggagatcaagctgagagtggagctggaggagaagagaaagaaggccctgaacctgcagaaggtgagcagaagaggcaaggagctgagacccaagggcttcgacgccctgcaggagagcagcctggacagcggcatgagcggcagaaagagaaaggccagcatcagcctgaccgacgacgaggtggacgacgaggaggagaccatcgaggaggaggaggccaacgagggcgtggtggaccaccagaccgagctgagcaacctggccaaggaggccgagctgcccctgctggacctgatgaagctgtacgagggcgccttcctgcccagcagccagtggcccagacccaagcccgacggcgaggacaccagcggcgaggaggacgccgacgactgccccggcgacagagagagcagaaaggacctggtgctgatcgacagcctgttcatcatggaccagttcaaggccgccgagagaatgaacatcggcaagcccaacgccaaggacatcgccgacgtgaccgccgtggccgaggccatcctgcccaagggcagcgccagagtgaccaccagcgtgaagttcaacgcccccagcctgctgtacggcgccctgagagactaccagaagatcggcctggactggctggccaagctgtacagaaagaacctgaacggcatcctggccgacgaggccggcctgggcaagaccgtgcagatcatcgccttcttcgcccacctggcctgcaacgagggcaactggggcccccacctggtggtggtgagaagctgcaacatcctgaagtgggagctggagctgaagagatggtgccccggcctgaagatcctgagctacatcggcagccacagagagctgaaggccaagagacaggagtgggccgagcccaacagcttccacgtgtgcatcaccagctacacccagttcttcagaggcctgaccgccttcaccagagtgagatggaagtgcctggtgatcgacgagatgcagagagtgaagggcatgaccgagagacactgggaggccgtgttcaccctgcagagccagcagagactgctgctgatcgacagccccctgcacaacaccttcctggagctgtggaccatggtgcacttcctggtgcccggcatcagcagaccctacctgagcagccccctgagagcccccagcgaggagagccaggactactaccacaaggtggtgatcagactgcacagagtgacccagcccttcatcctgagaagaaccaagagagacgtggagaagcagctgaccaagaagtacgagcacgtgctgaagtgcagactgagcaacagacagaaggccctgtacgaggacgtgatcctgcagcccggcacccaggaggccctgaagagcggccacttcgtgaacgtgctgagcatcctggtgagactgcagagaatctgcaaccaccccggcctggtggagcccagacaccccggcagcagctacgtggccggccccctggagtaccccagcgccagcctgatcctgaaggccctggagagagacttctggaaggaggccgacctgagcatgttcgacctgatcggcctggagaacaagatcaccagacacgaggccgagctgctgagcaagaagaagatccccagaaagctgatggaggagatcagcaccagcgccgcccccgccgccagacccgccgccgccaagctgaaggccagcagactgttccagcccgtgcagtacggccagaagcccgagggcagaaccgtggccttccccagcacccacccccccagaaccgccgcccccaccaccgccagcgccgccccccagggccccctgagaggcagaccccccatcgccaccttcagcgccaaccccgaggccaaggccgccgccgcccccttccagaccagccaggccagcgccagcgcccccagacaccagcccgccagcgccagcagcaccgccgccagccccgcccaccccgccaagctgagagcccagaccaccgcccaggccagcacccccggccagccccccccccagccccaggcccccagccacgccgccggccagagcgccctgccccagagactggtgctgcccagccaggcccaggccagactgcccagcggcgaggtggtgaagatcgcccagctggccagcatcaccggcccccagagcagagtggcccagcccgagacccccgtgaccctgcagttccagggcagcaagttcaccctgagccacagccagctgagacagctgaccgccggccagcccctgcagctgcagggcagcgtgctgcagatcgtgagcgcccccggccagccctacctgagagcccccggccccgtggtgatgcagaccgtgagccaggccggcgccgtgcacggcgccctgggcagcaagccccccgccggcggccccagccccgcccccctgaccccccaggtgggcgtgcccggcagagtggccgtgaacgccctggccgtgggcgagcccggcaccgccagcaagcccgccagccccatcggcggccccacccaggaggagaagaccagactgctgaaggagagactggaccagatctacctggtgaacgagagaagatgcagccaggcccccgtgtacggcagagacctgctgagaatctgcgccctgcccagccacggcagagtgcagtggagaggcagcctggacggcagaagaggcaaggaggccggccccgcccacagctacaccagcagcagcgagagccccagcgagctgatgctgaccctgtgcagatgcggcgagagcctgcaggacgtgatcgacagagtggccttcgtgatcccccccgtggtggccgccccccccagcctgagagtgcccagacccccccccctgtacagccacagaatgagaatcctgagacagggcctgagagagcacgccgccccctacttccagcagctgagacagaccaccgcccccagactgctgcagttccccgagctgagactggtgcagttcgacagcggcaagctggaggccctggccatcctgctgcagaagctgaagagcgagggcagaagagtgctgatcctgagccagatgatcctgatgctggacatcctggagatgttcctgaacttccactacctgacctacgtgagaatcgacgagaacgccagcagcgagcagagacaggagctgatgagaagcttcaacagagacagaagaatcttctgcgccatcctgagcacccacagcagaaccaccggcatcaacctggtggaggccgacaccgtggtgttctacgacaacgacctgaaccccgtgatggacgccaaggcccaggagtggtgcgacagaatcggcagatgcaaggacatccacatctacagactggtgagcggcaacagcatcgaggagaagctgctgaagaacggcaccaaggacctgatcagagaggtggccgcccagggcaacgactacagcatggccttcctgacccagagaaccatccaggagctgttcgaggtgtacagccccatggacgacgccggcttccccgtgaaggccgaggagttcgtggtgctgagccaggagcccagcgtgaccgagaccatcgcccccaagatcgccagacccttcatcgaggccctgaagagcatcgagtacctggaggaggacgcccagaagagcgcccaggagggcgtgctgggcccccacaccgacgccctgagcagcgacagcgagaacatgccctgcgacgaggagcccagccagctggaggagctggccgacttcatggagcagctgacccccatcgagaagtacgccctgaactacctggagctgttccacaccagcatcgagcaggagaaggagagaaacagcgaggacgccgtgatgaccgccgtgagagcctgggagttctggaacctgaagaccctgcaggagagagaggccagactgagactggagcaggaggaggccgagctgctgacctacaccagagaggacgcctacagcatggagtacgtgtacgaggacgtggacggccagaccgaggtgatgcccctgtggaccccccccacccccccccaggacgacagcgacatctacctggacagcgtgatgtgcctgatgtacgaggccacccccatccccgaggccaagctgccccccgtgtacgtgagaaaggagagaaagagacacaagaccgaccccagcgccgccggcagaaagaagaagcagagacacggcgaggccgtggtgccccccagaagcctgttcgacagagccacccccggcctgctgaagatcagaagagagggcaaggagcagaagaagaacatcctgctgaagcagcaggtgcccttcgccaagcccctgcccaccttcgccaagcccaccgccgagcccggccaggacaaccccgagtggctgatcagcgaggactgggccctgctgcaggccgtgaagcagctgctggagctgcccctgaacctgaccatcgtgagccccgcccacacccccaactgggacctggtgagcgacgtggtgaacagctgcagcagaatctacagaagcagcaagcagtgcagaaacagatacgagaacgtgatcatccccagagaggagggcaagagcaagaacaacagacccctgagaaccagccagatctacgcccaggacgagaacgccacccacacccagctgtacaccagccacttcgacctgatgaagatgaccgccggcaagagaagcccccccatcaagcccctgctgggcatgaaccccttccagaagaaccccaagcacgccagcgtgctggccgagagcggcatcaactacgacaagcccctgccccccatccaggtggccagcctgagagccgagagaatcgccaaggagaagaaggccctggccgaccagcagaaggcccagcagcccgccgtggcccagcccccccccccccagccccagccccccccccccccccagcagccccccccccccctgccccagccccaggccgccggcagccagccccccgccggcccccccgccgtgcagccccagccccagccccagccccagacccagccccagcccgtgcaggcccccgccaaggcccagcccgccatcaccaccggcggcagcgccgccgtgctggccggcaccatcaagaccagcgtgaccggcaccagcatgcccaccggcgccgtgagcggcaacgtgatcgtgaacaccatcgccggcgtgcccgccgccaccttccagagcatcaacaagagactggccagccccgtggcccccggcgccctgaccacccccggcggcagcgcccccgcccaggtggtgcacacccagcccccccccagagccgtgggcagccccgccaccgccacccccgacctggtgagcatggccaccacccagggcgtgagagccgtgaccagcgtgaccgccagcgccgtggtgaccaccaacctgacccccgtgcagacccccgccagaagcctggtgccccaggtgagccaggccaccggcgtgcagctgcccggcaagaccatcacccccgcccacttccagctgctgagacagcagcagcagcagcagcagcagcagcagcagcagcagcagcagcagcagcagcagcagcagcagcagcagcagcagcagcagcagaccaccaccaccagccaggtgcaggtgccccagatccagggccaggcccagagccccgcccagatcaaggccgtgggcaagctgacccccgagcacctgatcaagatgcagaagcagaagctgcagatgcccccccagcccccccccccccaggcccagagcgcccccccccagcccaccgcccaggtgcaggtgcagaccagccagcccccccagcagcagagcccccagctgaccaccgtgaccgcccccagacccggcgccctgctgaccggcaccaccgtggccaacctgcaggtggccagactgaccagagtgcccaccagccagctgcaggcccagggccagatgcagacccaggccccccagcccgcccaggtggccctggccaagccccccgtggtgagcgtgcccgccgccgtggtgagcagccccggcgtgaccaccctgcccatgaacgtggccggcatcagcgtggccatcggccagccccagaaggccgccggccagaccgtggtggcccagcccgtgcacatgcagcagctgctgaagctgaagcagcaggccgtgcagcagcagaaggccatccagccccaggccgcccagggccccgccgccgtgcagcagaagatcaccgcccagcagatcaccacccccggcgcccagcagaaggtggcctacgccgcccagcccgccctgaagacccagttcctgaccacccccatcagccaggcccagaagctggccggcgcccagcaggtgcagacccagatccaggtggccaagctgccccaggtggtgcagcagcagacccccgtggccagcatccagcaggtggccagcgccagccagcaggccagcccccagaccgtggccctgacccaggccaccgccgccggccagcaggtgcagatgatccccgccgtgaccgccaccgcccaggtggtgcagcagaagctgatccagcagcaggtggtgaccaccgccagcgcccccctgcagacccccggcgcccccaaccccgcccaggtgcccgccagcagcgacagccccagccagcagcccaagctgcagatgagagtgcccgccgtgagactgaagacccccaccaagcccccctgccagtag

SEQ ID NO: 80009 - DNA, 9480 bp, Artificial Sequence
  Description of Artificial Sequence: Synthetic coding sequence
atgcaccacggcaccggcccccagaacgtgcagcaccagctgcagagaagcagagcctgccccggcagcgagggcgaggagcagcccgcccaccccaaccccccccccagccccgccgcccccttcgcccccagcgccagccccagcgccccccagagccccagctaccagatccagcagctgatgaacagaagccccgccaccggccagaacgtgaacatcaccctgcagagcgtgggccccgtggtgggcggcaaccagcagatcaccctggcccccctgcccctgcccagccccaccagccccggcttccagttcagcgcccagcccagaagattcgagcacggcagccccagctacatccaggtgaccagccccctgagccagcaggtgcagacccagagccccacccagcccagccccggccccggccaggccctgcagaacgtgagagccggcgcccccggccccggcctgggcctgtgcagcagcagccccaccggcggcttcgtggacgccagcgtgctggtgagacagatcagcctgagccccagcagcggcggccacttcgtgttccaggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagatggcccagatgagaaagcagtgcctggactaccactaccaggagatgcaggccctgaaggaggtgttcaaggagtacctgatcgagctgttcttcctgcagcacttccagggcaacatgatggacttcctggccttcaagaagaagcactacgcccccctgcaggcctacctgagacagaacgacctggacatcgaggaggaggaggaggaggaggaggaggaggaggagaagagcgaggtgatcaacgacgaggtgaaggtggtgaccggcaaggacggccagaccggcacccccgtggccatcgccacccagctgccccccaaggtgagcgccgccttcagcagccagcagcagcccttccagcaggccctggccggcagcctggtggccggcgccggcagcaccgtggagaccgacctgttcaagagacagcaggccatgcccagcaccggcatggccgagcagagcaagagacccagactggaggtgggccaccagggcgtggtgttccagcaccccggcgccgacgccggcgtgcccctgcagcagctgatgcccaccgcccagggcggcatgccccccaccccccaggccgcccagctggccggccagagacagagccagcagcagtacgaccccagcaccggcccccccgtgcagaacgccgccagcctgcacacccccctgccccagctgcccggcagactgccccccgccggcgtgcccaccgccgccctgagcagcgccctgcagttcgcccagcagccccaggtggtggaggcccagacccagctgcagatccccgtgaagacccagcagcccaacgtgcccatccccgccccccccagcagccagctgcccatcccccccagccagcccgcccagctggccctgcacgtgcccacccccggcaaggtgcaggtgcaggccagccagctgagcagcctgccccagatggtggccagcaccagactgcccgtggaccccgcccccccctgccccagacccctgcccaccagcagcaccagcagcctggcccccgtgagcggcagcggccccggccccagccccgccagaagcagccccgtgaacagacccagcagcgccaccaacaaggccctgagccccgtgaccagcagaacccccggcgtggtggccagcgcccccaccaagccccagagccccgcccagaacgccaccagcagccaggacagcagccaggacaccctgaccgagcagatcaccctggagaaccaggtgcaccagagaatcgccgagctgagaaaggccggcctgtggagccagagaagactgcccaagctgcaggaggcccccagacccaagagccactgggactacctgctggaggagatgcagtggatggccaccgacttcgcccaggagagaagatggaaggtggccgccgccaagaagctggtgagaaccgtggtgagacaccacgaggagaagcagctgagagaggagagaggcaagaaggaggagcagagcagactgagaagaatcgccgccagcaccgccagagagatcgagtgcttctggagcaacatcgagcaggtggtggagatcaagctgagagtggagctggaggagaagagaaagaaggccctgaacctgcagaaggtgagcagaagaggcaaggagctgagacccaagggcttcgacgccctgcaggagagcagcctggacagcggcatgagcggcagaaagagaaaggccagcatcagcctgaccgacgacgaggtggacgacgaggaggagaccatcgaggaggaggaggccaacgagggcgtggtggaccaccagaccgagctgagcaacctggccaaggaggccgagctgcccctgctggacctgatgaagctgtacgagggcgccttcctgcccagcagccagtggcccagacccaagcccgacggcgaggacaccagcggcgaggaggacgccgacgactgccccggcgacagagagagcagaaaggacctggtgctgatcgacagcctgttcatcatggaccagttcaaggccgccgagagaatgaacatcggcaagcccaacgccaaggacatcgccgacgtgaccgccgtggccgaggccatcctgcccaagggcagcgccagagtgaccaccagcgtgaagttcaacgcccccagcctgctgtacggcgccctgagagactaccagaagatcggcctggactggctggccaagctgtacagaaagaacctgaacggcatcctggccgacgaggccggcctgggcaagaccgtgcagatcatcgccttcttcgcccacctggcctgcaacgagggcaactggggcccccacctggtggtggtgagaagctgcaacatcctgaagtgggagctggagctgaagagatggtgccccggcctgaagatcctgagctacatcggcagccacagagagctgaaggccaagagacaggagtgggccgagcccaacagcttccacgtgtgcatcaccagctacacccagttcttcagaggcctgaccgccttcaccagagtgagatggaagtgcctggtgatcgacgagatgcagagagtgaagggcatgaccgagagacactgggaggccgtgttcaccctgcagagccagcagagactgctgctgatcgacagccccctgcacaacaccttcctggagctgtggaccatggtgcacttcctggtgcccggcatcagcagaccctacctgagcagccccctgagagcccccagcgaggagagccaggactactaccacaaggtggtgatcagactgcacagagtgacccagcccttcatcctgagaagaaccaagagagacgtggagaagcagctgaccaagaagtacgagcacgtgctgaagtgcagactgagcaacagacagaaggccctgtacgaggacgtgatcctgcagcccggcacccaggaggccctgaagagcggccacttcgtgaacgtgctgagcatcctggtgagactgcagagaatctgcaaccaccccggcctggtggagcccagacaccccggcagcagctacgtggccggccccctggagtaccccagcgccagcctgatcctgaaggccctggagagagacttctggaaggaggccgacctgagcatgttcgacctgatcggcctggagaacaagatcaccagacacgaggccgagctgctgagcaagaagaagatccccagaaagctgatggaggagatcagcaccagcgccgcccccgccgccagacccgccgccgccaagctgaaggccagcagactgttccagcccgtgcagtacggccagaagcccgagggcagaaccgtggccttccccagcacccacccccccagaaccgccgcccccaccaccgccagcgccgccccccagggccccctgagaggcagaccccccatcgccaccttcagcgccaaccccgaggccaaggccgccgccgcccccttccagaccagccaggccagcgccagcgcccccagacaccagcccgccagcgccagcagcaccgccgccagccccgcccaccccgccaagctgagagcccagaccaccgcccaggccagcacccccggccagccccccccccagccccaggcccccagccacgccgccggccagagcgccctgccccagagactggtgctgcccagccaggcccaggccagactgcccagcggcgaggtggtgaagatcgcccagctggccagcatcaccggcccccagagcagagtggcccagcccgagacccccgtgaccctgcagttccagggcagcaagttcaccctgagccacagccagctgagacagctgaccgccggccagcccctgcagctgcagggcagcgtgctgcagatcgtgagcgcccccggccagccctacctgagagcccccggccccgtggtgatgcagaccgtgagccaggccggcgccgtgcacggcgccctgggcagcaagccccccgccggcggccccagccccgcccccctgaccccccaggtgggcgtgcccggcagagtggccgtgaacgccctggccgtgggcgagcccggcaccgccagcaagcccgccagccccatcggcggccccacccaggaggagaagaccagactgctgaaggagagactggaccagatctacctggtgaacgagagaagatgcagccaggcccccgtgtacggcagagacctgctgagaatctgcgccctgcccagccacggcagagtgcagtggagaggcagcctggacggcagaagaggcaaggaggccggccccgcccacagctacaccagcagcagcgagagccccagcgagctgatgctgaccctgtgcagatgcggcgagagcctgcaggacgtgatcgacagagtggccttcgtgatcccccccgtggtggccgccccccccagcctgagagtgcccagacccccccccctgtacagccacagaatgagaatcctgagacagggcctgagagagcacgccgccccctacttccagcagctgagacagaccaccgcccccagactgctgcagttccccgagctgagactggtgcagttcgacagcggcaagctggaggccctggccatcctgctgcagaagctgaagagcgagggcagaagagtgctgatcctgagccagatgatcctgatgctggacatcctggagatgttcctgaacttccactacctgacctacgtgagaatcgacgagaacgccagcagcgagcagagacaggagctgatgagaagcttcaacagagacagaagaatcttctgcgccatcctgagcacccacagcagaaccaccggcatcaacctggtggaggccgacaccgtggtgttctacgacaacgacctgaaccccgtgatggacgccaaggcccaggagtggtgcgacagaatcggcagatgcaaggacatccacatctacagactggtgagcggcaacagcatcgaggagaagctgctgaagaacggcaccaaggacctgatcagagaggtggccgcccagggcaacgactacagcatggccttcctgacccagagaaccatccaggagctgttcgaggtgtacagccccatggacgacgccggcttccccgtgaaggccgaggagttcgtggtgctgagccaggagcccagcgtgaccgagaccatcgcccccaagatcgccagacccttcatcgaggccctgaagagcatcgagtacctggaggaggacgcccagaagagcgcccaggagggcgtgctgggcccccacaccgacgccctgagcagcgacagcgagaacatgccctgcgacgaggagcccagccagctggaggagctggccgacttcatggagcagctgacccccatcgagaagtacgccctgaactacctggagctgttccacaccagcatcgagcaggagaaggagagaaacagcgaggacgccgtgatgaccgccgtgagagcctgggagttctggaacctgaagaccctgcaggagagagaggccagactgagactggagcaggaggaggccgagctgctgacctacaccagagaggacgcctacagcatggagtacgtgtacgaggacgtggacggccagaccgaggtgatgcccctgtggaccccccccacccccccccaggacgacagcgacatctacctggacagcgtgatgtgcctgatgtacgaggccacccccatccccgaggccaagctgccccccgtgtacgtgagaaaggagagaaagagacacaagaccgaccccagcgccgccggcagaaagaagaagcagagacacggcgaggccgtggtgccccccagaagcctgttcgacagagccacccccggcctgctgaagatcagaagagagggcaaggagcagaagaagaacatcctgctgaagcagcaggtgcccttcgccaagcccctgcccaccttcgccaagcccaccgccgagcccggccaggacaaccccgagtggctgatcagcgaggactgggccctgctgcaggccgtgaagcagctgctggagctgcccctgaacctgaccatcgtgagccccgcccacacccccaactgggacctggtgagcgacgtggtgaacagctgcagcagaatctacagaagcagcaagcagtgcagaaacagatacgagaacgtgatcatccccagagaggagggcaagagcaagaacaacagacccctgagaaccagccagatctacgcccaggacgagaacgccacccacacccagctgtacaccagccacttcgacctgatgaagatgaccgccggcaagagaagcccccccatcaagcccctgctgggcatgaaccccttccagaagaaccccaagcacgccagcgtgctggccgagagcggcatcaactacgacaagcccctgccccccatccaggtggccagcctgagagccgagagaatcgccaaggagaagaaggccctggccgaccagcagaaggcccagcagcccgccgtggcccagcccccccccccccagccccagccccccccccccccccagcagccccccccccccctgccccagccccaggccgccggcagccagccccccgccggcccccccgccgtgcagccccagccccagccccagccccagacccagccccagcccgtgcaggcccccgccaaggcccagcccgccatcaccaccggcggcagcgccgccgtgctggccggcaccatcaagaccagcgtgaccggcaccagcatgcccaccggcgccgtgagcggcaacgtgatcgtgaacaccatcgccggcgtgcccgccgccaccttccagagcatcaacaagagactggccagccccgtggcccccggcgccctgaccacccccggcggcagcgcccccgcccaggtggtgcacacccagcccccccccagagccgtgggcagccccgccaccgccacccccgacctggtgagcatggccaccacccagggcgtgagagccgtgaccagcgtgaccgccagcgccgtggtgaccaccaacctgacccccgtgcagacccccgccagaagcctggtgccccaggtgagccaggccaccggcgtgcagctgcccggcaagaccatcacccccgcccacttccagctgctgagacagcagcagcagcagcagcagcagcagcagcagcagcagcagcagcagcagcagcagcagcagcagcagcagcagcagcagcagcagaccaccaccaccagccaggtgcaggtgccccagatccagggccaggcccagagccccgcccagatcaaggccgtgggcaagctgacccccgagcacctgatcaagatgcagaagcagaagctgcagatgcccccccagcccccccccccccaggcccagagcgcccccccccagcccaccgcccaggtgcaggtgcagaccagccagcccccccagcagcagagcccccagctgaccaccgtgaccgcccccagacccggcgccctgctgaccggcaccaccgtggccaacctgcaggtggccagactgaccagagtgcccaccagccagctgcaggcccagggccagatgcagacccaggccccccagcccgcccaggtggccctggccaagccccccgtggtgagcgtgcccgccgccgtggtgagcagccccggcgtgaccaccctgcccatgaacgtggccggcatcagcgtggccatcggccagccccagaaggccgccggccagaccgtggtggcccagcccgtgcacatgcagcagctgctgaagctgaagcagcaggccgtgcagcagcagaaggccatccagccccaggccgcccagggccccgccgccgtgcagcagaagatcaccgcccagcagatcaccacccccggcgcccagcagaaggtggcctacgccgcccagcccgccctgaagacccagttcctgaccacccccatcagccaggcccagaagctggccggcgcccagcaggtgcagacccagatccaggtggccaagctgccccaggtggtgcagcagcagacccccgtggccagcatccagcaggtggccagcgccagccagcaggccagcccccagaccgtggccctgacccaggccaccgccgccggccagcaggtgcagatgatccccgccgtgaccgccaccgcccaggtggtgcagcagaagctgatccagcagcaggtggtgaccaccgccagcgcccccctgcagacccccggcgcccccaaccccgcccaggtgcccgccagcagcgacagccccagccagcagcccaagctgcagatgagagtgcccgccgtgagactgaagacccccaccaagcccccctgccagtag

SEQ ID NO: 80010 - DNA, 9372 bp, Artificial Sequence
  Description of Artificial Sequence: Synthetic coding sequence
atgcaccacggcaccggcccccagaacgtgcagcaccagctgcagagaagcagagcctgccccggcagcgagggcgaggagcagcccgcccaccccaaccccccccccagccccgccgcccccttcgcccccagcgccagccccagcgccccccagagccccagctaccagatccagcagctgatgaacagaagccccgccaccggccagaacgtgaacatcaccctgcagagcgtgggccccgtggtgggcggcaaccagcagatcaccctggcccccctgcccctgcccagccccaccagccccggcttccagttcagcgcccagcccagaagattcgagcacggcagccccagctacatccaggtgaccagccccctgagccagcaggtgcagacccagagccccacccagcccagccccggccccggccaggccctgcagaacgtgagagccggcgcccccggccccggcctgggcctgtgcagcagcagccccaccggcggcttcgtggacgccagcgtgctggtgagacagatcagcctgagccccagcagcggcggccacttcgtgttccaggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagatggcccagatgagaaagcagtgcctggactaccactaccaggagatgcaggccctgaaggaggtgttcaaggagtacctgatcgagctgttcttcctgcagcacttccagggcaacatgatggacttcctggccttcaagaagaagcactacgcccccctgcaggcctacctgagacagaacgacctggacatcgaggaggaggaggaggaggaggaggaggaggaggagaagagcgaggtgatcaacgacgagcagcaggccctggccggcagcctggtggccggcgccggcagcaccgtggagaccgacctgttcaagagacagcaggccatgcccagcaccggcatggccgagcagagcaagagacccagactggaggtgggccaccagggcgtggtgttccagcaccccggcgccgacgccggcgtgcccctgcagcagctgatgcccaccgcccagggcggcatgccccccaccccccaggccgcccagctggccggccagagacagagccagcagcagtacgaccccagcaccggcccccccgtgcagaacgccgccagcctgcacacccccctgccccagctgcccggcagactgccccccgccggcgtgcccaccgccgccctgagcagcgccctgcagttcgcccagcagccccaggtggtggaggcccagacccagctgcagatccccgtgaagacccagcagcccaacgtgcccatccccgccccccccagcagccagctgcccatcccccccagccagcccgcccagctggccctgcacgtgcccacccccggcaaggtgcaggtgcaggccagccagctgagcagcctgccccagatggtggccagcaccagactgcccgtggaccccgcccccccctgccccagacccctgcccaccagcagcaccagcagcctggcccccgtgagcggcagcggccccggccccagccccgccagaagcagccccgtgaacagacccagcagcgccaccaacaaggccctgagccccgtgaccagcagaacccccggcgtggtggccagcgcccccaccaagccccagagccccgcccagaacgccaccagcagccaggacagcagccaggacaccctgaccgagcagatcaccctggagaaccaggtgcaccagagaatcgccgagctgagaaaggccggcctgtggagccagagaagactgcccaagctgcaggaggcccccagacccaagagccactgggactacctgctggaggagatgcagtggatggccaccgacttcgcccaggagagaagatggaaggtggccgccgccaagaagctggtgagaaccgtggtgagacaccacgaggagaagcagctgagagaggagagaggcaagaaggaggagcagagcagactgagaagaatcgccgccagcaccgccagagagatcgagtgcttctggagcaacatcgagcaggtggtggagatcaagctgagagtggagctggaggagaagagaaagaaggccctgaacctgcagaaggtgagcagaagaggcaaggagctgagacccaagggcttcgacgccctgcaggagagcagcctggacagcggcatgagcggcagaaagagaaaggccagcatcagcctgaccgacgacgaggtggacgacgaggaggagaccatcgaggaggaggaggccaacgagggcgtggtggaccaccagaccgagctgagcaacctggccaaggaggccgagctgcccctgctggacctgatgaagctgtacgagggcgccttcctgcccagcagccagtggcccagacccaagcccgacggcgaggacaccagcggcgaggaggacgccgacgactgccccggcgacagagagagcagaaaggacctggtgctgatcgacagcctgttcatcatggaccagttcaaggccgccgagagaatgaacatcggcaagcccaacgccaaggacatcgccgacgtgaccgccgtggccgaggccatcctgcccaagggcagcgccagagtgaccaccagcgtgaagttcaacgcccccagcctgctgtacggcgccctgagagactaccagaagatcggcctggactggctggccaagctgtacagaaagaacctgaacggcatcctggccgacgaggccggcctgggcaagaccgtgcagatcatcgccttcttcgcccacctggcctgcaacgagggcaactggggcccccacctggtggtggtgagaagctgcaacatcctgaagtgggagctggagctgaagagatggtgccccggcctgaagatcctgagctacatcggcagccacagagagctgaaggccaagagacaggagtgggccgagcccaacagcttccacgtgtgcatcaccagctacacccagttcttcagaggcctgaccgccttcaccagagtgagatggaagtgcctggtgatcgacgagatgcagagagtgaagggcatgaccgagagacactgggaggccgtgttcaccctgcagagccagcagagactgctgctgatcgacagccccctgcacaacaccttcctggagctgtggaccatggtgcacttcctggtgcccggcatcagcagaccctacctgagcagccccctgagagcccccagcgaggagagccaggactactaccacaaggtggtgatcagactgcacagagtgacccagcccttcatcctgagaagaaccaagagagacgtggagaagcagctgaccaagaagtacgagcacgtgctgaagtgcagactgagcaacagacagaaggccctgtacgaggacgtgatcctgcagcccggcacccaggaggccctgaagagcggccacttcgtgaacgtgctgagcatcctggtgagactgcagagaatctgcaaccaccccggcctggtggagcccagacaccccggcagcagctacgtggccggccccctggagtaccccagcgccagcctgatcctgaaggccctggagagagacttctggaaggaggccgacctgagcatgttcgacctgatcggcctggagaacaagatcaccagacacgaggccgagctgctgagcaagaagaagatccccagaaagctgatggaggagatcagcaccagcgccgcccccgccgccagacccgccgccgccaagctgaaggccagcagactgttccagcccgtgcagtacggccagaagcccgagggcagaaccgtggccttccccagcacccacccccccagaaccgccgcccccaccaccgccagcgccgccccccagggccccctgagaggcagaccccccatcgccaccttcagcgccaaccccgaggccaaggccgccgccgcccccttccagaccagccaggccagcgccagcgcccccagacaccagcccgccagcgccagcagcaccgccgccagccccgcccaccccgccaagctgagagcccagaccaccgcccaggccagcacccccggccagccccccccccagccccaggcccccagccacgccgccggccagagcgccctgccccagagactggtgctgcccagccaggcccaggccagactgcccagcggcgaggtggtgaagatcgcccagctggccagcatcaccggcccccagagcagagtggcccagcccgagacccccgtgaccctgcagttccagggcagcaagttcaccctgagccacagccagctgagacagctgaccgccggccagcccctgcagctgcagggcagcgtgctgcagatcgtgagcgcccccggccagccctacctgagagcccccggccccgtggtgatgcagaccgtgagccaggccggcgccgtgcacggcgccctgggcagcaagccccccgccggcggccccagccccgcccccctgaccccccaggtgggcgtgcccggcagagtggccgtgaacgccctggccgtgggcgagcccggcaccgccagcaagcccgccagccccatcggcggccccacccaggaggagaagaccagactgctgaaggagagactggaccagatctacctggtgaacgagagaagatgcagccaggcccccgtgtacggcagagacctgctgagaatctgcgccctgcccagccacggcagagtgcagtggagaggcagcctggacggcagaagaggcaaggaggccggccccgcccacagctacaccagcagcagcgagagccccagcgagctgatgctgaccctgtgcagatgcggcgagagcctgcaggacgtgatcgacagagtggccttcgtgatcccccccgtggtggccgccccccccagcctgagagtgcccagacccccccccctgtacagccacagaatgagaatcctgagacagggcctgagagagcacgccgccccctacttccagcagctgagacagaccaccgcccccagactgctgcagttccccgagctgagactggtgcagttcgacagcggcaagctggaggccctggccatcctgctgcagaagctgaagagcgagggcagaagagtgctgatcctgagccagatgatcctgatgctggacatcctggagatgttcctgaacttccactacctgacctacgtgagaatcgacgagaacgccagcagcgagcagagacaggagctgatgagaagcttcaacagagacagaagaatcttctgcgccatcctgagcacccacagcagaaccaccggcatcaacctggtggaggccgacaccgtggtgttctacgacaacgacctgaaccccgtgatggacgccaaggcccaggagtggtgcgacagaatcggcagatgcaaggacatccacatctacagactggtgagcggcaacagcatcgaggagaagctgctgaagaacggcaccaaggacctgatcagagaggtggccgcccagggcaacgactacagcatggccttcctgacccagagaaccatccaggagctgttcgaggtgtacagccccatggacgacgccggcttccccgtgaaggccgaggagttcgtggtgctgagccaggagcccagcgtgaccgagaccatcgcccccaagatcgccagacccttcatcgaggccctgaagagcatcgagtacctggaggaggacgcccagaagagcgcccaggagggcgtgctgggcccccacaccgacgccctgagcagcgacagcgagaacatgccctgcgacgaggagcccagccagctggaggagctggccgacttcatggagcagctgacccccatcgagaagtacgccctgaactacctggagctgttccacaccagcatcgagcaggagaaggagagaaacagcgaggacgccgtgatgaccgccgtgagagcctgggagttctggaacctgaagaccctgcaggagagagaggccagactgagactggagcaggaggaggccgagctgctgacctacaccagagaggacgcctacagcatggagtacgtgtacgaggacgtggacggccagaccgaggtgatgcccctgtggaccccccccacccccccccaggacgacagcgacatctacctggacagcgtgatgtgcctgatgtacgaggccacccccatccccgaggccaagctgccccccgtgtacgtgagaaaggagagaaagagacacaagaccgaccccagcgccgccggcagaaagaagaagcagagacacggcgaggccgtggtgccccccagaagcctgttcgacagagccacccccggcctgctgaagatcagaagagagggcaaggagcagaagaagaacatcctgctgaagcagcaggtgcccttcgccaagcccctgcccaccttcgccaagcccaccgccgagcccggccaggacaaccccgagtggctgatcagcgaggactgggccctgctgcaggccgtgaagcagctgctggagctgcccctgaacctgaccatcgtgagccccgcccacacccccaactgggacctggtgagcgacgtggtgaacagctgcagcagaatctacagaagcagcaagcagtgcagaaacagatacgagaacgtgatcatccccagagaggagggcaagagcaagaacaacagacccctgagaaccagccagatctacgcccaggacgagaacgccacccacacccagctgtacaccagccacttcgacctgatgaagatgaccgccggcaagagaagcccccccatcaagcccctgctgggcatgaaccccttccagaagaaccccaagcacgccagcgtgctggccgagagcggcatcaactacgacaagcccctgccccccatccaggtggccagcctgagagccgagagaatcgccaaggagaagaaggccctggccgaccagcagaaggcccagcagcccgccgtggcccagcccccccccccccagccccagccccccccccccccccagcagccccccccccccctgccccagccccaggccgccggcagccagccccccgccggcccccccgccgtgcagccccagccccagccccagccccagacccagccccagcccgtgcaggcccccgccaaggcccagcccgccatcaccaccggcggcagcgccgccgtgctggccggcaccatcaagaccagcgtgaccggcaccagcatgcccaccggcgccgtgagcggcaacgtgatcgtgaacaccatcgccggcgtgcccgccgccaccttccagagcatcaacaagagactggccagccccgtggcccccggcgccctgaccacccccggcggcagcgcccccgcccaggtggtgcacacccagcccccccccagagccgtgggcagccccgccaccgccacccccgacctggtgagcatggccaccacccagggcgtgagagccgtgaccagcgtgaccgccagcgccgtggtgaccaccaacctgacccccgtgcagacccccgccagaagcctggtgccccaggtgagccaggccaccggcgtgcagctgcccggcaagaccatcacccccgcccacttccagctgctgagacagcagcagcagcagcagcagcagcagcagcagcagcagcagcagcagcagcagcagcagcagcagcagcagcagcagcagcagcagaccaccaccaccagccaggtgcaggtgccccagatccagggccaggcccagagccccgcccagatcaaggccgtgggcaagctgacccccgagcacctgatcaagatgcagaagcagaagctgcagatgcccccccagcccccccccccccaggcccagagcgcccccccccagcccaccgcccaggtgcaggtgcagaccagccagcccccccagcagcagagcccccagctgaccaccgtgaccgcccccagacccggcgccctgctgaccggcaccaccgtggccaacctgcaggtggccagactgaccagagtgcccaccagccagctgcaggcccagggccagatgcagacccaggccccccagcccgcccaggtggccctggccaagccccccgtggtgagcgtgcccgccgccgtggtgagcagccccggcgtgaccaccctgcccatgaacgtggccggcatcagcgtggccatcggccagccccagaaggccgccggccagaccgtggtggcccagcccgtgcacatgcagcagctgctgaagctgaagcagcaggccgtgcagcagcagaaggccatccagccccaggccgcccagggccccgccgccgtgcagcagaagatcaccgcccagcagatcaccacccccggcgcccagcagaaggtggcctacgccgcccagcccgccctgaagacccagttcctgaccacccccatcagccaggcccagaagctggccggcgcccagcaggtgcagacccagatccaggtggccaagctgccccaggtggtgcagcagcagacccccgtggccagcatccagcaggtggccagcgccagccagcaggccagcccccagaccgtggccctgacccaggccaccgccgccggccagcaggtgcagatgatccccgccgtgaccgccaccgcccaggtggtgcagcagaagctgatccagcagcaggtggtgaccaccgccagcgcccccctgcagacccccggcgcccccaaccccgcccaggtgcccgccagcagcgacagccccagccagcagcccaagctgcagatgagagtgcccgccgtgagactgaagacccccaccaagcccccctgccagtag

SEQ ID NO: 80011 - DNA, 9369 bp, Artificial Sequence
  Description of Artificial Sequence: Synthetic coding sequence
atgcaccacggcaccggcccccagaacgtgcagcaccagctgcagagaagcagagcctgccccggcagcgagggcgaggagcagcccgcccaccccaaccccccccccagccccgccgcccccttcgcccccagcgccagccccagcgccccccagagccccagctaccagatccagcagctgatgaacagaagccccgccaccggccagaacgtgaacatcaccctgcagagcgtgggccccgtggtgggcggcaaccagcagatcaccctggcccccctgcccctgcccagccccaccagccccggcttccagttcagcgcccagcccagaagattcgagcacggcagccccagctacatccaggtgaccagccccctgagccagcaggtgcagacccagagccccacccagcccagccccggccccggccaggccctgcagaacgtgagagccggcgcccccggccccggcctgggcctgtgcagcagcagccccaccggcggcttcgtggacgccagcgtgctggtgagacagatcagcctgagccccagcagcggcggccacttcgtgttccaggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagatggcccagatgagaaagcagtgcctggactaccactaccaggagatgcaggccctgaaggaggtgttcaaggagtacctgatcgagctgttcttcctgcagcacttccagggcaacatgatggacttcctggccttcaagaagaagcactacgcccccctgcaggcctacctgagacagaacgacctggacatcgaggaggaggaggaggaggaggaggaggaggaggagaagagcgaggtgatcaacgacgagcaggccctggccggcagcctggtggccggcgccggcagcaccgtggagaccgacctgttcaagagacagcaggccatgcccagcaccggcatggccgagcagagcaagagacccagactggaggtgggccaccagggcgtggtgttccagcaccccggcgccgacgccggcgtgcccctgcagcagctgatgcccaccgcccagggcggcatgccccccaccccccaggccgcccagctggccggccagagacagagccagcagcagtacgaccccagcaccggcccccccgtgcagaacgccgccagcctgcacacccccctgccccagctgcccggcagactgccccccgccggcgtgcccaccgccgccctgagcagcgccctgcagttcgcccagcagccccaggtggtggaggcccagacccagctgcagatccccgtgaagacccagcagcccaacgtgcccatccccgccccccccagcagccagctgcccatcccccccagccagcccgcccagctggccctgcacgtgcccacccccggcaaggtgcaggtgcaggccagccagctgagcagcctgccccagatggtggccagcaccagactgcccgtggaccccgcccccccctgccccagacccctgcccaccagcagcaccagcagcctggcccccgtgagcggcagcggccccggccccagccccgccagaagcagccccgtgaacagacccagcagcgccaccaacaaggccctgagccccgtgaccagcagaacccccggcgtggtggccagcgcccccaccaagccccagagccccgcccagaacgccaccagcagccaggacagcagccaggacaccctgaccgagcagatcaccctggagaaccaggtgcaccagagaatcgccgagctgagaaaggccggcctgtggagccagagaagactgcccaagctgcaggaggcccccagacccaagagccactgggactacctgctggaggagatgcagtggatggccaccgacttcgcccaggagagaagatggaaggtggccgccgccaagaagctggtgagaaccgtggtgagacaccacgaggagaagcagctgagagaggagagaggcaagaaggaggagcagagcagactgagaagaatcgccgccagcaccgccagagagatcgagtgcttctggagcaacatcgagcaggtggtggagatcaagctgagagtggagctggaggagaagagaaagaaggccctgaacctgcagaaggtgagcagaagaggcaaggagctgagacccaagggcttcgacgccctgcaggagagcagcctggacagcggcatgagcggcagaaagagaaaggccagcatcagcctgaccgacgacgaggtggacgacgaggaggagaccatcgaggaggaggaggccaacgagggcgtggtggaccaccagaccgagctgagcaacctggccaaggaggccgagctgcccctgctggacctgatgaagctgtacgagggcgccttcctgcccagcagccagtggcccagacccaagcccgacggcgaggacaccagcggcgaggaggacgccgacgactgccccggcgacagagagagcagaaaggacctggtgctgatcgacagcctgttcatcatggaccagttcaaggccgccgagagaatgaacatcggcaagcccaacgccaaggacatcgccgacgtgaccgccgtggccgaggccatcctgcccaagggcagcgccagagtgaccaccagcgtgaagttcaacgcccccagcctgctgtacggcgccctgagagactaccagaagatcggcctggactggctggccaagctgtacagaaagaacctgaacggcatcctggccgacgaggccggcctgggcaagaccgtgcagatcatcgccttcttcgcccacctggcctgcaacgagggcaactggggcccccacctggtggtggtgagaagctgcaacatcctgaagtgggagctggagctgaagagatggtgccccggcctgaagatcctgagctacatcggcagccacagagagctgaaggccaagagacaggagtgggccgagcccaacagcttccacgtgtgcatcaccagctacacccagttcttcagaggcctgaccgccttcaccagagtgagatggaagtgcctggtgatcgacgagatgcagagagtgaagggcatgaccgagagacactgggaggccgtgttcaccctgcagagccagcagagactgctgctgatcgacagccccctgcacaacaccttcctggagctgtggaccatggtgcacttcctggtgcccggcatcagcagaccctacctgagcagccccctgagagcccccagcgaggagagccaggactactaccacaaggtggtgatcagactgcacagagtgacccagcccttcatcctgagaagaaccaagagagacgtggagaagcagctgaccaagaagtacgagcacgtgctgaagtgcagactgagcaacagacagaaggccctgtacgaggacgtgatcctgcagcccggcacccaggaggccctgaagagcggccacttcgtgaacgtgctgagcatcctggtgagactgcagagaatctgcaaccaccccggcctggtggagcccagacaccccggcagcagctacgtggccggccccctggagtaccccagcgccagcctgatcctgaaggccctggagagagacttctggaaggaggccgacctgagcatgttcgacctgatcggcctggagaacaagatcaccagacacgaggccgagctgctgagcaagaagaagatccccagaaagctgatggaggagatcagcaccagcgccgcccccgccgccagacccgccgccgccaagctgaaggccagcagactgttccagcccgtgcagtacggccagaagcccgagggcagaaccgtggccttccccagcacccacccccccagaaccgccgcccccaccaccgccagcgccgccccccagggccccctgagaggcagaccccccatcgccaccttcagcgccaaccccgaggccaaggccgccgccgcccccttccagaccagccaggccagcgccagcgcccccagacaccagcccgccagcgccagcagcaccgccgccagccccgcccaccccgccaagctgagagcccagaccaccgcccaggccagcacccccggccagccccccccccagccccaggcccccagccacgccgccggccagagcgccctgccccagagactggtgctgcccagccaggcccaggccagactgcccagcggcgaggtggtgaagatcgcccagctggccagcatcaccggcccccagagcagagtggcccagcccgagacccccgtgaccctgcagttccagggcagcaagttcaccctgagccacagccagctgagacagctgaccgccggccagcccctgcagctgcagggcagcgtgctgcagatcgtgagcgcccccggccagccctacctgagagcccccggccccgtggtgatgcagaccgtgagccaggccggcgccgtgcacggcgccctgggcagcaagccccccgccggcggccccagccccgcccccctgaccccccaggtgggcgtgcccggcagagtggccgtgaacgccctggccgtgggcgagcccggcaccgccagcaagcccgccagccccatcggcggccccacccaggaggagaagaccagactgctgaaggagagactggaccagatctacctggtgaacgagagaagatgcagccaggcccccgtgtacggcagagacctgctgagaatctgcgccctgcccagccacggcagagtgcagtggagaggcagcctggacggcagaagaggcaaggaggccggccccgcccacagctacaccagcagcagcgagagccccagcgagctgatgctgaccctgtgcagatgcggcgagagcctgcaggacgtgatcgacagagtggccttcgtgatcccccccgtggtggccgccccccccagcctgagagtgcccagacccccccccctgtacagccacagaatgagaatcctgagacagggcctgagagagcacgccgccccctacttccagcagctgagacagaccaccgcccccagactgctgcagttccccgagctgagactggtgcagttcgacagcggcaagctggaggccctggccatcctgctgcagaagctgaagagcgagggcagaagagtgctgatcctgagccagatgatcctgatgctggacatcctggagatgttcctgaacttccactacctgacctacgtgagaatcgacgagaacgccagcagcgagcagagacaggagctgatgagaagcttcaacagagacagaagaatcttctgcgccatcctgagcacccacagcagaaccaccggcatcaacctggtggaggccgacaccgtggtgttctacgacaacgacctgaaccccgtgatggacgccaaggcccaggagtggtgcgacagaatcggcagatgcaaggacatccacatctacagactggtgagcggcaacagcatcgaggagaagctgctgaagaacggcaccaaggacctgatcagagaggtggccgcccagggcaacgactacagcatggccttcctgacccagagaaccatccaggagctgttcgaggtgtacagccccatggacgacgccggcttccccgtgaaggccgaggagttcgtggtgctgagccaggagcccagcgtgaccgagaccatcgcccccaagatcgccagacccttcatcgaggccctgaagagcatcgagtacctggaggaggacgcccagaagagcgcccaggagggcgtgctgggcccccacaccgacgccctgagcagcgacagcgagaacatgccctgcgacgaggagcccagccagctggaggagctggccgacttcatggagcagctgacccccatcgagaagtacgccctgaactacctggagctgttccacaccagcatcgagcaggagaaggagagaaacagcgaggacgccgtgatgaccgccgtgagagcctgggagttctggaacctgaagaccctgcaggagagagaggccagactgagactggagcaggaggaggccgagctgctgacctacaccagagaggacgcctacagcatggagtacgtgtacgaggacgtggacggccagaccgaggtgatgcccctgtggaccccccccacccccccccaggacgacagcgacatctacctggacagcgtgatgtgcctgatgtacgaggccacccccatccccgaggccaagctgccccccgtgtacgtgagaaaggagagaaagagacacaagaccgaccccagcgccgccggcagaaagaagaagcagagacacggcgaggccgtggtgccccccagaagcctgttcgacagagccacccccggcctgctgaagatcagaagagagggcaaggagcagaagaagaacatcctgctgaagcagcaggtgcccttcgccaagcccctgcccaccttcgccaagcccaccgccgagcccggccaggacaaccccgagtggctgatcagcgaggactgggccctgctgcaggccgtgaagcagctgctggagctgcccctgaacctgaccatcgtgagccccgcccacacccccaactgggacctggtgagcgacgtggtgaacagctgcagcagaatctacagaagcagcaagcagtgcagaaacagatacgagaacgtgatcatccccagagaggagggcaagagcaagaacaacagacccctgagaaccagccagatctacgcccaggacgagaacgccacccacacccagctgtacaccagccacttcgacctgatgaagatgaccgccggcaagagaagcccccccatcaagcccctgctgggcatgaaccccttccagaagaaccccaagcacgccagcgtgctggccgagagcggcatcaactacgacaagcccctgccccccatccaggtggccagcctgagagccgagagaatcgccaaggagaagaaggccctggccgaccagcagaaggcccagcagcccgccgtggcccagcccccccccccccagccccagccccccccccccccccagcagccccccccccccctgccccagccccaggccgccggcagccagccccccgccggcccccccgccgtgcagccccagccccagccccagccccagacccagccccagcccgtgcaggcccccgccaaggcccagcccgccatcaccaccggcggcagcgccgccgtgctggccggcaccatcaagaccagcgtgaccggcaccagcatgcccaccggcgccgtgagcggcaacgtgatcgtgaacaccatcgccggcgtgcccgccgccaccttccagagcatcaacaagagactggccagccccgtggcccccggcgccctgaccacccccggcggcagcgcccccgcccaggtggtgcacacccagcccccccccagagccgtgggcagccccgccaccgccacccccgacctggtgagcatggccaccacccagggcgtgagagccgtgaccagcgtgaccgccagcgccgtggtgaccaccaacctgacccccgtgcagacccccgccagaagcctggtgccccaggtgagccaggccaccggcgtgcagctgcccggcaagaccatcacccccgcccacttccagctgctgagacagcagcagcagcagcagcagcagcagcagcagcagcagcagcagcagcagcagcagcagcagcagcagcagcagcagcagcagcagaccaccaccaccagccaggtgcaggtgccccagatccagggccaggcccagagccccgcccagatcaaggccgtgggcaagctgacccccgagcacctgatcaagatgcagaagcagaagctgcagatgcccccccagcccccccccccccaggcccagagcgcccccccccagcccaccgcccaggtgcaggtgcagaccagccagcccccccagcagcagagcccccagctgaccaccgtgaccgcccccagacccggcgccctgctgaccggcaccaccgtggccaacctgcaggtggccagactgaccagagtgcccaccagccagctgcaggcccagggccagatgcagacccaggccccccagcccgcccaggtggccctggccaagccccccgtggtgagcgtgcccgccgccgtggtgagcagccccggcgtgaccaccctgcccatgaacgtggccggcatcagcgtggccatcggccagccccagaaggccgccggccagaccgtggtggcccagcccgtgcacatgcagcagctgctgaagctgaagcagcaggccgtgcagcagcagaaggccatccagccccaggccgcccagggccccgccgccgtgcagcagaagatcaccgcccagcagatcaccacccccggcgcccagcagaaggtggcctacgccgcccagcccgccctgaagacccagttcctgaccacccccatcagccaggcccagaagctggccggcgcccagcaggtgcagacccagatccaggtggccaagctgccccaggtggtgcagcagcagacccccgtggccagcatccagcaggtggccagcgccagccagcaggccagcccccagaccgtggccctgacccaggccaccgccgccggccagcaggtgcagatgatccccgccgtgaccgccaccgcccaggtggtgcagcagaagctgatccagcagcaggtggtgaccaccgccagcgcccccctgcagacccccggcgcccccaaccccgcccaggtgcccgccagcagcgacagccccagccagcagcccaagctgcagatgagagtgcccgccgtgagactgaagacccccaccaagcccccctgccagtag

SEQ ID NO: 80012 - DNA, 2475 bp, Artificial Sequence
  Description of Artificial Sequence: Synthetic coding sequence
atgcaccacggcaccggcccccagaacgtgcagcaccagctgcagagaagcagagcctgccccggcagcgagggcgaggagcagcccgcccaccccaaccccccccccagccccgccgcccccttcgcccccagcgccagccccagcgccccccagagccccagctaccagatccagcagctgatgaacagaagccccgccaccggccagaacgtgaacatcaccctgcagagcgtgggccccgtggtgggcggcaaccagcagatcaccctggcccccctgcccctgcccagccccaccagccccggcttccagttcagcgcccagcccagaagattcgagcacggcagccccagctacatccaggtgaccagccccctgagccagcaggtgcagacccagagccccacccagcccagccccggccccggccaggccctgcagaacgtgagagccggcgcccccggccccggcctgggcctgtgcagcagcagccccaccggcggcttcgtggacgccagcgtgctggtgagacagatcagcctgagccccagcagcggcggccacttcgtgttccaggacggcagcggcctgacccagatcgcccagggcgcccaggtgcagctgcagcaccccggcacccccatcaccgtgagagagagaagacccagccagccccacacccagagcggcggcaccatccaccacctgggcccccagagccccgccgccgccggcggcgccggcctgcagcccctggccagccccagccacatcaccaccgccaacctgcccccccagatcagcagcatcatccagggccagctggtgcagcagcagcaggtgctgcagggcccccccctgcccagacccctgggcttcgagagaacccccggcgtgctgctgcccggcgccggcggcgccgccggcttcggcatgaccagcccccccccccccaccagccccagcagaaccgccgtgccccccggcctgagcagcctgcccctgaccagcgtgggcaacaccggcatgaagaaggtgcccaagaagctggaggagatcccccccgccagccccgagatggcccagatgagaaagcagtgcctggactaccactaccaggagatgcaggccctgaaggaggtgttcaaggagtacctgatcgagctgttcttcctgcagcacttccagggcaacatgatggacttcctggccttcaagaagaagcactacgcccccctgcaggcctacctgagacagaacgacctggacatcgaggaggaggaggaggaggaggaggaggaggaggagaagagcgaggtgatcaacgacgagcaggccctggccggcagcctggtggccggcgccggcagcaccgtggagaccgacctgttcaagagacagcaggccatgcccagcaccggcatggccggcggcatgccccccaccccccaggccgcccagctggccggccagagacagagccagcagcagtacgaccccagcaccggcccccccgtgcagaacgccgccagcctgcacacccccctgccccagctgcccggcagactgccccccgccggcgtgcccaccgccgccctgagcagcgccctgcagttcgcccagcagccccaggtggtggaggcccagacccagctgcagatccccgtgaagacccagcagcccaacgtgcccatccccgccccccccagcagccagctgcccatcccccccagccagcccgcccagctggccctgcacgtgcccacccccggcaaggtgcaggtgcaggccagccagctgagcagcctgccccagatggtggccagcaccagactgcccgtggaccccgcccccccctgccccagacccctgcccaccagcagcaccagcagcctggcccccgtgagcggcagcggccccggccccagccccgccagaagcagccccgtgaacagacccagcagcgccaccaacaaggccctgagccccgtgaccagcagaacccccggcgtggtggccagcgcccccaccaagccccagagccccgcccagaacgccaccagcagccaggacagcagccaggacaccctgaccgagcagatcaccctggagaaccaggtgcaccagagaatcgccgagctgagaaaggccggcctgtggagccagagaagactgcccaagctgcaggaggcccccagacccaagagccactgggactacctgctggaggagatgcagtggatggccaccgacttcgcccaggagagaagatggaaggtggccgccgccaagaagctggtgagaaccgtggtgagacaccacgaggagaagcagctgagagaggagagaggcaagaaggaggagcagagcagactgagaagaatcgccgccagcaccgccagagagatcgagtgcttctggagcaacatcgagcaggtggtggagatcaagctgagagtggagctggagtag

SEQ ID NO: 80013 - DNA, 9372 bp, Artificial Sequence; identical to SEQ ID NO: 80010
  Description of Artificial Sequence: Synthetic coding sequence

SEQ ID NO: 80014 - DNA, 1314 bp, Artificial Sequence
  Description of Artificial Sequence: Synthetic coding sequence
atgctgcagggccccagagccctggccagcgccgccggccagacccccaaggtggtgcccgccatgagccccaccgagctgtggcccagcggcctgagcagcccccagctgtgccccgccaccgccacctactacacccccctgtacccccagaccgccccccccgccgccgcccccggcacctgcctggacgccaccccccacggccccgagggccaggtggtgagatgcctgcccgccggcagactgcccgccaagagaaagctggacctggagggcatcggcagacccgtggtgcccgagttccccacccccaagggcaagtgcatcagagtggacggcctgcccagccccaagacccccaagagccccggcgagaagaccagatacgacaccagcctgggcctgctgaccaagaagttcatctacctgctgagcgagagcgaggacggcgtgctggacctgaactgggccgccgaggtgctggacgtgcagaagagaagaatctacgacatcaccaacgtgctggagggcatccagctgatcagaaagaaggccaagaacaacatccagtgggtgggcagaggcatgttcgaggaccccaccagacccggcaagcagcagcagctgggccaggagctgaaggagctgatgaacaccgagcaggccctggaccagctgatccagagctgcagcctgagcttcaagcacctgaccgaggacaaggccaacaagagactggcctacgtgacctaccaggacatcagagccgtgggcaacttcaaggagcagaccgtgatcgccgtgaaggcccccccccagaccagactggaggtgcccgacagaaccgaggacaacctgcagatctacctgaagagcacccagggccccatcgaggtgtacctgtgccccgaggaggtgcaggagcccgacagccccagcgaggagcccctgcccagcaccagcaccctgtgccccagccccgacagcgcccagcccagcagcagcaccgaccccagcatcatggagcccaccgccagcagcgtgcccgcccccgcccccaccccccagcaggccccccccccccccagcctggtgcccctggaggccaccgacagcctgctggagctgccccaccccctgctgcagcagaccgaggaccagttcctgagccccaccctggcctgcagcagccccctgatcagcttcagccccagcctggaccaggacgactacctgtggggcctggaggccggcgagggcatcagcgacctgttcgacagctacgacctgggcgacctgctgatcaactag

SEQ ID NO: 80015 - DNA, 1398 bp, Artificial Sequence
  Description of Artificial Sequence: Synthetic coding sequence
atgagaaagggcatccagcccgccctggagcagtacctggtgaccgccggcggcggcgagggcgccgccgtggtggccgccgccgccgccgccagcatggacaagagagccctgctggccagccccggcttcgccgccgccgccgccgccgccgccgcccccggcgcctacatccagatcctgaccaccaacaccagcaccaccagctgcagcagcagcctgcagagcggcgccgtggccgccggccccctgctgcccagcgcccccggcgccgagcagaccgccggcagcctgctgtacaccaccccccacggccccagcagcagagccggcctgctgcagcagccccccgccctgggcagaggcggcagcggcggcggcggcggcccccccgccaagagaagactggagctgggcgagagcggccaccagtacctgagcgacggcctgaagacccccaagggcaagggcagagccgccctgagaagccccgacagccccaagacccccaagagccccagcgagaagaccagatacgacaccagcctgggcctgctgaccaagaagttcatccagctgctgagccagagccccgacggcgtgctggacctgaacaaggccgccgaggtgctgaaggtgcagaagagaagaatctacgacatcaccaacgtgctggagggcatccacctgatcaagaagaagagcaagaacaacgtgcagtggatgggctgcagcctgagcgaggacggcggcatgctggcccagtgccagggcctgagcaaggaggtgaccgagctgagccaggaggagaagaagctggacgagctgatccagagctgcaccctggacctgaagctgctgaccgaggacagcgagaaccagagactggcctacgtgacctaccaggacatcagaaagatcagcggcctgaaggaccagaccgtgatcgtggtgaaggccccccccgagaccagactggaggtgcccgacagcatcgagagcctgcagatccacctggccagcacccagggccccatcgaggtgtacctgtgccccgaggagaccgagacccacagccccatgaagaccaacaaccaggaccacaacggcaacatccccaagcccgccagcaaggacctggccagcaccaacagcggccacagcgactgcagcgtgagcatgggcaacctgagccccctggccagccccgccaacctgctgcagcagaccgaggaccagatccccagcaacctggagggccccttcgtgaacctgctgccccccctgctgcaggaggactacctgctgagcctgggcgaggaggagggcatcagcgacctgttcgacgcctacgacctggagaagctgcccctggtggaggacttcatgtgcagctag

SEQ ID NO: 80016 - DNA, 387 bp, Artificial Sequence
  Description of Artificial Sequence: Synthetic coding sequence
atggacaagagagccctgctggccagcggcggcggcggcggcccccccgccaagagaagactggagctgggcgagagcggccaccagtacctgagcgacggcctgaagacccccaagggcaagggcagagccgccctgagaagccccgacagccccaagaagaagaccagatacgacaccagcctgggcctgctgaccaagaagttcatccagctgctgagccagagccccgacggcgtgctggacctgaacaaggccgccgaggtgctgaaggtgcagaagagaagaatctacgacatcaccaacgtgctggagggcatcagcgacctgttcgacgcctacgacctggagaagctgcccctggtggaggacttcatgtgcagctag

SEQ ID NO: 80017 - DNA, 1005 bp, Artificial Sequence
  Description of Artificial Sequence: Synthetic coding sequence
atgcccctgcagcagcaggccaagagaagactggagctgggcgagagcggccaccagtacctgagcgacggcctgaagacccccaagggcaagggcagagccgccctgagaagccccgacagccccaagaagaagaccagatacgacaccagcctgggcctgctgaccaagaagttcatccagctgctgagccagagccccgacggcgtgctggacctgaacaaggccgccgaggtgctgaaggtgcagaagagaagaatctacgacatcaccaacgtgctggagggcatccacctgatcaagaagaagagcaagaacaacgtgcagtggatgggctgcagcctgagcgaggacggcggcatgctggcccagtgccagggcctgagcaaggaggtgaccgagctgagccaggaggagaagaagctggacgagctgatccagagctgcaccctggacctgaagctgctgaccgaggacagcgagaaccagagactggcctacgtgacctaccaggacatcagaaagatcagcggcctgaaggaccagaccgtgatcgtggtgaaggccccccccgagaccagactggaggtgcccgacagcatcgagagcctgcagatccacctggccagcacccagggccccatcgaggtgtacctgtgccccgaggagaccgagacccacagccccatgaagaccaacaaccaggaccacaacggcaacatccccaagcccgccagcaaggacctggccagcaccaacagcggccacagcgactgcagcgtgagcatgggcaacctgagccccctggccagccccgccaacctgctgcagcagaccgaggaccagatccccagcaacctggagggccccttcgtgaacctgctgccccccctgctgcaggaggactacctgctgagcctgggcgaggaggagggcatcagcgacctgttcgacgcctacgacctggagaagctgcccctggtggaggacttcatgtgcagctag

SEQ ID NO: 80018 - DNA, 2736 bp, Artificial Sequence
  Description of Artificial Sequence: Synthetic coding sequence
atggaggtgaactgcctgaccctgaaggacctgatcagccccagacagcccagactggacttcgccgtggaggacggcgagaacgcccagaaggagaacatcttcgtggacagaagcagaatggcccccaagacccccatcaagaacgagcccatcgacctgagcaagcagaagaagttcacccccgagagaaaccccatcacccccgtgaagttcgtggacagacagcaggccgagccctggacccccaccgccaacctgaagatgctgatcagcgccgccagccccgacatcagagacagagagaagaagaagggcctgttcagacccatcgagaacaaggacgacgccttcaccgacagcctgcagctggacgtggtgggcgacagcgccgtggacgagttcgagaagcagagacccagcagaaagcagaagagcctgggcctgctgtgccagaagttcctggccagataccccagctaccccctgagcaccgagaagaccaccatcagcctggacgaggtggccgtgagcctgggcgtggagagaagaagaatctacgacatcgtgaacgtgctggagagcctgcacctggtgagcagagtggccaagaaccagtacggctggcacggcagacacagcctgcccaagaccctgagaaacctgcagagactgggcgaggagcagaagtacgaggagcagatggcctacctgcagcagaaggagctggacctgatcgactacaagttcggcgagagaaagaaggacggcgaccccgacagccaggagcagcagctgctggacttcagcgagcccgactgccccagcagcagcgccaacagcagaaaggacaagagcctgagaatcatgagccagaagttcgtgatgctgttcctggtgagcaagaccaagatcgtgaccctggacgtggccgccaagatcctgatcgaggagagccaggacgcccccgaccacagcaagttcaagaccaaggtgagaagactgtacgacatcgccaacgtgctgaccagcctggccctgatcaagaaggtgcacgtgaccgaggagagaggcagaaagcccgccttcaagtggatcggccccgtggacttcagcagcagcgacgaggagctggtggacgtgagcgccagcgtgctgcccgagctgaagagagagacctacggccagatccaggtgtgcgccaagcagaagctggccagacacggcagcttcaacaccgtgcaggccagcgagagaatccagagaaaggtgaacagcgagcccagcagcccctacagagaggagcagggcagcggcggctacagcctggagatcggcagcctggccgccgtgtacagacagaagatcgaggacaacagccagggcaaggccttcgccagcaagagagtggtgccccccagcagcagcctggaccccgtggcccccttccccgtgctgagcgtggaccccgagtactgcgtgaaccccctggcccaccccgtgttcagcgtggcccagaccgacctgcaggccttcagcatgcagaacggcctgaacggccaggtggacgtgagcctggccagcgccgccagcgccgtggagagcctgaagcccgccctgctggccggccagcccctggtgtacgtgcccagcgccagcctgttcatgctgtacggcagcctgcaggagggccccgccagcggcagcggcagcgagagagacgacagaagcagcgaggcccccgccaccgtggagctgagcagcgcccccagcgcccagaagagactgtgcgaggagagaaagccccaggaggaggacgagcccgccaccaagagacagagcagagagtacgaggacggccccctgagcctggtgatgcccaagaagcccagcgacagcaccgacctggccagccccaagaccatgggcaacagagccagcatccccctgaaggacatccacgtgaacggccagctgcccgccgccgaggagatcagcggcaaggccaccgccaacagcctggtgagcagcgagtggggcaaccccagcagaaacaccgacgtggagaagcccagcaaggagaacgagagcaccaaggagcccagcctgctgcagtacctgtgcgtgcagagccccgccggcctgaacggcttcaacgtgctgctgagcggcagccagaccccccccaccgtgggccccagcagcggccagctgcccagcttcagcgtgccctgcatggtgctgcccagcccccccctgggccccttccccgtgctgtacagccccgccatgcccggccccgtgagcagcaccctgggcgccctgcccaacaccggccccgtgaacttcagcctgcccggcctgggcagcatcgcccagctgctggtgggccccaccgccgtggtgaaccccaagagcagcaccctgcccagcgccgacccccagctgcagagccagcccagcctgaacctgagccccgtgatgagcagaagccacagcgtggtgcagcagcccgagagccccgtgtacgtgggccaccccgtgagcgtggtgaagctgcaccagagccccgtgcccgtgacccccaagagcatccagagaacccacagagagaccttcttcaagacccccggcagcctgggcgaccccgtgctgaagagaagagagagaaaccagagcagaaacaccagcagcgcccagagaagactggagatccccagcggcggcgccgactag

SEQ ID NO: 80019 - DNA, 1149 bp, Artificial Sequence
  Description of Artificial Sequence: Synthetic coding sequence
atgcagaacggcctgaacggccaggtggacgtgagcctggccagcgccgccagcgccgtggagagcctgaagcccgccctgctggccggccagcccctggtgtacgtgcccagcgccagcctgttcatgctgtacggcagcctgcaggagggccccgccagcggcagcggcagcgagagagacgacagaagcagcgaggcccccgccaccgtggagctgagcagcgcccccagcgcccagaagagactgtgcgaggagagaaagccccaggaggaggacgagcccgccaccaagagacagagcagagagtacgaggacggccccctgagcctggtgatgcccaagaagcccagcgacagcaccgacctggccagccccaagaccatgggcaacagagccagcatccccctgaaggacatccacgtgaacggccagctgcccgccgccgaggagatcagcggcaaggccaccgccaacagcctggtgagcagcgagtggggcaaccccagcagaaacaccgacgtggagaagcccagcaaggagaacgagagcaccaaggagcccagcctgctgcagtacctgtgcgtgcagagccccgccggcctgaacggcttcaacgtgctgctgagcggcagccagaccccccccaccgtgggccccagcagcggccagctgcccagcttcagcgtgccctgcatggtgctgcccagcccccccctgggccccttccccgtgctgtacagccccgccatgcccggccccgtgagcagcaccctgggcagcatcgcccagctgctggtgggccccaccgccgtggtgaaccccaagagcagcaccctgcccagcgccgacccccagctgcagagccagcccagcctgaacctgagccccgtgatgagcagaagccacagcgtggtgcagcagcccgagagccccgtgtacgtgggccaccccgtgagcgtggtgaagctgcaccagagccccgtgcccgtgacccccaagagcatccagagaacccacagagagaccttcttcaagacccccggcagcctgggcgaccccgtgctgaagagaagagagagaaaccagagcagaaacaccagcagcgcccagagaagactggagatccccagcggcggcgccgactag

SEQ ID NO: 80020 - DNA, 2187 bp, Artificial Sequence
  Description of Artificial Sequence: Synthetic coding sequence
atggaggtgaactgcctgaccctgaaggacctgatcagccccagacagcccagactggacttcgccgtggaggacggcgagaacgcccagaaggagaacatcttcgtggacagaagcagaatggcccccaagacccccatcaagaacgagcccatcgacctgagcaagcagaagaagttcacccccgagagaaaccccatcacccccgtgaagttcgtggacagacagcaggccgagccctggacccccaccgccaacctgaagatgctgatcagcgccgccagccccgacatcagagacagagagaagaagaagggcctgttcagacccatcgagaacaaggacgacgccttcaccgacagcctgcagctggacgtggtgggcgacagcgccgtggacgagttcgagaagcagagacccagcagaaagcagaagagcctgggcctgctgtgccagaagttcctggccagataccccagctaccccctgagcaccgagaagaccaccatcagcctggacgaggtggccgtgagcctgggcgtggagagaagaagaatctacgacatcgtgaacgtgctggagagcctgcacctggtgagcagagtggccaagaaccagtacggctggcacggcagacacagcctgcccaagaccctgagaaacctgcagagactgggcgaggagcagaagtacgaggagcagatggcctacctgcagcagaaggagctggacctgatcgactacaagttcggcgagagaaagaaggacggcgaccccgacagccaggagcagcagctgctggacttcagcgagcccgactgccccagcagcagcgccaacagcagaaaggacaagagcctgagaatcatgagccagaagttcgtgatgctgttcctggtgagcaagaccaagatcgtgaccctggacgtggccgccaagatcctgatcgaggagagccaggacgcccccgaccacagcaagttcaagaccaaggtgagaagactgtacgacatcgccaacgtgctgaccagcctggccctgatcaagaaggtgcacgtgaccgaggagagaggcagaaagcccgccttcaagtggatcggccccgtggacttcagcagcagcgacgaggagctggtggacgtgagcgccagcgtgctgcccgagctgaagagagagacctacggccagatccaggtgtgcgccaagcagaagctggccagacacggcagcttcaacaccgtgcaggccagcgagagaatccagagaaaggtgaacagcgagcccagcagcccctacagagaggagcagggcagcggcggctacagcctggagatcggcagcctggccgccgtgtacagacagaagatcgaggacaacagccagggcaaggccttcgccagcaagagagtggtgccccccagcagcagcctggaccccgtggcccccttccccgtgctgagcgtggaccccgagtactgcgtgaaccccctggcccaccccgtgttcagcgtggcccagaccgacctgcaggccttcagcatgcagaacggcctgaacggccaggtggacgtgagcctggccagcgccgccagcgccgtggagagcctgaagcccgccctgctggccggccagcccctggtgtacgtgcccagcgccagcctgttcatgctgtacggcagcctgcaggagggccccgccagcggcagcggcagcgagagagacgacagaagcagcgaggcccccgccaccgtggagctgagcagcgcccccagcgcccagaagagactgtgcgaggagagaaagccccaggaggaggacgagcccgccaccaagagacagagcagagagtacgaggacggccccctgagcctggtgatgcccaagaagcccagcgacagcaccgacctggccagccccaagaccatgggcaacagagccagcatccccctgaaggacatccacgtgaacggccagctgcccgccgccgaggagatcagcggcaaggccaccgccaacagcctggtgagcagcgagtggggcaaccccagcagaaacaccgacgtggagaagcccagcaaggagaacgagagcaccaaggagcccagcctgctgcagtacctgtgcgtgcagagccccgccgtgaccagcagcagcgacccccaggagcaccccacccacaccagctag

SEQ ID NO: 80021 - DNA, 348 bp, Artificial Sequence
  Description of Artificial Sequence: Synthetic coding sequence
atggaggtgaactgcctgaccctgaaggacctgatcagccccagacagcccagactggacttcgccgtggaggacggcgagaacgcccagaaggagaacatcttcgtggacagaagcagaatggcccccaagacccccatcaagaacgagcccatcgacctgagcaagcagaagaagttcacccccgagagaaaccccatcacccccgtgaagttcgtggacagacagcaggccgagccctggacccccaccgccaacctgaagatgctgatcagcgccgccagccccgacatcagagacagagagaagaagaagggcctgttcagacccatcgagaacaaggactag

SEQ ID NO: 80022 - DNA, 2604 bp, Artificial Sequence
  Description of Artificial Sequence: Synthetic coding sequence
atggagaacgagaaggagaacctgttctgcgagccccacaagagaggcctgatgaagacccccctgaaggagagcaccaccgccaacatcgtgctggccgagatccagcccgacttcggccccctgaccacccccaccaagcccaaggagggcagccagggcgagccctggacccccaccgccaacctgaagatgctgatcagcgccgtgagccccgagatcagaaacagagaccagaagagaggcctgttcgacaacagaagcggcctgcccgaggccaaggactgcatccacgagcacctgagcggcgacgagttcgagaagagccagcccagcagaaaggagaagagcctgggcctgctgtgccacaagttcctggccagataccccaactaccccaaccccgccgtgaacaacgacatctgcctggacgaggtggccgaggagctgaacgtggagagaagaagaatctacgacatcgtgaacgtgctggagagcctgcacatggtgagcagactggccaagaacagatacacctggcacggcagacacaacctgaacaagaccctgggcaccctgaagagcatcggcgaggagaacaagtacgccgagcagatcatgatgatcaagaagaaggagtacgagcaggagttcgacttcatcaagagctacagcatcgaggaccacatcatcaagagcaacaccggccccaacggccaccccgacatgtgcttcgtggagctgcccggcgtggagttcagagccgccagcgtgaacagcagaaaggacaagagcctgagagtgatgagccagaagttcgtgatgctgttcctggtgagcaccccccagatcgtgagcctggaggtggccgccaagatcctgatcggcgaggaccacgtggaggacctggacaagagcaagttcaagaccaagatcagaagactgtacgacatcgccaacgtgctgagcagcctggacctgatcaagaaggtgcacgtgaccgaggagagaggcagaaagcccgccttcaagtggaccggccccgagatcagccccaacaccagcggcagcagccccgtgatccacttcacccccagcgacctggaggtgagaagaagcagcaaggagaactgcgccaagaacctgttcagcaccagaggcaagcccaacttcaccagacaccccagcctgatcaagctggtgaagagcatcgagagcgacagaagaaagatcaacagcgcccccagcagccccatcaagaccaacaaggccgagagcagccagaacagcgcccccttccccagcaagatggcccagctggccgccatctgcaagatgcagctggaggagcagagcagcgagagcagacagaaggtgaaggtgcagctggccagaagcggcccctgcaagcccgtggcccccctggacccccccgtgaacgccgagatggagctgaccgcccccagcctgatccagcccctgggcatggtgcccctgatccccagccccctgagcagcgccgtgcccctgatcctgccccaggcccccagcggccccagctacgccatctacctgcagcccacccaggcccaccagagcgtgacccccccccagggcctgagccccaccgtgtgcaccacccacagcagcaaggccaccggcagcaaggacagcaccgacgccaccaccgagaaggccgccaacgacaccagcaaggccagcgccagcaccagacccggcagcctgctgcccgcccccgagagacagggcgccaagagcagaaccagagagcccgccggcgagagaggcagcaagagagccagcatgctggaggacagcggcagcaagaagaagttcaaggaggacctgaagggcctggagaacgtgagcgccaccctgttccccagcggctacctgatccccctgacccagtgcagcagcctgggcgccgagagcatcctgagcggcaaggagaacagcagcgccctgagccccaaccacagaatctacagcagccccatcgccggcgtgatccccgtgaccagcagcgagctgaccgccgtgaacttccccagcttccacgtgacccccctgaagctgatggtgagccccaccagcgtggccgccgtgcccgtgggcaacagccccgccctggccagcagccaccccgtgcccatccagaaccccagcagcgccatcgtgaacttcaccctgcagcacctgggcctgatcagccccaacgtgcagctgagcgccagccccggcagcggcatcgtgcccgtgagccccagaatcgagagcgtgaacgtggcccccgagaacgccggcacccagcagggcagagccaccaactacgacagccccgtgcccggccagagccagcccaacggccagagcgtggccgtgaccggcgcccagcagcccgtgcccgtgacccccaagggcagccagctggtggccgagagcttcttcagaacccccggcggccccaccaagcccaccagcagcagctgcatggacttcgagggcgccaacaagaccagcctgggcaccctgttcgtgccccagagaaagctggaggtgagcaccgaggacgtgcactag

SEQ ID NO: 80023 - DNA, 2604 bp, Artificial Sequence
  Description of Artificial Sequence: Synthetic coding sequence
atgcagaagaagaaggagaacctgttctgcgagccccacaagagaggcctgatgaagacccccctgaaggagagcaccaccgccaacatcgtgctggccgagatccagcccgacttcggccccctgaccacccccaccaagcccaaggagggcagccagggcgagccctggacccccaccgccaacctgaagatgctgatcagcgccgtgagccccgagatcagaaacagagaccagaagagaggcctgttcgacaacagaagcggcctgcccgaggccaaggactgcatccacgagcacctgagcggcgacgagttcgagaagagccagcccagcagaaaggagaagagcctgggcctgctgtgccacaagttcctggccagataccccaactaccccaaccccgccgtgaacaacgacatctgcctggacgaggtggccgaggagctgaacgtggagagaagaagaatctacgacatcgtgaacgtgctggagagcctgcacatggtgagcagactggccaagaacagatacacctggcacggcagacacaacctgaacaagaccctgggcaccctgaagagcatcggcgaggagaacaagtacgccgagcagatcatgatgatcaagaagaaggagtacgagcaggagttcgacttcatcaagagctacagcatcgaggaccacatcatcaagagcaacaccggccccaacggccaccccgacatgtgcttcgtggagctgcccggcgtggagttcagagccgccagcgtgaacagcagaaaggacaagagcctgagagtgatgagccagaagttcgtgatgctgttcctggtgagcaccccccagatcgtgagcctggaggtggccgccaagatcctgatcggcgaggaccacgtggaggacctggacaagagcaagttcaagaccaagatcagaagactgtacgacatcgccaacgtgctgagcagcctggacctgatcaagaaggtgcacgtgaccgaggagagaggcagaaagcccgccttcaagtggaccggccccgagatcagccccaacaccagcggcagcagccccgtgatccacttcacccccagcgacctggaggtgagaagaagcagcaaggagaactgcgccaagaacctgttcagcaccagaggcaagcccaacttcaccagacaccccagcctgatcaagctggtgaagagcatcgagagcgacagaagaaagatcaacagcgcccccagcagccccatcaagaccaacaaggccgagagcagccagaacagcgcccccttccccagcaagatggcccagctggccgccatctgcaagatgcagctggaggagcagagcagcgagagcagacagaaggtgaaggtgcagctggccagaagcggcccctgcaagcccgtggcccccctggacccccccgtgaacgccgagatggagctgaccgcccccagcctgatccagcccctgggcatggtgcccctgatccccagccccctgagcagcgccgtgcccctgatcctgccccaggcccccagcggccccagctacgccatctacctgcagcccacccaggcccaccagagcgtgacccccccccagggcctgagccccaccgtgtgcaccacccacagcagcaaggccaccggcagcaaggacagcaccgacgccaccaccgagaaggccgccaacgacaccagcaaggccagcgccagcaccagacccggcagcctgctgcccgcccccgagagacagggcgccaagagcagaaccagagagcccgccggcgagagaggcagcaagagagccagcatgctggaggacagcggcagcaagaagaagttcaaggaggacctgaagggcctggagaacgtgagcgccaccctgttccccagcggctacctgatccccctgacccagtgcagcagcctgggcgccgagagcatcctgagcggcaaggagaacagcagcgccctgagccccaaccacagaatctacagcagccccatcgccggcgtgatccccgtgaccagcagcgagctgaccgccgtgaacttccccagcttccacgtgacccccctgaagctgatggtgagccccaccagcgtggccgccgtgcccgtgggcaacagccccgccctggccagcagccaccccgtgcccatccagaaccccagcagcgccatcgtgaacttcaccctgcagcacctgggcctgatcagccccaacgtgcagctgagcgccagccccggcagcggcatcgtgcccgtgagccccagaatcgagagcgtgaacgtggcccccgagaacgccggcacccagcagggcagagccaccaactacgacagccccgtgcccggccagagccagcccaacggccagagcgtggccgtgaccggcgcccagcagcccgtgcccgtgacccccaagggcagccagctggtggccgagagcttcttcagaacccccggcggccccaccaagcccaccagcagcagctgcatggacttcgagggcgccaacaagaccagcctgggcaccctgttcgtgccccagagaaagctggaggtgagcaccgaggacgtgcactag

SEQ ID NO: 80024 - DNA, 2604 bp, Artificial Sequence; identical to SEQ ID NO: 80022
  Description of Artificial Sequence: Synthetic coding sequence

SEQ ID NO: 80025 - DNA, 2355 bp, Artificial Sequence
  Description of Artificial Sequence: Synthetic coding sequence
atggagggcgccatggccgtgagagtgaccgccgcccacaccgccgaggcccaggccgaggccggcagagaggccggcgagggcgccgtggccgccgtggccgccgccctggcccccagcggcttcctgggcctgcccgcccccttcagcgaggaggacgaggacgacgtgcacagatgcggcagatgccaggccgagttcaccgccctggaggacttcgtgcagcacaagatccagaaggcctgccagagagccccccccgaggccctgcccgccacccccgccaccaccgccctgctgggccaggaggtggtgcccgccgcccccggccccgaggagcccatcaccgtggcccacatcgtggtggaggccgccagcctggccgccgacatcagccacgccagcgacctggtgggcggcggccacatcaaggaggtgatcgtggccgccgaggccgagctgggcgacggcgagatggccgaggcccccggcagccccagacagcagggcctgggcctggccggcgagggcgagcaggcccaggtgaagctgctggtgaacaaggacggcagatacgtgtgcgccctgtgccacaagaccttcaagaccggcagcatcctgaaggcccacatggtgacccacagcagcagaaaggaccacgagtgcaagctgtgcggcgccagcttcagaaccaagggcagcctgatcagacaccacagaagacacaccgacgagagaccctacaagtgcagcaagtgcggcaagagcttcagagagagcggcgccctgaccagacacctgaagagcctgaccccctgcaccgagaagatcagattcagcgtgagcaaggacgtggtggtgagcaaggaggacgccagagccggcagcggcgccggcgccgccggcctgggcaccgccaccagcagcgtgaccggcgagcccatcgagaccagccccgtgatccacctggtgaccgacgccaagggcaccgtgatccacgaggtgcacgtgcagatgcaggagctgagcctgggcatgaaggccctggcccccgagccccccgtgagccaggagctgccctgcagcagcgagggcagcagagagaacctgctgcaccaggccatgcagaacagcggcatcgtgctggagagagccgccggcgaggagggcgccctggagcccgcccccgccgccggcagcagcccccagcccctggccgtggccgccccccagctgcccgtgctggaggtgcagcccctggagacccaggtggccagcgaggccagcgccgtgcccagaacccacccctgcccccagtgcagcgagaccttccccaccgccgccaccctggaggcccacaagagaggccacaccggccccagacccttcgcctgcgcccagtgcggcaaggccttccccaaggcctacctgctgaagaagcaccaggaggtgcacgtgagagagagaagattcagatgcggcgactgcggcaagctgtacaagaccatcgcccacgtgagaggccacagaagagtgcacagcgacgagagaccctacccctgccccaagtgcggcaagagatacaagaccaagaacgcccagcaggtgcacttcagaacccacctggaggagaagccccacgtgtgccagttctgcagcagaggcttcagagagaagggcagcctggtgagacacgtgagacaccacaccggcgagaagcccttcaagtgctacaagtgcggcagaggcttcgccgagcacggcaccctgaacagacacctgagaaccaagggcggctgcctgctggaggtggaggagctgctggtgagcgaggacagccccgccgccgccaccaccgtgctgaccgaggacccccacaccgtgctggtggagttcagcagcgtggtggccgacacccaggagtacatcatcgaggccaccgccgacgacgccgagaccagcgaggccaccgagatcatcgagggcacccagaccgaggtggacagccacatcatgaaggtggtgcagcagatcgtgcaccaggccagcgccggccaccagatcatcgtgcagaacgtgaccatggacgaggagaccgccctgggccccgaggccgccgccgccgacaccatcaccatcgccacccccgagagcctgaccgagcaggtggccatgaccctggccagcgccatcagcgagggcaccgtgctggccgccagagccggcaccagcggcaccgagcaggccaccgtgaccatggtgagcagcgaggacatcgagatcctggagcacgccggcgagctggtgatcgccagccccgagggccagctggaggtgcagaccgtgatcgtgtag

SEQ ID NO: 80026 - DNA, 1047 bp, Artificial Sequence
  Description of Artificial Sequence: Synthetic coding sequence
atggccgccacctgcgagatcagcaacatcttcagcaactacttcagcgccatgtacagcagcgaggacagcaccctggccagcgtgccccccgccgccaccttcggcgccgacgacctggtgctgaccctgagcaacccccagatgagcctggagggcaccgagaaggccagctggctgggcgagcagccccagttctggagcaagacccaggtgctggactggatcagctaccaggtggagaagaacaagtacgacgccagcgccatcgacttcagcagatgcgacatggacggcgccaccctgtgcaactgcgccctggaggagctgagactggtgttcggccccctgggcgaccagctgcacgcccagctgagagacctgaccagcagcagcagcgacgagctgagctggatcatcgagctgctggagaaggacggcatggccttccaggaggccctggaccccggccccttcgaccagggcagccccttcgcccaggagctgctggacgacgtgagcaccgccggcaccggcgccagcagaagcagccacagcagcgacagcggcggcagcgacgtggacctggaccccaccgacggcaagctgttccccagcgacggcttcagagactgcaagaagggcgaccccaagcacggcaagagaaagagaggcagacccagaaagctgagcaaggagtactgggactgcctggagggcaagaagagcaagcacgcccccagaggcacccacctgtgggagttcatcagagacatcctgatccaccccgagctgaacgagggcctgatgaagtgggagaacagacacgagggcgtgttcaagttcctgagaagcgaggccgtggcccagctgtggggccagaagaagaagaacagcaacatgacctacgagaagctgagcagagccatgagatactactacaagagagagatcctggagagagtggacggcagaagactggtgtacaagttcggcaagaacagcagcggctggaaggaggaggaggtgctgcagagcagaaactag

SEQ ID NO: 80027 - DNA, 1116 bp, Artificial Sequence
  Description of Artificial Sequence: Synthetic coding sequence
atggccgccacctgcgagatcagcaacatcttcagcaactacttcagcgccatgtacagcagcgaggacagcaccctggccagcgtgccccccgccgccaccttcggcgccgacgacctggtgctgaccctgagcaacccccagatgagcctggagggcaccgagaaggccagctggctgggcgagcagccccagttctggagcaagacccaggtgctggactggatcagctaccaggtggagaagaacaagtacgacgccagcgccatcgacttcagcagatgcgacatggacggcgccaccctgtgcaactgcgccctggaggagctgagactggtgttcggccccctgggcgaccagctgcacgcccagctgagagacctgaccagcagcagcagcgacgagctgagctggatcatcgagctgctggagaaggacggcatggccttccaggaggccctggaccccggccccttcgaccagggcagccccttcgcccaggagctgctggacgacggccagcaggccagcccctaccaccccggcagctgcggcgccggcgcccccagccccggcagcagcgacgtgagcaccgccggcaccggcgccagcagaagcagccacagcagcgacagcggcggcagcgacgtggacctggaccccaccgacggcaagctgttccccagcgacggcttcagagactgcaagaagggcgaccccaagcacggcaagagaaagagaggcagacccagaaagctgagcaaggagtactgggactgcctggagggcaagaagagcaagcacgcccccagaggcacccacctgtgggagttcatcagagacatcctgatccaccccgagctgaacgagggcctgatgaagtgggagaacagacacgagggcgtgttcaagttcctgagaagcgaggccgtggcccagctgtggggccagaagaagaagaacagcaacatgacctacgagaagctgagcagagccatgagatactactacaagagagagatcctggagagagtggacggcagaagactggtgtacaagttcggcaagaacagcagcggctggaaggaggaggaggtgctgcagagcagaaactag

SEQ ID NO: 80028 - DNA, 1116 bp, Artificial Sequence; identical to SEQ ID NO: 80027
  Description of Artificial Sequence: Synthetic coding sequence

SEQ ID NO: 80029 - DNA, 1116 bp, Artificial Sequence; identical to SEQ ID NO: 80027
  Description of Artificial Sequence: Synthetic coding sequence

SEQ ID NO: 80030 - DNA, 699 bp, Artificial Sequence
  Description of Artificial Sequence: Synthetic coding sequence
atggccgccacctgcgagatcagcaacatcttcagcaactacttcagcgccatgtacagcagcgaggacagcaccctggccagcgtgccccccgccgccaccttcggcgccgacgacctggtgctgaccctgagcaacccccagatgagcctggaggagaaggccagctggctgggcgagcagccccagttctggagcaagacccaggtgctggactggatcagctaccaggtggagaagaacaagtacgacgccagcgccatcgacttcagcagatgcgacatggacggcgccaccctgtgcaactgcgccctggaggagctgagactggtgttcggccccctgggcgaccagctgcacgcccagctgagagacctgaccagcagcagcagcgacgagctgagctggatcatcgagctgctggagaaggacggcatggccttccaggaggccctggaccccggccccttcgaccagggcagccccttcgcccaggagctgctggacgacggccagcaggccagcccctaccaccccggcagctgcggcgccggcgcccccagccccggcagcagcgacgtgagcaccgccggcaccggcgccagcagaagcagccacagcagcgacagcggcggcagcgacgtggacctggaccccaccgacggcaagctgttccccagcgacggcttcagagactag

SEQ ID NO: 80031 - DNA, 1992 bp, Artificial Sequence
  Description of Artificial Sequence: Synthetic coding sequence
atggccatcaccctgcagcccagcgacctgatcttcgagttcgccagcaacggcatggacgacgacatccaccagctggaggaccccagcgtgttccccgccgtgatcgtggagcaggtgccctaccccgacctgctgcacctgtacagcggcctggagctggacgacgtgcacaacggcatcatcaccgacggcaccctgtgcatgacccaggaccagatcctggagggcagcttcctgctgaccgacgacaacgaggccaccagccacaccatgagcaccgccgaggtgctgctgaacatggagagccccagcgacatcctggacgagaagcagatcttcagcaccagcgagatgctgcccgacagcgaccccgcccccgccgtgaccctgcccaactacctgttccccgccagcgagcccgacgccctgaacagagccggcgacaccagcgaccaggagggccacagcctggaggagaaggccagcagagaggagagcgccaagaagaccggcaagagcaagaagagaatcagaaagaccaagggcaacagaagcaccagccccgtgaccgaccccagcatccccatcagaaagaagagcaaggacggcaagggcagcaccatctacctgtgggagttcctgctggccctgctgcaggacagaaacacctgccccaagtacatcaagtggacccagagagagaagggcatcttcaagctggtggacagcaaggccgtgagcaagctgtggggcaagcagaagaacaagcccgacatgaactacgagaccatgggcagagccctgagatactactaccagagaggcatcctggccaaggtggagggccagagactggtgtaccagttcaaggagatgcccaaggacctggtggtgatcgaggacgaggacgagagcagcgaggccaccgccgcccccccccaggccagcaccgccagcgtggccagcgccagcaccaccagaagaaccagcagcagagtgagcagcagaagcgccccccagggcaagggcagcagcagctgggagaagcccaagatccagcacgtgggcctgcagcccagcgccagcctggagctgggccccagcctggacgaggagatccccaccaccagcaccatgctggtgagccccgccgagggccaggtgaagctgaccaaggccgtgagcgccagcagcgtgcccagcaacatccacctgggcgtggcccccgtgggcagcggcagcgccctgaccctgcagaccatccccctgaccaccgtgctgaccaacggcccccccgccagcaccaccgcccccacccagctggtgctgcagagcgtgcccgccgccagcaccttcaaggacaccttcaccctgcaggccagcttccccctgaacgccagcttccaggacagccaggtggccgcccccggcgcccccctgatcctgagcggcctgccccagctgctggccggcgccaacagacccaccaaccccgccccccccaccgtgaccggcgccggccccgccggccccagcagccagccccccggcaccgtgatcgccgccttcatcagaaccagcggcaccaccgccgcccccagagtgaaggagggccccctgagaagcagcagctacgtgcagggcatggtgaccggcgcccccatggagggcctgctggtgcccgaggagaccctgagagagctgctgagagaccaggcccacctgcagcccctgcccacccaggtggtgagcagaggcagccacaaccccagcctgctgggcaaccagaccctgagcccccccagcagacccaccgtgggcctgacccccgtggccgagctggagctgagcagcggcagcggcagcctgctgatggccgagcccagcgtgaccaccagcggcagcctgctgaccagaagccccacccccgcccccttcagccccttcaaccccaccagcctgatcaagatggagccccacgacatctag

SEQ ID NO: 80032 - DNA, 1992 bp, Artificial Sequence; identical to SEQ ID NO: 80031
  Description of Artificial Sequence: Synthetic coding sequence

SEQ ID NO: 80033 - DNA, 234 bp, Artificial Sequence
  Description of Artificial Sequence: Synthetic coding sequence
atggacgacgacatccaccagctggaggaccccagcgtgttccccgccgtgatcgtggagcaggtgccctaccccgacctgctgcacctgtacagcggcctggagctggacgacgtgcacaacggcatcatcaccgacggcaccctgtgcatgacccaggaccagatcctggagggcagcttcctgctgaccgacgacaacgaggccaccagccacaccatgagcaccgcctag

SEQ ID NO: 80034 - DNA, 768 bp, Artificial Sequence
  Description of Artificial Sequence: Synthetic coding sequence
atgctggacagcgtgacccacagcaccttcctgcccaacgccagcttctgcgaccccctgatgagctggaccgacctgttcagcaacgaggagtactaccccgccttcgagcaccagaccgcctgcgacagctactggaccagcgtgcaccccgagtactggaccaagagacacgtgtgggagtggctgcagttctgctgcgaccagtacaagctggacaccaactgcatcagcttctgcaacttcaacatcagcggcctgcagctgtgcagcatgacccaggaggagttcgtggaggccgccggcctgtgcggcgagtacctgtacttcatcctgcagaacatcagaacccagggctacagcttcttcaacgacgccgaggagagcaaggccaccatcaaggactacgccgacagcaactgcctgaagaccagcggcatcaagagccaggactgccacagccacagcagaaccagcctgcagagcagccacctgtgggagttcgtgagagacctgctgctgagccccgaggagaactgcggcatcctggagtgggaggacagagagcagggcatcttcagagtggtgaagagcgaggccctggccaagatgtggggccagagaaagaagaacgacagaatgacctacgagaagctgagcagagccctgagatactactacaagaccggcatcctggagagagtggacagaagactggtgtacaagttcggcaagaacgcccacggctggcaggaggacaagctgtag

SEQ ID NO: 80035 - DNA, 798 bp, Artificial Sequence
  Description of Artificial Sequence: Synthetic coding sequence
atgcccagcctgccccacagccacagagtgatgctggacagcgtgacccacagcaccttcctgcccaacgccagcttctgcgaccccctgatgagctggaccgacctgttcagcaacgaggagtactaccccgccttcgagcaccagaccgcctgcgacagctactggaccagcgtgcaccccgagtactggaccaagagacacgtgtgggagtggctgcagttctgctgcgaccagtacaagctggacaccaactgcatcagcttctgcaacttcaacatcagcggcctgcagctgtgcagcatgacccaggaggagttcgtggaggccgccggcctgtgcggcgagtacctgtacttcatcctgcagaacatcagaacccagggctacagcttcttcaacgacgccgaggagagcaaggccaccatcaaggactacgccgacagcaactgcctgaagaccagcggcatcaagagccaggactgccacagccacagcagaaccagcctgcagagcagccacctgtgggagttcgtgagagacctgctgctgagccccgaggagaactgcggcatcctggagtgggaggacagagagcagggcatcttcagagtggtgaagagcgaggccctggccaagatgtggggccagagaaagaagaacgacagaatgacctacgagaagctgagcagagccctgagatactactacaagaccggcatcctggagagagtggacagaagactggtgtacaagttcggcaagaacgcccacggctggcaggaggacaagctgtag

SEQ ID NO: 80036 - DNA, 483 bp, Artificial Sequence
  Description of Artificial Sequence: Synthetic coding sequence
atgctggacagcgtgacccacagcaccttcctgcccaacgccagcttctgcgaccccctgatgagctggaccgacctgttcagcaacgaggagtactaccccgccttcgagcaccagaccgacgccgacagcaactgcctgaagaccagcggcatcaagagccaggactgccacagccacagcagaaccagcctgcagagcagccacctgtgggagttcgtgagagacctgctgctgagccccgaggagaactgcggcatcctggagtgggaggacagagagcagggcatcttcagagtggtgaagagcgaggccctggccaagatgtggggccagagaaagaagaacgacagaatgacctacgagaagctgagcagagccctgagatactactacaagaccggcatcctggagagagtggacagaagactggtgtacaagttcggcaagaacgcccacggctggcaggaggacaagctgtag

SEQ ID NO: 80037 - DNA, 1728 bp, Artificial Sequence
  Description of Artificial Sequence: Synthetic coding sequence
atgttcggcatccaggacaccctgggcagaggccccaccctgaaggagaagagcctgggcgccgagatggacagcgtgagaagctgggtgagaaacgtgggcgtggtggacgccaacgtggccgcccagagcggcgtggccctgagcagagcccacttcgagaagcagccccccagcaacctgagaaagagcaacttcttccacttcgtgctggccctgtacgacagacagggccagcccgtggagatcgagagaaccgccttcgtggacttcgtggagaacgacaaggagcagggcaacgagaagaccaacaacggcacccactacaagctgcagctgctgtacagcaacggcgtgagaaccgagcaggacctgtacgtgagactgatcgacagcgtgaccaagcagcccatcgcctacgagggccagaacaagaaccccgagatgtgcagagtgctgctgacccacgaggtgatgtgcagcagatgctgcgagaagaagagctgcggcaacagaaacgagacccccagcgaccccgtgatcatcgacagattcttcctgaagttcttcctgaagtgcaaccagaactgcctgaagaccgccggcaaccccagagacatgagaagattccaggtggtgctgagcaccaccgtgaacgtggacggccacgtgctggccgtgagcgacaacatgttcgtgcacaacaacagcaagcacggcagaagagccagaagactggaccccagcgaggccaccccctgcatcaaggccatcagccccagcgagggctggaccaccggcggcgccatggtgatcatcatcggcgacaacttcttcgacggcctgcaggtggtgttcggcaccatgctggtgtggagcgagctgatcaccccccacgccatcagagtgcagaccccccccagacacatccccggcgtggtggaggtgaccctgagctacaagagcaagcagttctgcaagggcgcccccggcagattcatctacaccgccctgaacgagcccaccatcgactacggcttccagagactgcagaaggtgatccccagacaccccggcgaccccgagagactggccaaggagatgctgctgaagagagccgccgacctggtggaggccctgtacggcaccccccacaacaaccaggacatcatcctgaagagagccgccgacatcgccgaggccctgtacagcgtgcccagaaaccccagccagctgcccgccctgagcagcagccccgcccacagcggcatgatgggcatcaacagctacggcagccagctgggcgtgagcatcagcgagagcacccagggcaacaaccagggctacatcagaaacaccagcagcatcagccccagaggctacagcagcagcagcaccccccagcagagcaactacagcaccagcagcaacagcatgaacggctacagcaacgtgcccatggccaacctgggcgtgcccggcagccccggcttcctgaacggcagccccaccggcagcccctacggcatcatgagcagcagccccaccgtgggcagcagcagcaccagcagcatcctgcccttcagcagcagcgtgttccccgccgtgaagcagaagagcgccttcgcccccgtgatcagaccccagggcagccccagccccgcctgcagcagcggcaacggcaacggcttcagagccatgaccggcctggtggtgccccccatgtag

SEQ ID NO: 80038 - DNA, 795 bp, Artificial Sequence
  Description of Artificial Sequence: Synthetic coding sequence
atggtgatcatcatcggcgacaacttcttcgacggcctgcaggtggtgttcggcaccatgctggtgtggagcgagctgatcaccccccacgccatcagagtgcagaccccccccagacacatccccggcgtggtggaggtgaccctgagctacaagagcaagcagttctgcaagggcgcccccggcagattcatctacaccgccctgaacgagcccaccatcgactacggcttccagagactgcagaaggtgatccccagacaccccggcgaccccgagagactggccaaggagatgctgctgaagagagccgccgacctggtggaggccctgtacggcaccccccacaacaaccaggacatcatcctgaagagagccgccgacatcgccgaggccctgtacagcgtgcccagaaaccccagccagctgcccgccctgagcagcagccccgcccacagcggcatgatgggcatcaacagctacggcagccagctgggcgtgagcatcagcgagagcacccagggcaacaaccagggctacatcagaaacaccagcagcatcagccccagaggctacagcagcagcagcaccccccagcagagcaactacagcaccagcagcaacagcatgaacggctacagcaacgtgcccatggccaacctgggcgtgcccggcagccccggcttcctgaacggcagccccaccggcagcccctacggcaccggcctgtggctgacctggctgctgaaggccttctggggcaagaagagaatcgagaccatccccttcctgtag

SEQ ID NO: 80039 - DNA, 1791 bp, Artificial Sequence
  Description of Artificial Sequence: Synthetic coding sequence
atgttcggcatccaggagaacatccccagaggcggcaccaccatgaaggaggagcccctgggcagcggcatgaaccccgtgagaagctggatgcacaccgccggcgtggtggacgccaacaccgccgcccagagcggcgtgggcctggccagagcccacttcgagaagcagccccccagcaacctgagaaagagcaacttcttccacttcgtgctggccctgtacgacagacagggccagcccgtggagatcgagagaaccgccttcgtggacttcgtggagaaggagaaggagcccaacaacgagaagaccaacaacggcatccactacaagctgcagctgctgtacagcaacggcgtgagaaccgagcaggacctgtacgtgagactgatcgacagcatgaccaagcaggccatcgtgtacgagggccaggacaagaaccccgagatgtgcagagtgctgctgacccacgagatcatgtgcagcagatgctgcgacaagaagagctgcggcaacagaaacgagacccccagcgaccccgtgatcatcgacagattcttcctgaagttcttcctgaagtgcaaccagaactgcctgaagaacgccggcaaccccagagacatgagaagattccaggtggtggtgagcaccaccgtgaacgtggacggccacgtgctggccgtgagcgacaacatgttcgtgcacaacaacagcaagcacggcagaagagccagaagactggaccccagcgagggcaccgcccccagctacctggagaacgccaccccctgcatcaaggccatcagccccagcgagggctggaccaccggcggcgccaccgtgatcatcatcggcgacaacttcttcgacggcctgcaggtggtgttcggcaccatgctggtgtggagcgagctgatcaccccccacgccatcagagtgcagaccccccccagacacatccccggcgtggtggaggtgaccctgagctacaagagcaagcagttctgcaagggcgcccccggcagattcgtgtacaccgccctgaacgagcccaccatcgactacggcttccagagactgcagaaggtgatccccagacaccccggcgaccccgagagactgcccaaggaggtgctgctgaagagagccgccgacctggtggaggccctgtacggcatgccccacaacaaccaggagatcatcctgaagagagccgccgacatcgccgaggccctgtacagcgtgcccagaaaccacaaccagatccccaccctgggcaacaaccccgcccacaccggcatgatgggcgtgaacagcttcagcagccagctggccgtgaacgtgagcgagaccagccaggccaacgaccaggtgggctacagcagaaacaccagcagcgtgagccccagaggctacgtgcccagcagcaccccccagcagagcaactacaacaccgtgagcaccagcatgaacggctacggcagcggcgccatggccagcctgggcgtgcccggcagccccggcttcctgaacggcagcagcgccaacagcccctacggcatcgtgcccagcagccccaccatggccgccagcagcgtgaccctgcccagcaactgcagcagcacccacggcatcttcagcttcagccccgccaacgtgatcagcgccgtgaagcagaagagcgccttcgcccccgtggtgagaccccaggccagccccccccccagctgcaccagcgccaacggcaacggcctgcaggccatgagcggcctggtggtgccccccatgtag

SEQ ID NO: 80040 - DNA, 1656 bp, Artificial Sequence
  Description of Artificial Sequence: Synthetic coding sequence
atgttcggcatccaggagaacatccccagaggcggcaccaccatgaaggaggagcccctgggcagcggcatgaaccccgtgagaagctggatgcacaccgccggcgtggtggacgccaacaccgccgcccagagcggcgtgggcctggccagagcccacttcgagaagcagccccccagcaacctgagaaagagcaacttcttccacttcgtgctggccctgtacgacagacagggccagcccgtggagatcgagagaaccgccttcgtggacttcgtggagaaggagaaggagcccaacaacgagaagaccaacaacggcatccactacaagctgcagctgctgtacagcaacggcgtgagaaccgagcaggacctgtacgtgagactgatcgacagcatgaccaagcaggccatcgtgtacgagggccaggacaagaaccccgagatgtgcagagtgctgctgacccacgagatcatgtgcagcagatgctgcgacaagaagagctgcggcaacagaaacgagacccccagcgaccccgtgatcatcgacagattcttcctgaagttcttcctgaagtgcaaccagaactgcctgaagaacgccggcaaccccagagacatgagaagattccaggtggtggtgagcaccaccgtgaacgtggacggccacgtgctggccgtgagcgacaacatgttcgtgcacaacaacagcaagcacggcagaagagccagaagactggaccccagcgaggccaccccctgcatcaaggccatcagccccagcgagggctggaccaccggcggcgccaccgtgatcatcatcggcgacaacttcttcgacggcctgcaggtggtgttcggcaccatgctggtgtggagcgagctgatcaccccccacgccatcagagtgcagaccccccccagacacatccccggcgtggtggaggtgaccctgagctacaagagcaagcagttctgcaagggcgcccccggcagattcgtgtacaccgccctgaacgagcccaccatcgactacggcttccagagactgcagaaggtgatccccagacaccccggcgaccccgagagactgcccaaggaggtgctgctgaagagagccgccgacctggtggaggccctgtacggcatgccccacaacaaccaggagatcatcctgaagagagccgccgacatcgccgaggccctgtacagcgtgcccagaaaccacaaccagatccccaccctgggcaacaaccccgcccacaccggcatgatgggcgtgaacagcttcagcagccagctggccgtgaacgtgagcgagaccagccaggccaacgaccaggtgggctacagcagaaacaccagcagcgtgagccccagaggctacgtgcccagcagcaccccccagcagagcaactacaacaccgtgagcaccagcatgaacggctacggcagcggcgccatggccagcctgggcgtgcccggcagccccggcttcctgaacggcagcagcgccaacagcccctacggcatgaagcagaagagcgccttcgcccccgtggtgagaccccaggccagccccccccccagctgcaccagcgccaacggcaacggcctgcaggccatgagcggcctggtggtgccccccatgtag

SEQ ID NO: 80041 - DNA, 576 bp, Artificial Sequence
  Description of Artificial Sequence: Synthetic coding sequence
tgattcagcagccagctggccgtgaacgtgagcgagaccagccaggccaacgaccaggtgggctacagcagaaacaccagcagcgtgagccccagaggctacgtgcccagcagcaccccccagcagagcaactacaacaccgtgagcaccagcatgaacggctacggcagcggcgccatggccagcctgggcgtgcccggcagccccggcttcctgaacggcagcagcgccaacagcccctacggcatcgtgcccagcagccccaccatggccgccagcagcgtgaccctgcccagcaactgcagcagcacccacggcatcttcagcttcagccccgccaacgtgatcagcgccgtgaagcagaagagcgccttcgcccccgtggtgagaccccaggccagccccccccccagctgcaccagcgccaacggcaacggcctgcagggcagcctgctgggcgccgaggacgtggccgccgagaagaccaactggcccttctgcgaggtgggcggcatcttccacttcgacgagctgatgctgaagaagggcaccggcaagctgtgcctgggctggtag

SEQ ID NO: 80042 - DNA, 1809 bp, Artificial Sequence
  Description of Artificial Sequence: Synthetic coding sequence
atgttccccgcccaggacgccctgcccagaagcggcctgaacctgaaggaggagcccctgctgcccgccggcctgggcagcgtgagaagctggatgcagggcgccggcatcctggacgccagcaccgccgcccagagcggcgtgggcctggccagagcccacttcgagaagcagccccccagcaacctgagaaagagcaacttcttccacttcgtgctggccatgtacgacagacagggccagcccgtggaggtggagagaaccgccttcatcgacttcgtggagaaggacagagagcccggcgccgagaagaccaacaacggcatccactacagactgagactggtgtacaacaacggcctgagaaccgagcaggacctgtacgtgagactgatcgacagcatgagcaagcaggccatcatctacgagggccaggacaagaaccccgagatgtgcagagtgctgctgacccacgagatcatgtgcagcagatgctgcgacagaaagagctgcggcaacagaaacgagacccccagcgaccccgtgatcatcgacagattcttcctgaagttcttcctgaagtgcaaccagaactgcctgaagaacgccggcaaccccagagacatgagaagattccaggtggtggtgagcaccaccgtgagcgtggacggccacgtgctggccgtgagcgacaacatgttcgtgcacaacaacagcaagcacggcagaagagccagaagactggaccccagcgaggccgccaccccctgcatcaaggccatcagccccggcgagggctggaccaccggcggcgccaccgtgatcgtgatcggcgacaacttcttcgacggcctgcaggtggtgttcggcaacgtgctggtgtggagcgagctgatcaccccccacgccatcagagtgcagaccccccccagacacatccccggcgtggtggaggtgaccctgagctacaagagcaagcagttctgcaagggctgccccggcagattcgtgtacaccgccctgaacgagcccaccatcgactacggcttccagagactgcagaaggtgatccccagacaccccggcgaccccgagagactgcccaaggaggtgctgctgaagagagccgccgacctggccgaggccctgtacggcgtgcccggcagcaaccaggagctgctgctgaagagagccgccgacgtggccgaggccctgtacagcacccccagagcccccggccccctggcccccctggcccccagccacccccaccccgccgtggtgggcatcaacgccttcagcagccccctggccatcgccgtgggcgacgccacccccggccccgagcccggctacgccagaagctgcagcagcgccagccccagaggcttcgcccccagccccggcagccagcagagcggctacggcggcggcctgggcgccggcctgggcggctacggcgcccccggcgtggccggcctgggcgtgcccggcagccccagcttcctgaacggcagcaccgccaccagccccttcgccatcatgcccagcagcccccccctggccgccgccagcagcatgagcctgcccgccgccgcccccaccaccagcgtgttcagcttcagccccgtgaacatgatcagcgccgtgaagcagagaagcgccttcgcccccgtgctgagaccccccagcagccccccccaggcctgccccagagcccacggcgagggcctgcccgaccagagcttcgaggacagcgacaagttccacagccccgccagaggcctgcagggcctggcctacagctag

SEQ ID NO: 80043 - DNA, 1797 bp, Artificial Sequence
  Description of Artificial Sequence: Synthetic coding sequence
atggacgccctgcccagaagcggcctgaacctgaaggaggagcccctgctgcccgccggcctgggcagcgtgagaagctggatgcagggcgccggcatcctggacgccagcaccgccgcccagagcggcgtgggcctggccagagcccacttcgagaagcagccccccagcaacctgagaaagagcaacttcttccacttcgtgctggccatgtacgacagacagggccagcccgtggaggtggagagaaccgccttcatcgacttcgtggagaaggacagagagcccggcgccgagaagaccaacaacggcatccactacagactgagactggtgtacaacaacggcctgagaaccgagcaggacctgtacgtgagactgatcgacagcatgagcaagcaggccatcatctacgagggccaggacaagaaccccgagatgtgcagagtgctgctgacccacgagatcatgtgcagcagatgctgcgacagaaagagctgcggcaacagaaacgagacccccagcgaccccgtgatcatcgacagattcttcctgaagttcttcctgaagtgcaaccagaactgcctgaagaacgccggcaaccccagagacatgagaagattccaggtggtggtgagcaccaccgtgagcgtggacggccacgtgctggccgtgagcgacaacatgttcgtgcacaacaacagcaagcacggcagaagagccagaagactggaccccagcgaggccgccaccccctgcatcaaggccatcagccccggcgagggctggaccaccggcggcgccaccgtgatcgtgatcggcgacaacttcttcgacggcctgcaggtggtgttcggcaacgtgctggtgtggagcgagctgatcaccccccacgccatcagagtgcagaccccccccagacacatccccggcgtggtggaggtgaccctgagctacaagagcaagcagttctgcaagggctgccccggcagattcgtgtacaccgccctgaacgagcccaccatcgactacggcttccagagactgcagaaggtgatccccagacaccccggcgaccccgagagactgcccaaggaggtgctgctgaagagagccgccgacctggccgaggccctgtacggcgtgcccggcagcaaccaggagctgctgctgaagagagccgccgacgtggccgaggccctgtacagcacccccagagcccccggccccctggcccccctggcccccagccacccccaccccgccgtggtgggcatcaacgccttcagcagccccctggccatcgccgtgggcgacgccacccccggccccgagcccggctacgccagaagctgcagcagcgccagccccagaggcttcgcccccagccccggcagccagcagagcggctacggcggcggcctgggcgccggcctgggcggctacggcgcccccggcgtggccggcctgggcgtgcccggcagccccagcttcctgaacggcagcaccgccaccagccccttcgccatcatgcccagcagcccccccctggccgccgccagcagcatgagcctgcccgccgccgcccccaccaccagcgtgttcagcttcagccccgtgaacatgatcagcgccgtgaagcagagaagcgccttcgcccccgtgctgagaccccccagcagccccccccaggcctgccccagagcccacggcgagggcctgcccgaccagagcttcgaggacagcgacaagttccacagccccgccagaggcctgcagggcctggcctacagctag

SEQ ID NO: 80044 - DNA, 555 bp, Artificial Sequence
  Description of Artificial Sequence: Synthetic coding sequence
agaggcagcgtgcagcacccccccgtggtgggcatcaacgccttcagcagccccctggccatcgccgtgggcgacgccacccccggccccgagcccggctacgccagaagctgcagcagcgccagccccagaggcttcgcccccagccccggcagccagcagagcggctacggcggcggcctgggcgccggcctgggcggctacggcgcccccggcgtggccggcctgggcgtgcccggcagccccagcttcctgaacggcagcaccgccaccagccccttcgccatcatgcccagcagcccccccctggccgccgccagcagcatgagcctgcccgccgccgcccccaccaccagcgtgttcagcttcagccccgtgaacatgatcagcgccgtgaagcagagaagcgccttcgcccccgtgctgagaccccccagcagccccccccaggcctgccccagagcccacggcgagggcctgcccgaccagagcttcgaggacagcgacaagttccacagccccgccagaggcctgcagggcctggcctacagctag

SEQ ID NO: 80045 - DNA, 1632 bp, Artificial Sequence
  Description of Artificial Sequence: Synthetic coding sequence
atggccgccgccaaggccgagatgcagctgatgagccccctgcagatcagcgaccccttcggcagcttcccccacagccccaccatggacaactaccccaagctggaggagatgatgctgctgagcaacggcgccccccagttcctgggcgccgccggcgcccccgagggcagcggcagcaacagcagcagcagcagcagcggcggcggcggcggcggcggcggcggcagcaacagcagcagcagcagcagcaccttcaacccccaggccgacaccggcgagcagccctacgagcacctgaccgccgagagcttccccgacatcagcctgaacaacgagaaggtgctggtggagaccagctaccccagccagaccaccagactgccccccatcacctacaccggcagattcagcctggagcccgcccccaacagcggcaacaccctgtggcccgagcccctgttcagcctggtgagcggcctggtgagcatgaccaacccccccgccagcagcagcagcgcccccagccccgccgccagcagcgccagcgccagccagagcccccccctgagctgcgccgtgcccagcaacgacagcagccccatctacagcgccgcccccaccttccccacccccaacaccgacatcttccccgagccccagagccaggccttccccggcagcgccggcaccgccctgcagtaccccccccccgcctaccccgccgccaagggcggcttccaggtgcccatgatccccgactacctgttcccccagcagcagggcgacctgggcctgggcacccccgaccagaagcccttccagggcctggagagcagaacccagcagcccagcctgacccccctgagcaccatcaaggccttcgccacccagagcggcagccaggacctgaaggccctgaacaccagctaccagagccagctgatcaagcccagcagaatgagaaagtaccccaacagacccagcaagacccccccccacgagagaccctacgcctgccccgtggagagctgcgacagaagattcagcagaagcgacgagctgaccagacacatcagaatccacaccggccagaagcccttccagtgcagaatctgcatgagaaacttcagcagaagcgaccacctgaccacccacatcagaacccacaccggcgagaagcccttcgcctgcgacatctgcggcagaaagttcgccagaagcgacgagagaaagagacacaccaagatccacctgagacagaaggacaagaaggccgacaagagcgtggtggccagcagcgccaccagcagcctgagcagctaccccagccccgtggccaccagctaccccagccccgtgaccaccagctaccccagccccgccaccaccagctaccccagccccgtgcccaccagcttcagcagccccggcagcagcacctaccccagccccgtgcacagcggcttccccagccccagcgtggccaccacctacagcagcgtgccccccgccttccccgcccaggtgagcagcttccccagcagcgccgtgaccaacagcttcagcgccagcaccggcctgagcgacatgaccgccaccttcagccccagaaccatcgagatctgctag

SEQ ID NO: 80046 - DNA, 603 bp, Artificial Sequence
  Description of Artificial Sequence: Synthetic coding sequence
atggccgccgccaaggccgagatgcagctgatgagccccctgcagatcagcgaccccttcggcagcttcccccacagccccaccatggacaactaccccaagctggaggagatgatgctgctgagcaacggcgccccccagttcctgggcgccgccggcgcccccgagggcagcggcagcaacagcagcagcagcagcagcggcggcggcggcggcggcggcggcggcagcaacagcagcagcagcagcagcaccttcaacccccaggccgacaccggcgagcagccctacgagcacctgaccgccgagagcttccccgacatcagcctgaacaacgagaaggtgctggtggagaccagctaccccagccagaccaccagactgccccccatcacctacaccggcagattcagcctggagcccgcccccaacagcggcttccccagccccagcgtggccaccacctacagcagcgtgccccccgccttccccgcccaggtgagcagcttccccagcagcgccgtgaccaacagcttcagcgccagcaccggcctgagcgacatgaccgccaccttcagccccagaaccatcgagatctgctag

SEQ ID NO: 80047 - DNA, 699 bp, Artificial Sequence
  Description of Artificial Sequence: Synthetic coding sequence
atggccgccgccaaggccgagatgcagctgatgagccccctgcagatcagcgaccccttcggcagcttcccccacagccccaccatggacaactaccccaagctggaggagatgatgctgctgagcaacggcgccccccagttcctgggcgccgccggcgcccccgagggcagcggcagcaacagcagcagcagcagcagcggcggcggcggcggcggcggcggcggcagcaacagcagcagcagcagcagcaccttcaacccccaggccgacaccggcgagcagccctacgagcacctgaccgccgagagcttccccgacatcagcctgaacaacgagaaggtgctggtggagaccagctaccccagccagaccaccagactgccccccatcacctacaccggcagattcagcctggagcccgcccccaacagcggcaacaccctgtggcccgagcccctgttcagcctggtgagcggcctggtgagcatgaccaacccccccgccagcagcagcagcgcccccagccccgccgccagcagcgccagcgccagccagagcccccccctgagctgcgccgtgcccagcaacgacagcagccccatctacagcgccgcccccaccttccccacccccaacaccgacatcttccccgagaccgccatgagcaagttcttcaccagcatccagagaacctag

SEQ ID NO: 80048 - DNA, 1431 bp, Artificial Sequence
  Description of Artificial Sequence: Synthetic coding sequence
atgatgaccgccaaggccgtggacaagatccccgtgaccctgagcggcttcgtgcaccagctgagcgacaacatctaccccgtggaggacctggccgccaccagcgtgaccatcttccccaacgccgagctgggcggccccttcgaccagatgaacggcgtggccggcgacggcatgatcaacatcgacatgaccggcgagaagagaagcctggacctgccctaccccagcagcttcgcccccgtgagcgcccccagaaaccagaccttcacctacatgggcaagttcagcatcgacccccagtaccccggcgccagctgctaccccgagggcatcatcaacatcgtgagcgccggcatcctgcagggcgtgaccagccccgccagcaccaccgccagcagcagcgtgaccagcgccagccccaaccccctggccaccggccccctgggcgtgtgcaccatgagccagacccagcccgacctggaccacctgtacagcccccccccccccccccccccctacagcggctgcgccggcgacctgtaccaggaccccagcgccttcctgagcgccgccaccaccagcaccagcagcagcctggcctacccccccccccccagctaccccagccccaagcccgccaccgaccccggcctgttccccatgatccccgactaccccggcttcttccccagccagtgccagagagacctgcacggcaccgccggccccgacagaaagcccttcccctgccccctggacaccctgagagtgcccccccccctgacccccctgagcaccatcagaaacttcaccctgggcggccccagcgccggcgtgaccggccccggcgccagcggcggcagcgagggccccagactgcccggcagcagcagcgccgccgccgccgccgccgccgccgccgcctacaacccccaccacctgcccctgagacccatcctgagacccagaaagtaccccaacagacccagcaagacccccgtgcacgagagaccctacccctgccccgccgagggctgcgacagaagattcagcagaagcgacgagctgaccagacacatcagaatccacaccggccacaagcccttccagtgcagaatctgcatgagaaacttcagcagaagcgaccacctgaccacccacatcagaacccacaccggcgagaagcccttcgcctgcgactactgcggcagaaagttcgccagaagcgacgagagaaagagacacaccaagatccacctgagacagaaggagagaaagagcagcgcccccagcgccagcgtgcccgcccccagcaccgccagctgcagcggcggcgtgcagcccggcggcaccctgtgcagcagcaacagcagcagcctgggcggcggccccctggccccctgcagcagcagaaccagaaccccctag

SEQ ID NO: 80049 - DNA, 1281 bp, Artificial Sequence
  Description of Artificial Sequence: Synthetic coding sequence
atgaacggcgtggccggcgacggcatgatcaacatcgacatgaccggcgagaagagaagcctggacctgccctaccccagcagcttcgcccccgtgagcgcccccagaaaccagaccttcacctacatgggcaagttcagcatcgacccccagtaccccggcgccagctgctaccccgagggcatcatcaacatcgtgagcgccggcatcctgcagggcgtgaccagccccgccagcaccaccgccagcagcagcgtgaccagcgccagccccaaccccctggccaccggccccctgggcgtgtgcaccatgagccagacccagcccgacctggaccacctgtacagcccccccccccccccccccccctacagcggctgcgccggcgacctgtaccaggaccccagcgccttcctgagcgccgccaccaccagcaccagcagcagcctggcctacccccccccccccagctaccccagccccaagcccgccaccgaccccggcctgttccccatgatccccgactaccccggcttcttccccagccagtgccagagagacctgcacggcaccgccggccccgacagaaagcccttcccctgccccctggacaccctgagagtgcccccccccctgacccccctgagcaccatcagaaacttcaccctgggcggccccagcgccggcgtgaccggccccggcgccagcggcggcagcgagggccccagactgcccggcagcagcagcgccgccgccgccgccgccgccgccgccgcctacaacccccaccacctgcccctgagacccatcctgagacccagaaagtaccccaacagacccagcaagacccccgtgcacgagagaccctacccctgccccgccgagggctgcgacagaagattcagcagaagcgacgagctgaccagacacatcagaatccacaccggccacaagcccttccagtgcagaatctgcatgagaaacttcagcagaagcgaccacctgaccacccacatcagaacccacaccggcgagaagcccttcgcctgcgactactgcggcagaaagttcgccagaagcgacgagagaaagagacacaccaagatccacctgagacagaaggagagaaagagcagcgcccccagcgccagcgtgcccgcccccagcaccgccagctgcagcggcggcgtgcagcccggcggcaccctgtgcagcagcaacagcagcagcctgggcggcggccccctggccccctgcagcagcagaaccagaaccccctag

SEQ ID NO: 80050 - DNA, 786 bp, Artificial Sequence
  Description of Artificial Sequence: Synthetic coding sequence
atgagagtgggcctgcccagcgaggccagcagctgcccctggagcgccagaggccccagagacccccccgagagaagaagaagcggcctggcccacgtgctgagcgacaacatctaccccgtggaggacctggccgccaccagcgtgaccatcttccccaacgccgagctgggcggccccttcgaccagatgaacggcgtggccggcgacggcatgatcaacatcgacatgaccggcgagaagagaagcctggacctgccctaccccagcagcttcgcccccgtgagcgcccccagaaaccagaccttcacctacatgggcaagttcagcatcgacccccagtaccccggcgccagctgctaccccgagggcatcatcaacatcgtgagcgccggcatcctgcagggcgtgaccagccccgccagcaccaccgccagcagcagcgtgaccagcgccagccccaaccccctggccaccggccccctgggcgtgtgcaccatgagccagacccagcccgacctggaccacctgtacagcccccccccccccccccccccctacagcggctgcgccggcgacctgtaccaggaccccagcgccttcctgagcgccgccaccaccagcaccagcagcagcctggcctacccccccccccccagctaccccagccccaagcccgtggaggccgccagagaccccggctgcctggtggccgcccagcagcagcagcagccccccccccccccccccatcacccacaccacctgccactgcggccccttctag

SEQ ID NO: 80051 - DNA, 1431 bp, Artificial Sequence; identical to SEQ ID NO: 80048
  Description of Artificial Sequence: Synthetic coding sequence

SEQ ID NO: 80052 - DNA, 1461 bp, Artificial Sequence
  Description of Artificial Sequence: Synthetic coding sequence
atgctgcacctgagcgagttcagcgagcccgacgccctgctggtgaagagcaccgagggctgctgcgccgagcccagcgccgagctgcccagactgcccgccagagacgcccccgccgccaccggctaccccggcgccggcgacttcctgagctgggccctgaacagctgcggcgccagcggcgacctggccgacagctgcttcctggagggccccgcccccacccccccccccggcctgagctacagcggcagcttcttcatccaggccgtgcccgagcacccccacgaccccgaggccctgttcaacctgatgagcggcatcctgggcctggcccccttccccggccccgaggccgccgccagcagaagccccctggacgcccccttccccgccggcagcgacgccctgctgcccggcccccccgacctgtacagccccgacctgggcgccgcccccttccccgaggccttctgggaggccagcccctgcgccggcgcccccagccagtgcctgtacgagccccagctgagcccccccgacgtgaagcccggcctgagagccccccccgccagccccgccctggacgccgtgagcgccttcaagggcccctacgccccctgggagctgctgagcgtgggcgcccccggcaactgcggcagccagggcgactaccaggccgcccccgaggccagattccccgtgatcggcaccaagatcgaggacctgctgagcatcagctgccccgccgagctgcccgccgtgcccgccaacagactgtaccccagcggcgcctacgacgccttccccctggcccccggcgacctgggcgagggcgccgagggcctgcccggcctgctgaccccccccagcggcgagggcggcagcagcggcgacggcggcgagttcctggccagcacccagccccagctgagccccctgggcctgagaagcgccgccgccgccgacttccccaagcccctggtggccgacatccccggcagcagcggcgtggccgccccccccgtgcccccccccccccccacccccttcccccaggccaaggccagaagaaagggcagaagaggcggcaagtgcagcaccagatgcttctgccccagaccccacgccaaggccttcgcctgccccgtggagagctgcgtgagaagcttcgccagaagcgacgagctgaacagacacctgagaatccacaccggccacaagcccttccagtgcagaatctgcctgagaaacttcagcagaagcgaccacctgaccacccacgtgagaacccacaccggcgagaagcccttcgcctgcgacgtgtgcggcagaagattcgccagaagcgacgagaagaagagacacagcaaggtgcacctgaagcagaaggccagagccgaggagagactgaagggcctgggcttctacagcctgggcctgagcttcgccagcctgtag

SEQ ID NO: 80053 - DNA, 1770 bp, Artificial Sequence
  Description of Artificial Sequence: Synthetic coding sequence
atggccgtggccagaggcgtgggcagccccgagcccgcccccccccagctgtacaagtggggcggctgcggcctgggcgagcccggcagcgccctggagagaagaggcgccgccgccagaggcagatgcggcagagccagagcccccagactgcccgacagcttccccagaggcgagtgccccaagcccggcgccagagcccccagaagcgtgagatgcggcgagcccctgccccccgccagccccccccccgccagaccccaggcccagagagccagacccagagccccccacagcagaagaagagccatgctgcacctgagcgagttcagcgagcccgacgccctgctggtgaagagcaccgagggctgctgcgccgagcccagcgccgagctgcccagactgcccgccagagacgcccccgccgccaccggctaccccggcgccggcgacttcctgagctgggccctgaacagctgcggcgccagcggcgacctggccgacagctgcttcctggagggccccgcccccacccccccccccggcctgagctacagcggcagcttcttcatccaggccgtgcccgagcacccccacgaccccgaggccctgttcaacctgatgagcggcatcctgggcctggcccccttccccggccccgaggccgccgccagcagaagccccctggacgcccccttccccgccggcagcgacgccctgctgcccggcccccccgacctgtacagccccgacctgggcgccgcccccttccccgaggccttctgggaggccagcccctgcgccggcgcccccagccagtgcctgtacgagccccagctgagcccccccgacgtgaagcccggcctgagagccccccccgccagccccgccctggacgccgtgagcgccttcaagggcccctacgccccctgggagctgctgagcgtgggcgcccccggcaactgcggcagccagggcgactaccaggccgcccccgaggccagattccccgtgatcggcaccaagatcgaggacctgctgagcatcagctgccccgccgagctgcccgccgtgcccgccaacagactgtaccccagcggcgcctacgacgccttccccctggcccccggcgacctgggcgagggcgccgagggcctgcccggcctgctgaccccccccagcggcgagggcggcagcagcggcgacggcggcgagttcctggccagcacccagccccagctgagccccctgggcctgagaagcgccgccgccgccgacttccccaagcccctggtggccgacatccccggcagcagcggcgtggccgccccccccgtgcccccccccccccccacccccttcccccaggccaaggccagaagaaagggcagaagaggcggcaagtgcagcaccagatgcttctgccccagaccccacgccaaggccttcgcctgccccgtggagagctgcgtgagaagcttcgccagaagcgacgagctgaacagacacctgagaatccacaccggccacaagcccttccagtgcagaatctgcctgagaaacttcagcagaagcgaccacctgaccacccacgtgagaacccacaccggcgagaagcccttcgcctgcgacgtgtgcggcagaagattcgccagaagcgacgagaagaagagacacagcaaggtgcacctgaagcagaaggccagagccgaggagagactgaagggcctgggcttctacagcctgggcctgagcttcgccagcctgtag

SEQ ID NO: 80054 - DNA, 921 bp, Artificial Sequence
  Description of Artificial Sequence: Synthetic coding sequence
atggacaccccccccctgagcgacagcgagagcgagagcgacgagagcctggtgaccgacagagagctgcaggacgccttcagcagaggcctgctgaagcccggcctgaacgtggtgctggagggccccaagaaggccgtgaacgacgtgaacggcctgaagcagtgcctggccgagttcaagagagacctggagtgggtggagagactggacgtgaccctgggccccgtgcccgagatcggcggcagcgaggcccccgccccccagaacaaggaccagaaggccgtggaccccgaggacgacttccagagagagatgagcttctacagacaggcccaggccgccgtgctggccgtgctgcccagactgcaccagctgaaggtgcccaccaagagacccaccgactacttcgccgagatggccaagagcgacctgcagatgcagaagatcagacagaagctgcagaccaagcaggccgccatggagagaagcgagaaggccaagcagctgagagccctgagaaagtacggcaagaaggtgcagaccgaggtgctgcagaagagacagcaggagaaggcccacatgatgaacgccatcaagaagtaccagaagggcttcagcgacaagctggacttcctggagggcgaccagaagcccctggcccagagaaagaaggccggcgccaagggccagcagatgagaaagggccccagcgccaagagaagatacaagaaccagaagttcggcttcggcggcaagaagaagggcagcaagtggaacaccagagagagctacgacgacgtgagcagcttcagagccaagaccgcccacggcagaggcctgaagagacccggcaagaagggcagcaacaagagacccggcaagagaaccagagagaagatgaagaacagaacccactag

SEQ ID NO: 80055 - DNA, 1086 bp, Artificial Sequence
  Description of Artificial Sequence: Synthetic coding sequence
atgtaccccgaggccctgcccgtgggcatcctgagcaaccccgacaccttcaagagaagaagcggcagctacagcaacgacaagcccgaggtgtggttcgccgccggcagcggcagccccaaccagaagctgagcagcagctgcgtgggcagagcctgcggcgagatggacaccccccccctgagcgacagcgagagcgagagcgacgagagcctggtgaccgacagagagctgcaggacgccttcagcagaggcctgctgaagcccggcctgaacgtggtgctggagggccccaagaaggccgtgaacgacgtgaacggcctgaagcagtgcctggccgagttcaagagagacctggagtgggtggagagactggacgtgaccctgggccccgtgcccgagatcggcggcagcgaggcccccgccccccagaacaaggaccagaaggccgtggaccccgaggacgacttccagagagagatgagcttctacagacaggcccaggccgccgtgctggccgtgctgcccagactgcaccagctgaaggtgcccaccaagagacccaccgactacttcgccgagatggccaagagcgacctgcagatgcagaagatcagacagaagctgcagaccaagcaggccgccatggagagaagcgagaaggccaagcagctgagagccctgagaaagtacggcaagaaggtgcagaccgaggtgctgcagaagagacagcaggagaaggcccacatgatgaacgccatcaagaagtaccagaagggcttcagcgacaagctggacttcctggagggcgaccagaagcccctggcccagagaaagaaggccggcgccaagggccagcagatgagaaagggccccagcgccaagagaagatacaagaaccagaagttcggcttcggcggcaagaagaagggcagcaagtggaacaccagagagagctacgacgacgtgagcagcttcagagccaagaccgcccacggcagaggcctgaagagacccggcaagaagggcagcaacaagagacccggcaagagaaccagagagaagatgaagaacagaacccactag

SEQ ID NO: 80056 - DNA, 2448 bp, Artificial Sequence
  Description of Artificial Sequence: Synthetic coding sequence
atggaggacggcttcagcagctacagcagcctgtacgacaccagcagcctgctgcagttctgcaacgacgacagcgccagcgccgccagcagcatggaggtgaccgacagaatcgccagcctggagcagagagtgcagatgcaggaggacgacatccagctgctgaagagcgccctggccgacgtggtgagaagactgaacatcaccgaggagcagcaggccgtgctgaacagaaagggccccaccaaggccagacccctgatgcagaccctgcccctgagaaccaccgtgaacaacggcaccgtgctgcccaagaagcccaccggcagcctgcccagccccagcggcgtgagaaaggagaccgccgtgcccgccaccaagagcaacatcaagagaaccagcagcagcgagagagtgagccccggcggcagaagagagagcaacggcgacagcagaggcaacagaaacagaaccggcagcaccagcagcagcagcagcggcaagaagaacagcgagagcaagcccaaggagcccgtgttcagcgccgaggagggctacgtgaagatgttcctgagaggcagacccgtgaccatgtacatgcccaaggaccaggtggacagctacagcctggaggccaaggtggagctgcccaccaagagactgaagctggagtgggtgtacggctacagaggcagagactgcagaaacaacctgtacctgctgcccaccggcgagaccgtgtacttcatcgccagcgtggtggtgctgtacaacgtggaggagcagctgcagagacactacgccggccacaacgacgacgtgaagtgcctggccgtgcaccccgacagaatcaccatcgccaccggccaggtggccggcaccagcaaggacggcaagcagctgcccccccacgtgagaatctgggacagcgtgaccctgaacaccctgcacgtgatcggcatcggcttcttcgacagagccgtgacctgcatcgccttcagcaagagcaacggcggcaccaacctgtgcgccgtggacgacagcaacgaccacgtgctgagcgtgtgggactggcagaaggaggagaagctggccgacgtgaagtgcagcaacgaggccgtgttcgccgccgacttccaccccaccgacaccaacatcatcgtgacctgcggcaagagccacctgtacttctggaccctggagggcagcagcctgaacaagaagcagggcctgttcgagaagcaggagaagcccaagttcgtgctgtgcgtgaccttcagcgagaacggcgacaccatcaccggcgacagcagcggcaacatcctggtgtggggcaagggcaccaacagaatcagctacgccgtgcagggcgcccacgagggcggcatcttcgccctgtgcatgctgagagacggcaccctggtgagcggcggcggcaaggacagaaagctgatcagctggagcggcaactaccagaagctgagaaagaccgagatccccgagcagttcggccccatcagaaccgtggccgagggcaagggcgacgtgatcctgatcggcaccaccagaaacttcgtgctgcagggcaccctgagcggcgacttcacccccatcacccagggccacaccgacgagctgtggggcctggccatccacgccagcaagagccagttcctgacctgcggccacgacaagcacgccaccctgtgggacgccgtgggccacagacccgtgtgggacaagatcatcgaggaccccgcccagagcagcggcttccaccccagcggcagcgtggtggccgtgggcaccctgaccggcagatggttcgtgttcgacaccgagaccaaggacctggtgaccgtgcacaccgacggcaacgagcagctgagcgtgatgagatacagccccgacggcaacttcctggccatcggcagccacgacaactgcatctacatctacggcgtgagcgacaacggcagaaagtacaccagagtgggcaagtgcagcggccacagcagcttcatcacccacctggactggagcgtgaacagccagttcctggtgagcaacagcggcgactacgagatcctgtactgggtgcccagcgcctgcaagcaggtggtgagcgtggagaccaccagagacatcgagtgggccacctacacctgcaccctgggcttccacgtgttcggcgtgtggcccgagggcagcgacggcaccgacatcaacgccgtgtgcagagcccacgagaagaagctgctgagcaccggcgacgacttcggcaaggtgcacctgttcagctacccctgcagccagttcagagcccccagccacatctacggcggccacagcagccacgtgaccaacgtggacttcctgtgcgaggacagccacctgatcagcaccggcggcaaggacaccagcatcatgcagtggagagtgatctag

SEQ ID NO: 80057 - DNA, 2505 bp, Artificial Sequence
  Description of Artificial Sequence: Synthetic coding sequence
atggaggacggcttcagcagctacagcagcctgtacgacaccagcagcctgctgcagttctgcaacgacgacagcgccagcgccgccagcagcatggaggtgaccgacagaatcgccagcctggagcagagagtgcagatgcaggaggacgacatccagctgctgaagagcgccctggccgacgtggtgagaagactgaacatcaccgaggagcagcaggccgtgctgaacagaaagggccccaccaaggccagacccctgatgcagaccctgcccctgagaaccaccgtgaacaacggcaccgtgctgcccaagaagcccaccggcagcctgcccagccccagcggcgtgagaaaggagaccgccgtgcccgccaccaagagactgaacagaagcgtgagcctgctgaacgcctgcaagctgaacagaagcacccccagcaacatcaagagaaccagcagcagcgagagagtgagccccggcggcagaagagagagcaacggcgacagcagaggcaacagaaacagaaccggcagcaccagcagcagcagcagcggcaagaagaacagcgagagcaagcccaaggagcccgtgttcagcgccgaggagggctacgtgaagatgttcctgagaggcagacccgtgaccatgtacatgcccaaggaccaggtggacagctacagcctggaggccaaggtggagctgcccaccaagagactgaagctggagtgggtgtacggctacagaggcagagactgcagaaacaacctgtacctgctgcccaccggcgagaccgtgtacttcatcgccagcgtggtggtgctgtacaacgtggaggagcagctgcagagacactacgccggccacaacgacgacgtgaagtgcctggccgtgcaccccgacagaatcaccatcgccaccggccaggtggccggcaccagcaaggacggcaagcagctgcccccccacgtgagaatctgggacagcgtgaccctgaacaccctgcacgtgatcggcatcggcttcttcgacagagccgtgacctgcatcgccttcagcaagagcaacggcggcaccaacctgtgcgccgtggacgacagcaacgaccacgtgctgagcgtgtgggactggcagaaggaggagaagctggccgacgtgaagtgcagcaacgaggccgtgttcgccgccgacttccaccccaccgacaccaacatcatcgtgacctgcggcaagagccacctgtacttctggaccctggagggcagcagcctgaacaagaagcagggcctgttcgagaagcaggagaagcccaagttcgtgctgtgcgtgaccttcagcgagaacggcgacaccatcaccggcgacagcagcggcaacatcctggtgtggggcaagggcaccaacagaatcagctacgccgtgcagggcgcccacgagggcggcatcttcgccctgtgcatgctgagagacggcaccctggtgagcggcggcggcaaggacagaaagctgatcagctggagcggcaactaccagaagctgagaaagaccgagatccccgagcagttcggccccatcagaaccgtggccgagggcaagggcgacgtgatcctgatcggcaccaccagaaacttcgtgctgcagggcaccctgagcggcgacttcacccccatcacccagggccacaccgacgagctgtggggcctggccatccacgccagcaagagccagttcctgacctgcggccacgacaagcacgccaccctgtgggacgccgtgggccacagacccgtgtgggacaagatcatcgaggaccccgcccagagcagcggcttccaccccagcggcagcgtggtggccgtgggcaccctgaccggcagatggttcgtgttcgacaccgagaccaaggacctggtgaccgtgcacaccgacggcaacgagcagctgagcgtgatgagatacagccccgacggcaacttcctggccatcggcagccacgacaactgcatctacatctacggcgtgagcgacaacggcagaaagtacaccagagtgggcaagtgcagcggccacagcagcttcatcacccacctggactggagcgtgaacagccagttcctggtgagcaacagcggcgactacgagatcctgtactgggtgcccagcgcctgcaagcaggtggtgagcgtggagaccaccagagacatcgagtgggccacctacacctgcaccctgggcttccacgtgttcggcgtgtggcccgagggcagcgacggcaccgacatcaacgccgtgtgcagagcccacgagaagaagctgctgagcaccggcgacgacttcggcaaggtgcacctgttcagctacccctgcagccagttcagagcccccagccacatctacggcggccacagcagccacgtgaccaacgtggacttcctgtgcgaggacagccacctgatcagcaccggcggcaaggacaccagcatcatgcagtggagagtgatctag

SEQ ID NO: 80058 - DNA, 2505 bp, Artificial Sequence; identical to SEQ ID NO: 80057
  Description of Artificial Sequence: Synthetic coding sequence

SEQ ID NO: 80059 - DNA, 2946 bp, Artificial Sequence
  Description of Artificial Sequence: Synthetic coding sequence
atggacggcttcgccggcagcctggacgacagcatcagcgccgccagcaccagcgacgtgcaggacagactgagcgccctggagagcagagtgcagcagcaggaggacgagatcaccgtgctgaaggccgccctggccgacgtgctgagaagactggccatcagcgaggaccacgtggccagcgtgaagaagagcgtgagcagcaagggccagcccagccccagagccgtgatccccatgagctgcatcaccaacggcagcggcgccaacagaaagcccagccacaccagcgccgtgagcatcgccggcaaggagaccctgagcagcgccgccaagagcggcaccgagaagaagaaggagaagccccagggccagagagagaagaaggaggagagccacagcaacgaccagagcccccagatcagagccagccccagcccccagcccagcagccagcccctgcagatccacagacagacccccgagagcaagaacgccacccccaccaagagcatcaagagacccagccccgccgagaagagccacaacagctgggagaacagcgacgacagcagaaacaagctgagcaagatccccagcacccccaagctgatccccaaggtgaccaagaccgccgacaagcacaaggacgtgatcatcaaccaggagggcgagtacatcaagatgttcatgagaggcagacccatcaccatgttcatccccagcgacgtggacaactacgacgacatcagaaccgagctgccccccgagaagctgaagctggagtgggcctacggctacagaggcaaggactgcagagccaacgtgtacctgctgcccaccggcaagatcgtgtacttcatcgccagcgtggtggtgctgttcaactacgaggagagaacccagagacactacctgggccacaccgactgcgtgaagtgcctggccatccaccccgacaagatcagaatcgccaccggccagatcgccggcgtggacaaggacggcagacccctgcagccccacgtgagagtgtgggacagcgtgaccctgagcaccctgcagatcatcggcctgggcaccttcgagagaggcgtgggctgcctggacttcagcaaggccgacagcggcgtgcacctgtgcatcatcgacgacagcaacgagcacatgctgaccgtgtgggactggcagaagaaggccaagggcgccgagatcaagaccaccaacgaggtggtgctggccgtggagttccaccccaccgacgccaacaccatcatcacctgcggcaagagccacatcttcttctggacctggagcggcaacagcctgaccagaaagcagggcatcttcggcaagtacgagaagcccaagttcgtgcagtgcctggccttcctgggcaacggcgacgtgctgaccggcgacagcggcggcgtgatgctgatctggagcaagaccaccgtggagcccacccccggcaagggccccaagggcgtgtaccagatcagcaagcagatcaaggcccacgacggcagcgtgttcaccctgtgccagatgagaaacggcatgctgctgaccggcggcggcaaggacagaaagatcatcctgtgggaccacgacctgaaccccgagagagagatcgaggtgcccgaccagtacggcaccatcagagccgtggccgagggcaaggccgaccagttcctggtgggcaccagcagaaacttcatcctgagaggcaccttcaacgacggcttccagatcgaggtgcagggccacaccgacgagctgtggggcctggccacccaccccttcaaggacctgctgctgacctgcgcccaggacagacaggtgtgcctgtggaacagcatggagcacagactggagtggaccagactggtggacgagcccggccactgcgccgacttccaccccagcggcaccgtggtggccatcggcacccacagcggcagatggttcgtgctggacgccgagaccagagacctggtgagcatccacaccgacggcaacgagcagctgagcgtgatgagatacagcatcgacggcaccttcctggccgtgggcagccacgacaacttcatctacctgtacgtggtgagcgagaacggcagaaagtacagcagatacggcagatgcaccggccacagcagctacatcacccacctggactggagccccgacaacaagtacatcatgagcaacagcggcgactacgagatcctgtactgggacatccccaacggctgcaagctgatcagaaacagaagcgactgcaaggacatcgactggaccacctacacctgcgtgctgggcttccaggtgttcggcgtgtggcccgagggcagcgacggcaccgacatcaacgccctggtgagaagccacaacagaaaggtgatcgccgtggccgacgacttctgcaaggtgcacctgttccagtacccctgcagcaaggccaaggcccccagccacaagtacagcgcccacagcagccacgtgaccaacgtgagcttcacccacaacgacagccacctgatcagcaccggcggcaaggacatgagcatcatccagtggaagctggtggagaagctgagcctgccccagaacgagaccgtggccgacaccaccctgaccaaggcccccgtgagcagcaccgagagcgtgatccagagcaacacccccacccccccccccagccagcccctgaacgagaccgccgaggaggagagcagaatcagcagcagccccaccctgctggagaacagcctggagcagaccgtggagcccagcgaggaccacagcgaggaggagagcgaggagggcagcggcgacctgggcgagcccctgtacgaggagccctgcaacgagatcagcaaggagcaggccaaggccaccctgctggaggaccagcaggaccccagccccagcagctag

SEQ ID NO: 80060 - DNA, 738 bp, Artificial Sequence
  Description of Artificial Sequence: Synthetic coding sequence
atgagcaacagcggcgactacgagatcctgtactgggacatccccaacggctgcaagctgatcagaaacagaagcgactgcaaggacatcgactggaccacctacacctgcgtgctgggcttccaggtgttcggcgtgtggcccgagggcagcgacggcaccgacatcaacgccctggtgagaagccacaacagaaaggtgatcgccgtggccgacgacttctgcaaggtgcacctgttccagtacccctgcagcaaggccaaggcccccagccacaagtacagcgcccacagcagccacgtgaccaacgtgagcttcacccacaacgacagccacctgatcagcaccggcggcaaggacatgagcatcatccagtggaagctggtggagaagctgagcctgccccagaacgagaccgtggccgacaccaccctgaccaaggcccccgtgagcagcaccgagagcgtgatccagagcaacacccccacccccccccccagccagcccctgaacgagaccgccgaggaggagagcagaatcagcagcagccccaccctgctggagaacagcctggagcagaccgtggagcccagcgaggaccacagcgaggaggagagcgaggagggcagcggcgacctgggcgagcccctgtacgaggagccctgcaacgagatcagcaaggagcaggccaaggccaccctgctggaggaccagcaggaccccagccccagcagctag

SEQ ID NO: 80061 - DNA, 2772 bp, Artificial Sequence
  Description of Artificial Sequence: Synthetic coding sequence
atggacggcttcgccggcagcctggacgacagcatcagcgccgccagcaccagcgacgtgcaggacagactgagcgccctggagagcagagtgcagcagcaggaggacgagatcaccgtgctgaaggccgccctggccgacgtgctgagaagactggccatcagcgaggaccacgtggccagcgtgaagaagagcgtgagcagcaagggccagcccagccccagagccgtgatccccatgagctgcatcaccaacggcagcggcgccaacagaaagcccagccacaccagcgccgtgagcatcgccggcaaggagaccctgagcagcgccgccaagagcatcaagagacccagccccgccgagaagagccacaacagctgggagaacagcgacgacagcagaaacaagctgagcaagatccccagcacccccaagctgatccccaaggtgaccaagaccgccgacaagcacaaggacgtgatcatcaaccaggagggcgagtacatcaagatgttcatgagaggcagacccatcaccatgttcatccccagcgacgtggacaactacgacgacatcagaaccgagctgccccccgagaagctgaagctggagtgggcctacggctacagaggcaaggactgcagagccaacgtgtacctgctgcccaccggcaagatcgtgtacttcatcgccagcgtggtggtgctgttcaactacgaggagagaacccagagacactacctgggccacaccgactgcgtgaagtgcctggccatccaccccgacaagatcagaatcgccaccggccagatcgccggcgtggacaaggacggcagacccctgcagccccacgtgagagtgtgggacagcgtgaccctgagcaccctgcagatcatcggcctgggcaccttcgagagaggcgtgggctgcctggacttcagcaaggccgacagcggcgtgcacctgtgcatcatcgacgacagcaacgagcacatgctgaccgtgtgggactggcagaagaaggccaagggcgccgagatcaagaccaccaacgaggtggtgctggccgtggagttccaccccaccgacgccaacaccatcatcacctgcggcaagagccacatcttcttctggacctggagcggcaacagcctgaccagaaagcagggcatcttcggcaagtacgagaagcccaagttcgtgcagtgcctggccttcctgggcaacggcgacgtgctgaccggcgacagcggcggcgtgatgctgatctggagcaagaccaccgtggagcccacccccggcaagggccccaagggcgtgtaccagatcagcaagcagatcaaggcccacgacggcagcgtgttcaccctgtgccagatgagaaacggcatgctgctgaccggcggcggcaaggacagaaagatcatcctgtgggaccacgacctgaaccccgagagagagatcgaggtgcccgaccagtacggcaccatcagagccgtggccgagggcaaggccgaccagttcctggtgggcaccagcagaaacttcatcctgagaggcaccttcaacgacggcttccagatcgaggtgcagggccacaccgacgagctgtggggcctggccacccaccccttcaaggacctgctgctgacctgcgcccaggacagacaggtgtgcctgtggaacagcatggagcacagactggagtggaccagactggtggacgagcccggccactgcgccgacttccaccccagcggcaccgtggtggccatcggcacccacagcggcagatggttcgtgctggacgccgagaccagagacctggtgagcatccacaccgacggcaacgagcagctgagcgtgatgagatacagcatcgacggcaccttcctggccgtgggcagccacgacaacttcatctacctgtacgtggtgagcgagaacggcagaaagtacagcagatacggcagatgcaccggccacagcagctacatcacccacctggactggagccccgacaacaagtacatcatgagcaacagcggcgactacgagatcctgtactgggacatccccaacggctgcaagctgatcagaaacagaagcgactgcaaggacatcgactggaccacctacacctgcgtgctgggcttccaggtgttcggcgtgtggcccgagggcagcgacggcaccgacatcaacgccctggtgagaagccacaacagaaaggtgatcgccgtggccgacgacttctgcaaggtgcacctgttccagtacccctgcagcaaggccaaggcccccagccacaagtacagcgcccacagcagccacgtgaccaacgtgagcttcacccacaacgacagccacctgatcagcaccggcggcaaggacatgagcatcatccagtggaagctggtggagaagctgagcctgccccagaacgagaccgtggccgacaccaccctgaccaaggcccccgtgagcagcaccgagagcgtgatccagagcaacacccccacccccccccccagccagcccctgaacgagaccgccgaggaggagagcagaatcagcagcagccccaccctgctggagaacagcctggagcagaccgtggagcccagcgaggaccacagcgaggaggagagcgaggagggcagcggcgacctgggcgagcccctgtacgaggagccctgcaacgagatcagcaaggagcaggccaaggccaccctgctggaggaccagcaggaccccagccccagcagctag

SEQ ID NO: 80062 - DNA, 780 bp, Artificial Sequence
  Description of Artificial Sequence: Synthetic coding sequence
atgctgctgagaagctggttcggcaacaaggacttccaggccctgcccatcctggccagactgcccagcatgcccaccgacatggagcacaccggccactacctgcacctggccttcctgatgaccaccgtgttcagcctgagccccggcaccaaggccaactacaccagactgtgggccaacagcaccagcagctgggacagcgtgatccagaacaagaccggcagaaaccagaacgagaacatcaacaccaaccccatcacccccgaggtggactacaagggcaacagcaccaacatgcccgagaccagccacatcgtggccctgaccagcaagagcgagcaggagctgtacatccccagcgtggtgagcaacagccccagcaccgtgcagagcatcgagaacaccagcaagagccacggcgagatcttcaagaaggacgtgtgcgccgagaacaacaacaacatggccatgctgatctgcctgatcatcatcgccgtgctgttcctgatctgcaccttcctgttcctgagcaccgtggtgctggccaacaaggtgagcagcctgagaagaagcaagcaggtgggcaagagacagcccagaagcaacggcgacttcctggccagcggcctgtggcccgccgagagcgacacctggaagagaaccaagcagctgaccggccccaacctggtgatgcagagcaccggcgtgctgaccgccaccagagagagaaaggacgaggagggcaccgagaagctgaccaacaagcagatcggctag

SEQ ID NO: 80063 - DNA, 711 bp, Artificial Sequence
  Description of Artificial Sequence: Synthetic coding sequence
atgcccaccgacatggagcacaccggccactacctgcacctggccttcctgatgaccaccgtgttcagcctgagccccggcaccaaggccaactacaccagactgtgggccaacagcaccagcagctgggacagcgtgatccagaacaagaccggcagaaaccagaacgagaacatcaacaccaaccccatcacccccgaggtggactacaagggcaacagcaccaacatgcccgagaccagccacatcgtggccctgaccagcaagagcgagcaggagctgtacatccccagcgtggtgagcaacagccccagcaccgtgcagagcatcgagaacaccagcaagagccacggcgagatcttcaagaaggacgtgtgcgccgagaacaacaacaacatggccatgctgatctgcctgatcatcatcgccgtgctgttcctgatctgcaccttcctgttcctgagcaccgtggtgctggccaacaaggtgagcagcctgagaagaagcaagcaggtgggcaagagacagcccagaagcaacggcgacttcctggccagcggcctgtggcccgccgagagcgacacctggaagagaaccaagcagctgaccggccccaacctggtgatgcagagcaccggcgtgctgaccgccaccagagagagaaaggacgaggagggcaccgagaagctgaccaacaagcagatcggctag

SEQ ID NO: 80064 - DNA, 711 bp, Artificial Sequence; identical to SEQ ID NO: 80063
  Description of Artificial Sequence: Synthetic coding sequence

SEQ ID NO: 80065 - DNA, 699 bp, Artificial Sequence
  Description of Artificial Sequence: Synthetic coding sequence
atggagcacaccggccactacctgcacctggccttcctgatgaccaccgtgttcagcctgagccccggcaccaaggccaactacaccagactgtgggccaacagcaccagcagctgggacagcgtgatccagaacaagaccggcagaaaccagaacgagaacatcaacaccaaccccatcacccccgaggtggactacaagggcaacagcaccaacatgcccgagaccagccacatcgtggccctgaccagcaagagcgagcaggagctgtacatccccagcgtggtgagcaacagccccagcaccgtgcagagcatcgagaacaccagcaagagccacggcgagatcttcaagaaggacgtgtgcgccgagaacaacaacaacatggccatgctgatctgcctgatcatcatcgccgtgctgttcctgatctgcaccttcctgttcctgagcaccgtggtgctggccaacaaggtgagcagcctgagaagaagcaagcaggtgggcaagagacagcccagaagcaacggcgacttcctggccagcggcctgtggcccgccgagagcgacacctggaagagaaccaagcagctgaccggccccaacctggtgatgcagagcaccggcgtgctgaccgccaccagagagagaaaggacgaggagggcaccgagaagctgaccaacaagcagatcggctag

SEQ ID NO: 80066 - DNA, 1347 bp, Artificial Sequence
  Description of Artificial Sequence: Synthetic coding sequence
atggaccccaagtacttcatcctgatcctgttctgcggccacctgaacaacaccttcttcagcaagaccgagaccatcaccaccgagaagcagagccagcccaccctgttcaccagcagcatgagccaggtgctggccaacagccagaacaccaccggcaaccccctgggccagcccacccagttcagcgacaccttcagcggccagagcatcagccccgccaaggtgaccgccggccagcccacccccgccgtgtacaccagcagcgagaagcccgaggcccacaccagcgccggccagcccctggcctacaacaccaagcagcccacccccatcgccaacaccagcagccagcaggccgtgttcaccagcgccagacagctgcccagcgccagaaccagcaccacccagccccccaagagcttcgtgtacaccttcacccagcagagcagcagcgtgcagatccccagcagaaagcagatcaccgtgcacaaccccagcacccagcccaccagcaccgtgaagaacagccccagaagcacccccggcttcatcctggacaccaccagcaacaagcagaccccccagaagaacaactacaacagcatcgccgccatcctgatcggcgtgctgctgaccagcatgctggtggccatcatcatcatcgtgctgtggaagtgcctgagaaagcccgtgctgaacgaccagaactgggccggcagaagccccttcgccgacggcgagacccccgacatctgcatggacaacatcagagagaacgagatcagcaccaagagaaccagcatcatcagcctgaccccctggaagcccagcaagagcaccctgctggccgacgacctggagatcaagctgttcgagagcagcgagaacatcgaggacagcaacaaccccaagaccgagaagatcaaggaccaggtgaacggcaccagcgaggacagcgccgacggcagcaccgtgggcaccgccgtgagcagcagcgacgacgccgacctgcccccccccccccccctgctggacctggagggccaggagagcaaccagagcgacaagcccaccatgaccatcgtgagccccctgcccaacgacagcaccagcctgccccccagcctggactgcctgaaccaggactgcggcgaccacaagagcgagatcatccagagcttcccccccctggacagcctgaacctgcccctgccccccgtggacttcatgaagaaccaggaggacagcaacctggagatccagtgccaggagttcagcatcccccccaacagcgaccaggacctgaacgagagcctgccccccccccccgccgagctgctgtag

SEQ ID NO: 80067 - DNA, 1392 bp, Artificial Sequence
  Description of Artificial Sequence: Synthetic coding sequence
atgctgttcagatacgccgagaagatcaccagaaagtacagcgagatggaccccaagtacttcatcctgatcctgttctgcggccacctgaacaacaccttcttcagcaagaccgagaccatcaccaccgagaagcagagccagcccaccctgttcaccagcagcatgagccaggtgctggccaacagccagaacaccaccggcaaccccctgggccagcccacccagttcagcgacaccttcagcggccagagcatcagccccgccaaggtgaccgccggccagcccacccccgccgtgtacaccagcagcgagaagcccgaggcccacaccagcgccggccagcccctggcctacaacaccaagcagcccacccccatcgccaacaccagcagccagcaggccgtgttcaccagcgccagacagctgcccagcgccagaaccagcaccacccagccccccaagagcttcgtgtacaccttcacccagcagagcagcagcgtgcagatccccagcagaaagcagatcaccgtgcacaaccccagcacccagcccaccagcaccgtgaagaacagccccagaagcacccccggcttcatcctggacaccaccagcaacaagcagaccccccagaagaacaactacaacagcatcgccgccatcctgatcggcgtgctgctgaccagcatgctggtggccatcatcatcatcgtgctgtggaagtgcctgagaaagcccgtgctgaacgaccagaactgggccggcagaagccccttcgccgacggcgagacccccgacatctgcatggacaacatcagagagaacgagatcagcaccaagagaaccagcatcatcagcctgaccccctggaagcccagcaagagcaccctgctggccgacgacctggagatcaagctgttcgagagcagcgagaacatcgaggacagcaacaaccccaagaccgagaagatcaaggaccaggtgaacggcaccagcgaggacagcgccgacggcagcaccgtgggcaccgccgtgagcagcagcgacgacgccgacctgcccccccccccccccctgctggacctggagggccaggagagcaaccagagcgacaagcccaccatgaccatcgtgagccccctgcccaacgacagcaccagcctgccccccagcctggactgcctgaaccaggactgcggcgaccacaagagcgagatcatccagagcttcccccccctggacagcctgaacctgcccctgccccccgtggacttcatgaagaaccaggaggacagcaacctggagatccagtgccaggagttcagcatcccccccaacagcgaccaggacctgaacgagagcctgccccccccccccgccgagctgctgtag

SEQ ID NO: 80068 - DNA, 924 bp, Artificial Sequence
  Description of Artificial Sequence: Synthetic coding sequence
atgaaccaggccgagctgatgcagctggacatggagggcatgctgcagcacttccagaaggtgatcccccaccagttcgacggcgtgcccgacaagctgatccaggccgcctaccaggtgaagtacaacagcaagaagatgaagaagctggagaaggagtacaccaccatcaagaccaaggagatggaggagcaggtggagatcaagagactgagaaccgagaacagactgctgaagcagagaatcgagaccctggagaaggagagcgccagcctggccgacagactgatccagggccaggtgaccagagcccaggaggccgaggagaactacctgatcaagagagagctggccaccatcaagcagcagagcgacgaggccagcgccaagctggagcaggccgagaacaccatcagaaagctgcagcaccagcagcagtggcacaagtgcagcagcaactacaacgaggacttcgtgctgcagctggagaaggagctggtgcaggccagactgagcgaggccgagagccagtgcgccctgaaggagatgcaggacaaggtgctggacatcgagaagagaaacaacagcctgcccgacgagaacaacatcgccagactgcaggaggagctgatcgccgtgaagctgagagaggccgaggccatcatgggcctgaaggagctgagacagcaggtgaaggacctggaggagcactggcagagacacctggccagaaccaccggcagatggaaggacccccccaagaagaacgccatgaacgagctgcaggacgagctgatgaccatcagactgagagaggccgagacccaggccgagatcagagagatcaagcagagaatgatggagatggagacccagagcggcacctgcggccccctgctgaagatcatcttcttcaacgcctag

SEQ ID NO: 80069 - DNA, 2433 bp, Artificial Sequence
  Description of Artificial Sequence: Synthetic coding sequence
atggtgaccaacaagatgaccgccgccttcagaaaccccagcggcaagcaggtggccaccgacaaggtggccgagaagctgagcagcaccctgagctgggtgaagaacaccgtgagccacaccgtgagccagatggccagccaggtggccagccccagcaccagcctgcacaccaccagcagcagcaccaccctgagcacccccgccctgagccccagcagccccagccagctgagccccgacgacctggagctgctggccaagctggaggagcagaacagactgctggagaccgacagcaagagcctgagaagcgtgaacggcagcagaagaaacagcggcagcagcctggtgagcagcagcagcgccagcagcaacctgagccacctggaggaggacagctggatcctgtggggcagaatcgtgaacgagtgggaggacgtgagaaagaagaaggagaagcaggtgaaggagctggtgcacaagggcatcccccaccacttcagagccatcgtgtggcagctgctgtgcagcgcccagagcatgcccatcaaggaccagtacagcgagctgctgaagatgaccagcccctgcgagaagctgatcagaagagacatcgccagaacctaccccgagcacaacttcttcaaggagaaggacagcctgggccaggaggtgctgttcaacgtgatgaaggcctacagcctggtggacagagaggtgggctactgccagggcagcgccttcatcgtgggcctgctgctgatgcagatgcccgaggaggaggccttctgcgtgttcgtgaagctgatgcaggactacagactgagagagctgttcaagcccagcatggccgagctgggcctgtgcatgtaccagttcgagtgcatgatccaggagcacctgcccgagctgttcgtgcacttccagagccagagcttccacaccagcatgtacgccagcagctggttcctgaccatcttcctgaccaccttccccctgcccatcgccaccagaatcttcgacatcttcatgagcgagggcctggagatcgtgttcagagtgggcctggccctgctgcagatgaaccaggccgagctgatgcagctggacatggagggcatgctgcagcacttccagaaggtgatcccccaccagttcgacggcgtgcccgacaagctgatccaggccgcctaccaggtgaagtacaacagcaagaagatgaagaagctggagaaggagtacaccaccatcaagaccaaggagatggaggagcaggtggagatcaagagactgagaaccgagaacagactgctgaagcagagaatcgagaccctggagaagcacaagtgcagcagcaactacaacgaggacttcgtgctgcagctggagaaggagctggtgcaggccagactgagcgaggccgagagccagtgcgccctgaaggagatgcaggacaaggtgctggacatcgagaagagaaacaacagcctgcccgacgagaacaacatcgccagactgcaggaggagctgatcgccgtgaagctgagagaggccgaggccatcatgggcctgaaggagctgagacagcaggtgaaggacctggaggagcactggcagagacacctggccagaaccaccggcagatggaaggacccccccaagaagaacgccatgaacgagctgcaggacgagctgatgaccatcagactgagagaggccgagacccaggccgagatcagagagatcaagcagagaatgatggagatggagacccagaaccagatcaacagcaaccacctgagaagagccgagcaggaggtgatcagcctgcaggagaaggtgcagtacctgagcgcccagaacaagggcctgctgacccagctgagcgaggccaagagaaagcaggccgagatcgagtgcaagaacaaggaggaggtgatggccgtgagactgagagaggccgacagcatcgccgccgtggccgagctgagacagcacatcgccgagctggagatccagaaggaggagggcaagctgcagggccagctgaacaagagcgacagcaaccagtacatcggcgagctgaaggaccagatcgccgagctgaaccacgagctgagatgcctgaagggccagagaggcttcagcggccagccccccttcgacggcatccacatcgtgaaccacctgatcggcgacgacgagagcttccacagcagcgacgaggacttcatcgacaacagcctgcaggagaccggcgtgggcttccccctgcacggcaagagcggcagcatgagcctggaccccgccgtggccgacggcagcgagagcgagaccgaggacagcgtgctggagaccagagagagcaaccaggtggtgcagaaggagagaccccccagaagaagagagagctacagcaccaccgtgtag

SEQ ID NO: 80070 - DNA, 2433 bp, Artificial Sequence; identical to SEQ ID NO: 80069
  Description of Artificial Sequence: Synthetic coding sequence

SEQ ID NO: 80071 - DNA, 2466 bp, Artificial Sequence
  Description of Artificial Sequence: Synthetic coding sequence
atggtgaccaacaagatgaccgccgccttcagaaaccccagcggcaagcaggtggccaccgacaaggtggccgagaagctgagcagcaccctgagctgggtgaagaacaccgtgagccacaccgtgagccagatggccagccaggtggccagccccagcaccagcctgcacaccaccagcagcagcaccaccctgagcacccccgccctgagccccagcagccccagccagctgagccccgacgacctggagctgctggccaagctggaggagcagaacagactgctggagaccgacagcaagagcctgagaagcgtgaacggcagcagaagaaacagcggcagcagcctggtgagcagcagcagcgccagcagcaacctgagccacctggaggaggacagctggatcctgtggggcagaatcgtgaacgagtgggaggacgtgagaaagaagaaggagaagcaggtgaaggagctggtgcacaagggcatcccccaccacttcagagccatcgtgtggcagctgctgtgcagcgcccagagcatgcccatcaaggaccagtacagcgagctgctgaagatgaccagcccctgcgagaagctgatcagaagagacatcgccagaacctaccccgagcacaacttcttcaaggagaaggacagcctgggccaggaggtgctgttcaacgtgatgaaggcctacagcctggtggacagagaggtgggctactgccagggcagcgccttcatcgtgggcctgctgctgatgcagatgcccgaggaggaggccttctgcgtgttcgtgaagctgatgcaggactacagactgagagagctgttcaagcccagcatggccgagctgggcctgtgcatgtaccagttcgagtgcatgatccaggagcacctgcccgagctgttcgtgcacttccagagccagagcttccacaccagcatgtacgccagcagctggttcctgaccatcttcctgaccaccttccccctgcccatcgccaccagaatcttcgacatcttcatgagcgagggcctggagatcgtgttcagagtgggcctggccctgctgcagatgaaccaggccgagctgatgcagctggacatggagggcatgctgcagcacttccagaaggtgatcccccaccagttcgacggcgtgcccgacaagctgatccaggccgcctaccaggtgaagtacaacagcaagaagatgaagaagctggagaaggagtacaccaccatcaagaccaaggagatggaggagcaggtggagatcaagagactgagaaccgagaacagactgctgaagcagagaatcgagaccctggagaaggagagcgccagcctggccgacagactgatccagcacaagtgcagcagcaactacaacgaggacttcgtgctgcagctggagaaggagctggtgcaggccagactgagcgaggccgagagccagtgcgccctgaaggagatgcaggacaaggtgctggacatcgagaagagaaacaacagcctgcccgacgagaacaacatcgccagactgcaggaggagctgatcgccgtgaagctgagagaggccgaggccatcatgggcctgaaggagctgagacagcaggtgaaggacctggaggagcactggcagagacacctggccagaaccaccggcagatggaaggacccccccaagaagaacgccatgaacgagctgcaggacgagctgatgaccatcagactgagagaggccgagacccaggccgagatcagagagatcaagcagagaatgatggagatggagacccagaaccagatcaacagcaaccacctgagaagagccgagcaggaggtgatcagcctgcaggagaaggtgcagtacctgagcgcccagaacaagggcctgctgacccagctgagcgaggccaagagaaagcaggccgagatcgagtgcaagaacaaggaggaggtgatggccgtgagactgagagaggccgacagcatcgccgccgtggccgagctgagacagcacatcgccgagctggagatccagaaggaggagggcaagctgcagggccagctgaacaagagcgacagcaaccagtacatcggcgagctgaaggaccagatcgccgagctgaaccacgagctgagatgcctgaagggccagagaggcttcagcggccagccccccttcgacggcatccacatcgtgaaccacctgatcggcgacgacgagagcttccacagcagcgacgaggacttcatcgacaacagcctgcaggagaccggcgtgggcttccccctgcacggcaagagcggcagcatgagcctggaccccgccgtggccgacggcagcgagagcgagaccgaggacagcgtgctggagaccagagagagcaaccaggtggtgcagaaggagagaccccccagaagaagagagagctacagcaccaccgtgtag

SEQ ID NO: 80072 - DNA, 891 bp, Artificial Sequence
  Description of Artificial Sequence: Synthetic coding sequence
atgagctgggtgcaggccaccctgctggccagaggcctgtgcagagcctggggcggcacctgcggcgccgccctgaccggcaccagcatcagccaggtgcccagaagactgcccagaggcctgcactgcagcgccgccgcccacagcagcgagcagagcctggtgcccagcccccccgagcccagacagagacccaccaaggccctggtgcccttcgaggacctgttcggccaggcccccggcggcgagagagacaaggccagcttcctgcagaccgtgcagaagttcgccgagcacagcgtgagaaagagaggccacatcgacttcatctacctggccctgagaaagatgagagagtacggcgtggagagagacctggccgtgtacaaccagctgctgaacatcttccccaaggaggtgttcagacccagaaacatcatccagagaatcttcgtgcactaccccagacagcaggagtgcggcatcgccgtgctggagcagatggagaaccacggcgtgatgcccaacaaggagaccgagttcctgctgatccagatcttcggcagaaagagctaccccatgctgaagctggtgagactgaagctgtggttccccagattcatgaacgtgaaccccttccccgtgcccagagacctgccccaggaccccgtggagctggccatgttcggcctgagacacatggagcccgacctgagcgccagagtgaccatctaccaggtgcccctgcccaaggacagcaccggcgccgccgaccccccccagccccacatcgtgggcagcggcagagacgccggcggcgtggagcccctgctgcccgacgccgccggccccggcgtgtgcgaggagtggctgggccagctgagagtgtag

SEQ ID NO: 80073 - DNA, 1296 bp, Artificial Sequence
  Description of Artificial Sequence: Synthetic coding sequence
atgagctgggtgcaggccaccctgctggccagaggcctgtgcagagcctggggcggcacctgcggcgccgccctgaccggcaccagcatcagccaggtgcccagaagactgcccagaggcctgcactgcagcgccgccgcccacagcagcgagcagagcctggtgcccagcccccccgagcccagacagagacccaccaaggccctggtgcccttcgaggacctgttcggccaggcccccggcggcgagagagacaaggccagcttcctgcagaccgtgcagaagttcgccgagcacagcgtgagaaagagaggccacatcgacttcatctacctggccctgagaaagatgagagagtacggcgtggagagagacctggccgtgtacaaccagctgctgaacatcttccccaaggaggtgttcagacccagaaacatcatccagagaatcttcgtgcactaccccagacagcaggagtgcggcatcgccgtgctggagcagatggagaaccacggcgtgatgcccaacaaggagaccgagttcctgctgatccagatcttcggcagaaagagctaccccatgctgaagctggtgagactgaagctgtggttccccagattcatgaacgtgaaccccttccccgtgcccagagacctgccccaggaccccgtggagctggccatgttcggcctgagacacatggagcccgacctgagcgccagagtgaccatctaccaggtgcccctgcccaaggacagcaccggcgccgccgaccccccccagccccacatcgtgggcatccagagccccgaccagcaggccgccctggccagacacaaccccgccagacccgtgttcgtggagggccccttcagcctgtggctgagaaacaagtgcgtgtactaccacatcctgagagccgacctgctgccccccgaggagagagaggtggaggagacccccgaggagtggaacctgtactaccccatgcagctggacctggagtacgtgagaagcggctgggacaactacgagttcgacatcaacgaggtggaggagggccccgtgttcgccatgtgcatggccggcgcccacgaccaggccaccatggccaagtggatccagggcctgcaggagaccaaccccaccctggcccagatccccgtggtgttcagactggccggcagcaccagagagctgcagaccagcagcgccggcctggaggagccccccctgcccgaggaccaccaggaggaggacgacaacctgcagagacagcagcagggccagagctag

SEQ ID NO: 80074 - DNA, 654 bp, Artificial Sequence
  Description of Artificial Sequence: Synthetic coding sequence
atgagctgggtgcaggccaccctgctggccagaggcctgtgcagagcctggggcggcacctgcggcgccgccctgaccggcaccagcatcagccaggtgcccctgcccaaggacagcaccggcgccgccgaccccccccagccccacatcgtgggcatccagagccccgaccagcaggccgccctggccagacacaaccccgccagacccgtgttcgtggagggccccttcagcctgtggctgagaaacaagtgcgtgtactaccacatcctgagagccgacctgctgccccccgaggagagagaggtggaggagacccccgaggagtggaacctgtactaccccatgcagctggacctggagtacgtgagaagcggctgggacaactacgagttcgacatcaacgaggtggaggagggccccgtgttcgccatgtgcatggccggcgcccacgaccaggccaccatggccaagtggatccagggcctgcaggagaccaaccccaccctggcccagatccccgtggtgttcagactggccggcagcaccagagagctgcagaccagcagcgccggcctggaggagccccccctgcccgaggaccaccaggaggaggacgacaacctgcagagacagcagcagggccagagctag

SEQ ID NO: 80075 - DNA, 891 bp, Artificial Sequence
  Description of Artificial Sequence: Synthetic coding sequence
atgagctgggtgcaggccaccctgctggccagaggcctgtgcagagcctggggcggcacctgcggcgccgccctgaccggcaccagcatcagccaggtgcccagaagactgcccagaggcctgcactgcagcgccgccgcccacagcagcgagcagagcctggtgcccagcccccccgagcccagacagagacccaccaaggccctggtgcccttcgaggacctgttcggccaggcccccggcggcgagagagacaaggccagcttcctgcagaccgtgcagaagttcgccgagcacagcgtgagaaagagaggccacatcgacttcatctacctggccctgagaaagatgagagagtacggcgtggagagagacctggccgtgtacaaccagctgctgaacatcttccccaaggaggtgttcagacccagaaacatcatccagagaatcttcgtgcactaccccagacagcaggagtgcggcatcgccgtgctggagcagatggagaaccacggcgtgatgcccaacaaggagaccgagttcctgctgatccagatcttcggcagaaagagctaccccatgctgaagctggtgagactgaagctgtggttccccagattcatgaacgtgaaccccttccccgtgcccagagacctgccccaggaccccgtggagctggccatgttcggcctgagacacatggagcccgacctgagcgccagagtgaccatctaccaggtgcccctgcccaaggacagcaccggcgccgccgaccccccccagccccacatcgtggagctgacctgctgccccagaagaagaggcaagtggaagagaagaagaagaagcggcaccagcaccaccagatgcagctggacctggagcatgtag

SEQ ID NO: 80076 - DNA, 1770 bp, Artificial Sequence
  Description of Artificial Sequence: Synthetic coding sequence
atgagcgtgagcgtgcacgagaacagaaagagcagagccagcagcggcagcatcaacatctacctgttccacaagagcagctacgccgacagcgtgctgacccacctgaacctgctgagacagcagagactgttcaccgacgtgctgctgcacgccggcaacagaaccttcccctgccacagagccgtgctggccgcctgcagcagatacttcgaggccatgttcagcggcggcctgaaggagagccaggacagcgaggtgaacttcgacaacagcatccaccccgaggtgctggagctgctgctggactacgcctacagcagcagagtgatcatcaacgaggagaacgccgagagcctgctggaggccggcgacatgctggagttccaggacatcagagacgcctgcgccgagttcctggagaagaacctgcaccccaccaactgcctgggcatgctgctgctgagcgacgcccaccagtgcaccaagctgtacgagctgagctggagaatgtgcctgagcaacttccagaccatcagaaagaacgaggacttcctgcagctgccccaggacatggtggtgcagctgctgagcagcgaggagctggagaccgaggacgagagactggtgtacgagagcgccatcaactggatcagctacgacctgaagaagagatactgctacctgcccgagctgctgcagaccgtgagactggccctgctgcccgccatctacctgatggagaacgtggccatggaggagctgatcaccaagcagagaaagagcaaggagatcgtggaggaggccatcagatgcaagctgaagatcctgcagaacgacggcgtggtgaccagcctgtgcgccagacccagaaagaccggccacgccctgttcctgctgggcggccagaccttcatgtgcgacaagctgtacctggtggaccagaaggccaaggagatcatccccaaggccgacatccccagccccagaaaggagttcagcgcctgcgccatcggctgcaaggtgtacatcaccggcggcagaggcagcgagaacggcgtgagcaaggacgtgtgggtgtacgacaccctgcacgaggagtggagcaaggccgcccccatgctggtggccagattcggccacggcagcgccgagctgaagcactgcctgtacgtggtgggcggccacaccgccgccaccggctgcctgcccgccagccccagcgtgagcctgaagcaggtggagcactacgaccccaccatcaacaagtggaccatggtggcccccctgagagagggcgtgagcaacgccgccgtggtgagcgccaagctgaagctgttcgccttcggcggcaccagcgtgagccacgacaagctgcccaaggtgcagtgctacgaccagtgcgagaacagatggaccgtgcccgccacctgcccccagccctggagatacaccgccgccgccgtgctgggcaaccagatcttcatcatgggcggcgacaccgagttcagcgcctgcagcgcctacaagttcaacagcgagacctaccagtggaccaaggtgggcgacgtgaccgccaagagaatgagctgccacgccgtggccagcggcaacaagctgtacgtggtgggcggctacttcggcatccagagatgcaagaccctggactgctacgaccccaccctggacgtgtggaacagcatcaccaccgtgccctacagcctgatccccaccgccttcgtgagcacctggaagcacctgcccagctag

SEQ ID NO: 80077 - DNA, 153 bp, Artificial Sequence
  Description of Artificial Sequence: Synthetic coding sequence
atgagcgtgagcgtgcacgagaacagaaagagcagagccagcagcggcagcatcaacatctacctgttccacaagagcagctacgccgacagcgtgctgacccacctgaacctgctgagacagcagagactgttcaccgacgtgctgctgtag

SEQ ID NO: 80078 - DNA, 15 bp, Artificial Sequence
  Description of Artificial Sequence: Synthetic coding sequence
atgagcgtgagctag

SEQ ID NO: 80079 - DNA, 1770 bp, Artificial Sequence; identical to SEQ ID NO: 80076
  Description of Artificial Sequence: Synthetic coding sequence

SEQ ID NO: 80080 - DNA, 1551 bp, Artificial Sequence
  Description of Artificial Sequence: Synthetic coding sequence
atgttcagcggcggcctgaaggagagccaggacagcgaggtgaacttcgacaacagcatccaccccgaggtgctggagctgctgctggactacgcctacagcagcagagtgatcatcaacgaggagaacgccgagagcctgctggaggccggcgacatgctggagttccaggacatcagagacgcctgcgccgagttcctggagaagaacctgcaccccaccaactgcctgggcatgctgctgctgagcgacgcccaccagtgcaccaagctgtacgagctgagctggagaatgtgcctgagcaacttccagaccatcagaaagaacgaggacttcctgcagctgccccaggacatggtggtgcagctgctgagcagcgaggagctggagaccgaggacgagagactggtgtacgagagcgccatcaactggatcagctacgacctgaagaagagatactgctacctgcccgagctgctgcagaccgtgagactggccctgctgcccgccatctacctgatggagaacgtggccatggaggagctgatcaccaagcagagaaagagcaaggagatcgtggaggaggccatcagatgcaagctgaagatcctgcagaacgacggcgtggtgaccagcctgtgcgccagacccagaaagaccggccacgccctgttcctgctgggcggccagaccttcatgtgcgacaagctgtacctggtggaccagaaggccaaggagatcatccccaaggccgacatccccagccccagaaaggagttcagcgcctgcgccatcggctgcaaggtgtacatcaccggcggcagaggcagcgagaacggcgtgagcaaggacgtgtgggtgtacgacaccctgcacgaggagtggagcaaggccgcccccatgctggtggccagattcggccacggcagcgccgagctgaagcactgcctgtacgtggtgggcggccacaccgccgccaccggctgcctgcccgccagccccagcgtgagcctgaagcaggtggagcactacgaccccaccatcaacaagtggaccatggtggcccccctgagagagggcgtgagcaacgccgccgtggtgagcgccaagctgaagctgttcgccttcggcggcaccagcgtgagccacgacaagctgcccaaggtgcagtgctacgaccagtgcgagaacagatggaccgtgcccgccacctgcccccagccctggagatacaccgccgccgccgtgctgggcaaccagatcttcatcatgggcggcgacaccgagttcagcgcctgcagcgcctacaagttcaacagcgagacctaccagtggaccaaggtgggcgacgtgaccgccaagagaatgagctgccacgccgtggccagcggcaacaagctgtacgtggtgggcggctacttcggcatccagagatgcaagaccctggactgctacgaccccaccctggacgtgtggaacagcatcaccaccgtgccctacagcctgatccccaccgccttcgtgagcacctggaagcacctgcccagctag

SEQ ID NO: 80081 - DNA, 1932 bp, Artificial Sequence
  Description of Artificial Sequence: Synthetic coding sequence
atggtggacgccggcggcgtggagaacatcacccagctgccccaggagctgccccagatgatggccgccgccgccgacggcctgggcagcatcgccatcgacaccacccagctgaacatgagcgtgaccgaccccaccgcctgggccaccgccatgaacaacctgggcatggtgcccgtgggcctgcccggccagcagctggtgagcgacagcatctgcgtgcccggcttcgaccccagcctgaacatgatgaccggcatcacccccatcaaccccatgatccccggcctgggcctggtgcccccccccccccccaccgaggtggccgtggtgaaggagatcatccactgcaagagctgcaccctgttcccccagaaccccaacctgcccccccccagcaccagagagagaccccccggctgcaagaccgtgttcgtgggcggcctgcccgagaacgccaccgaggagatcatccaggaggtgttcgagcagtgcggcgacatcaccgccatcagaaagagcaagaagaacttctgccacatcagattcgccgaggagttcatggtggacaaggccatctacctgagcggctacagaatgagactgggcagcagcaccgacaagaaggacagcggcagactgcacgtggacttcgcccaggccagagacgacttctacgagtgggagtgcaagcagagaatgagagccagagaggagagacacagaagaaagctggaggaggacagactgagaccccccagcccccccgccatcatgcactacagcgagcacgaggccgccctgctggccgagaagctgaaggacgacagcaagttcagcgaggccatcaccgtgctgctgagctggatcgagagaggcgaggtgaacagaagaagcgccaaccagttctacagcatggtgcagagcgccaacagccacgtgagaagactgatgaacgagaaggccacccacgagcaggagatggaggaggccaaggagaacttcaagaacgccctgaccggcatcctgacccagttcgagcagatcgtggccgtgttcaacgccagcaccagacagaaggcctgggaccacttcagcaaggcccagagaaagaacatcgacatctggagaaagcacagcgaggagctgagaaacgcccagagcgagcagctgatgggcatcagaagagaggaggagatggagatgagcgacgacgagaactgcgacagccccaccaagaagatgagagtggacgagagcgccctggccgcccaggcctacgccctgaaggaggagaacgacagcctgagatggcagctggacgcctacagaaacgaggtggagctgctgaagcaggagaaggagcagctgttcagaaccgaggagaacctgaccaaggaccagcagctgcagttcctgcagcagaccatgcagggcatgcagcagcagctgctgaccatccaggaggagctgaacaacaagaagagcgagctggagcaggccaaggaggagcagagccacacccaggccctgctgaaggtgctgcaggagcagctgaagggcaccaaggagctggtggagaccaacggccacagccacgaggacagcaacgagatcaacgtgctgaccgtggccctggtgaaccaggacagagagaacaacatcgagaagagaagccagggcctgaagagcgagaaggaggccctgctgatcggcatcatcagcaccttcctgcacgtgcaccccttcggcgccaacatcgagtacctgtggagctacatgcagcagctggacagcaagatcagcgccaacgagatcgagatgctgctgatgagactgcccagaatgttcaagcaggagttcaccggcgtgggcgccaccctggagaagagatggaagctgtgcgccttcgagggcatcaagaccacctag

SEQ ID NO: 80082 - DNA, 1932 bp, Artificial Sequence; identical to SEQ ID NO: 80081
  Description of Artificial Sequence: Synthetic coding sequence

SEQ ID NO: 80083 - DNA, 708 bp, Artificial Sequence
  Description of Artificial Sequence: Synthetic coding sequence
atggtggacaaggccatctacctgagcggctacagaatgagactgggcagcagcaccgacaagaaggacagcggcagactgcacgtggacttcgcccaggccagagacgacttctacgagtgggagtgcaagcagagaatgagagccagagaggagagacacagaagaaagctggaggaggacagactgagaccccccagcccccccgccatcatgcactacagcgagcacgaggccgccctgctggccgagaagctgaaggacgacagcaagttcagcgaggccatcaccgtgctgctgagctggatcgagagaggcgaggtgaacagaagaagcgccaaccagttctacagcatggtgcagagcgccaacagccacgtgagaagactgatgaacgagaaggccacccacgagcaggagatggaggaggccaaggagaacttcaagaacgccctgaccggcatcctgacccagttcgagcagatcgtggccgtgttcaacgccagcaccagacagaaggcctgggaccacttcagcaaggcccagagaaagaacatcgacatctggagaaagcacagcgaggagctgagaaacgcccagagcgagcagctgatgggcatcagaagagaggaggagatggagatgagcgacgacgagaactgcgacagccccaccaagaagatgagagtggacgagagcggcgcctag

SEQ ID NO: 80084 - DNA, 1833 bp, Artificial Sequence
  Description of Artificial Sequence: Synthetic coding sequence
atgcagagagacttcagatggctgtgggtgtacgagatcggctacgccgccgacaacagcagaaccctgaacgtggacagcaccgccatgaccctgcccatgagcgaccccaccgcctgggccaccgccatgaacaacctgggcatggcccccctgggcatcgccggccagcccatcctgcccgacttcgaccccgccctgggcatgatgaccggcatcccccccatcacccccatgatgcccggcctgggcatcgtgcccccccccatcccccccgacatgcccgtggtgaaggagatcatccactgcaagagctgcaccctgttcccccccaaccccaacctgcccccccccgccaccagagagagaccccccggctgcaagaccgtgttcgtgggcggcctgcccgagaacggcaccgagcagatcatcgtggaggtgttcgagcagtgcggcgagatcatcgccatcagaaagagcaagaagaacttctgccacatcagattcgccgaggagtacatggtggacaaggccctgtacctgagcggctacagaatcagactgggcagcagcaccgacaagaaggacaccggcagactgcacgtggacttcgcccaggccagagacgacctgtacgagtgggagtgcaagcagagaatgctggccagagaggagagacacagaagaagaatggaggaggagagactgagaccccccagccccccccccgtggtgcactacagcgaccacgagtgcagcatcgtggccgagaagctgaaggacgacagcaagttcagcgaggccgtgcagaccctgctgacctggatcgagagaggcgaggtgaacagaagaagcgccaacaacttctacagcatgatccagagcgccaacagccacgtgagaagactggtgaacgagaaggccgcccacgagaaggacatggaggaggccaaggagaagttcaagcaggccctgagcggcatcctgatccagttcgagcagatcgtggccgtgtaccacagcgccagcaagcagaaggcctgggaccacttcaccaaggcccagagaaagaacatcagcgtgtggtgcaagcaggccgaggagatcagaaacatccacaacgacgagctgatgggcatcagaagagaggaggagatggagatgagcgacgacgagatcgaggagatgaccgagaccaaggagaccgaggagagcgccctggtgagccaggccgaggccctgaaggaggagaacgacagcctgagatggcagctggacgcctacagaaacgaggtggagctgctgaagcaggagcagggcaaggtgcacagagaggacgaccccaacaaggagcagcagctgaagctgctgcagcaggccctgcagggcatgcagcagcacctgctgaaggtgcaggaggagtacaagaagaaggaggccgagctggagaagctgaaggacgacaagctgcaggtggagaagatgctggagaacctgaaggagaaggagagctgcgccagcagactgtgcgccagcaaccaggacagcgagtaccccctggagaagaccatgaacagcagccccatcaagagcgagagagaggccctgctggtgggcatcatcagcaccttcctgcacgtgcaccccttcggcgccagcatcgagtacatctgcagctacctgcacagactggacaacaagatctgcaccagcgacgtggagtgcctgatgggcagactgcagcacaccttcaagcaggagatgaccggcgtgggcgccagcctggagaagagatggaagttctgcggcttcgagggcctgaagctgacctag

SEQ ID NO: 80085 - DNA, 1917 bp, Artificial Sequence
  Description of Artificial Sequence: Synthetic coding sequence
ctgcccttcgaccccgccaacaacaacgagcccctgcagttcggcagcgccagcggccccctggtgaccgagggcctgatcgagaacggcggcgagagcagcaagaagagaaagagaaccaacacccccagcgccgacaacagcagaaccctgaacgtggacagcaccgccatgaccctgcccatgagcgaccccaccgcctgggccaccgccatgaacaacctgggcatggcccccctgggcatcgccggccagcccatcctgcccgacttcgaccccgccctgggcatgatgaccggcatcccccccatcacccccatgatgcccggcctgggcatcgtgcccccccccatcccccccgacatgcccgtggtgaaggagatcatccactgcaagagctgcaccctgttcccccccaaccccaacctgcccccccccgccaccagagagagaccccccggctgcaagaccgtgttcgtgggcggcctgcccgagaacggcaccgagcagatcatcgtggaggtgttcgagcagtgcggcgagatcatcgccatcagaaagagcaagaagaacttctgccacatcagattcgccgaggagtacatggtggacaaggccctgtacctgagcggctacagaatcagactgggcagcagcaccgacaagaaggacaccggcagactgcacgtggacttcgcccaggccagagacgacctgtacgagtgggagtgcaagcagagaatgctggccagagaggagagacacagaagaagaatggaggaggagagactgagaccccccagccccccccccgtggtgcactacagcgaccacgagtgcagcatcgtggccgagaagctgaaggacgacagcaagttcagcgaggccgtgcagaccctgctgacctggatcgagagaggcgaggtgaacagaagaagcgccaacaacttctacagcatgatccagagcgccaacagccacgtgagaagactggtgaacgagaaggccgcccacgagaaggacatggaggaggccaaggagaagttcaagcaggccctgagcggcatcctgatccagttcgagcagatcgtggccgtgtaccacagcgccagcaagcagaaggcctgggaccacttcaccaaggcccagagaaagaacatcagcgtgtggtgcaagcaggccgaggagatcagaaacatccacaacgacgagctgatgggcatcagaagagaggaggagatggagatgagcgacgacgagatcgaggagatgaccgagaccaaggagaccgaggagagcgccctggtgagccaggccgaggccctgaaggaggagaacgacagcctgagatggcagctggacgcctacagaaacgaggtggagctgctgaagcaggagcagggcaaggtgcacagagaggacgaccccaacaaggagcagcagctgaagctgctgcagcaggccctgcagggcatgcagcagcacctgctgaaggtgcaggaggagtacaagaagaaggaggccgagctggagaagctgaaggacgacaagctgcaggtggagaagatgctggagaacctgaaggagaaggagagctgcgccagcagactgtgcgccagcaaccaggacagcgagtaccccctggagaagaccatgaacagcagccccatcaagagcgagagagaggccctgctggtgggcatcatcagcaccttcctgcacgtgcaccccttcggcgccagcatcgagtacatctgcagctacctgcacagactggacaacaagatctgcaccagcgacgtggagtgcctgatgggcagactgcagcacaccttcaagcaggagatgaccggcgtgggcgccagcctggagaagagatggaagttctgcggcttcgagggcctgaagctgacctag

SEQ ID NO: 80086 - DNA, 1833 bp, Artificial Sequence; identical to SEQ ID NO: 80084
  Description of Artificial Sequence: Synthetic coding sequence

SEQ ID NO: 80087 - DNA, 1746 bp, Artificial Sequence
  Description of Artificial Sequence: Synthetic coding sequence
atgaccctgcccatgagcgaccccaccgcctgggccaccgccatgaacaacctgggcatggcccccctgggcatcgccggccagcccatcctgcccgacttcgaccccgccctgggcatgatgaccggcatcccccccatcacccccatgatgcccggcctgggcatcgtgcccccccccatcccccccgacatgcccgtggtgaaggagatcatccactgcaagagctgcaccctgttcccccccaaccccaacctgcccccccccgccaccagagagagaccccccggctgcaagaccgtgttcgtgggcggcctgcccgagaacggcaccgagcagatcatcgtggaggtgttcgagcagtgcggcgagatcatcgccatcagaaagagcaagaagaacttctgccacatcagattcgccgaggagtacatggtggacaaggccctgtacctgagcggctacagaatcagactgggcagcagcaccgacaagaaggacaccggcagactgcacgtggacttcgcccaggccagagacgacctgtacgagtgggagtgcaagcagagaatgctggccagagaggagagacacagaagaagaatggaggaggagagactgagaccccccagccccccccccgtggtgcactacagcgaccacgagtgcagcatcgtggccgagaagctgaaggacgacagcaagttcagcgaggccgtgcagaccctgctgacctggatcgagagaggcgaggtgaacagaagaagcgccaacaacttctacagcatgatccagagcgccaacagccacgtgagaagactggtgaacgagaaggccgcccacgagaaggacatggaggaggccaaggagaagttcaagcaggccctgagcggcatcctgatccagttcgagcagatcgtggccgtgtaccacagcgccagcaagcagaaggcctgggaccacttcaccaaggcccagagaaagaacatcagcgtgtggtgcaagcaggccgaggagatcagaaacatccacaacgacgagctgatgggcatcagaagagaggaggagatggagatgagcgacgacgagatcgaggagatgaccgagaccaaggagaccgaggagagcgccctggtgagccaggccgaggccctgaaggaggagaacgacagcctgagatggcagctggacgcctacagaaacgaggtggagctgctgaagcaggagcagggcaaggtgcacagagaggacgaccccaacaaggagcagcagctgaagctgctgcagcaggccctgcagggcatgcagcagcacctgctgaaggtgcaggaggagtacaagaagaaggaggccgagctggagaagctgaaggacgacaagctgcaggtggagaagatgctggagaacctgaaggagaaggagagctgcgccagcagactgtgcgccagcaaccaggacagcgagtaccccctggagaagaccatgaacagcagccccatcaagagcgagagagaggccctgctggtgggcatcatcagcaccttcctgcacgtgcaccccttcggcgccagcatcgagtacatctgcagctacctgcacagactggacaacaagatctgcaccagcgacgtggagtgcctgatgggcagactgcagcacaccttcaagcaggagatgaccggcgtgggcgccagcctggagaagagatggaagttctgcggcttcgagggcctgaagctgacctag

SEQ ID NO: 80088 - DNA, 1746 bp, Artificial Sequence; identical to SEQ ID NO: 80087
  Description of Artificial Sequence: Synthetic coding sequence

SEQ ID NO: 80089 - DNA, 1131 bp, Artificial Sequence
  Description of Artificial Sequence: Synthetic coding sequence
atgaccctgcccatgagcgaccccaccgcctgggccaccgccatgaacaacctgggcatggcccccctgggcatcgccggccagcccatcctgcccgacttcgaccccgccctgggcatgatgaccggcatcccccccatcacccccatgatgcccggcctgggcatcgtgcccccccccatcccccccgacatgcccgtggtgaaggagatcatccactgcaagagctgcaccctgttcccccccaaccccaacctgcccccccccgccaccagagagagaccccccggctgcaagaccgtgttcgtgggcggcctgcccgagaacggcaccgagcagatcatcgtggaggtgttcgagcagtgcggcgagatcatcgccatcagaaagagcaagaagaacttctgccacatcagattcgccgaggagtacatggtggacaaggccctgtacctgagcggctacagaatcagactgggcagcagcaccgacaagaaggacaccggcagactgcacgtggacttcgcccaggccagagacgacctgtacgagtgggagtgcaagcagagaatgctggccagagaggagagacacagaagaagaatggaggaggagagactgagaccccccagccccccccccgtggtgcactacagcgaccacgagtgcagcatcgtggccgagaagctgaaggacgacagcaagttcagcgaggccgtgcagaccctgctgacctggatcgagagaggcgaggtgaacagaagaagcgccaacaacttctacagcatgatccagagcgccaacagccacgtgagaagactggtgaacgagaaggccgcccacgagaaggacatggaggaggccaaggagaagttcaagcaggccctgagcggcatcctgatccagttcgagcagatcgtggccgtgtaccacagcgccagcaagcagaaggcctgggaccacttcaccaaggcccagagaaagaacatcagcgtgtggtgcaagcaggccgaggagatcagaaacatccacaacgacgagctgatgggcatcagaagagaggaggagatggagatgagcgacgacgagatcgaggagatgaccgagaccaaggagaccgaggagagctag

SEQ ID NO: 80090 - DNA, 1407 bp, Artificial Sequence
  Description of Artificial Sequence: Synthetic coding sequence
atgaccctgcccatgagcgaccccaccgcctgggccaccgccatgaacaacctgggcatggcccccctgggcatcgccggccagcccatcctgcccgacttcgaccccgccctgggcatgatgaccggcatcccccccatcacccccatgatgcccggcctgggcatcgtgcccccccccatcccccccgacatgcccgtggtgaaggagatcatccactgcaagagctgcaccctgttcccccccaaccccaacctgcccccccccgccaccagagagagaccccccggctgcaagaccgtgttcgtgggcggcctgcccgagaacggcaccgagcagatcatcgtggaggtgttcgagcagtgcggcgagatcatcgccatcagaaagagcaagaagaacttctgccacatcagattcgccgaggagtacatggtggacaaggccctgtacctgagcggctacagaatcagactgggcagcagcaccgacaagaaggacaccggcagactgcacgtggacttcgcccaggccagagacgacctgtacgagtgggagtgcaagcagagaatgctggccagagaggagagacacagaagaagaatggaggaggagagactgagaccccccagccccccccccgtggtgcactacagcgaccacgagtgcagcatcgtggccgagaagctgaaggacgacagcaagttcagcgaggccgtgcagaccctgctgacctggatcgagagaggcgaggtgaacagaagaagcgccaacaacttctacagcatgatccagagcgccaacagccacgtgagaagactggtgaacgagaaggccgcccacgagaaggacatggaggaggccaaggagaagttcaagcaggccctgagcggcatcctgatccagttcgagcagatcgtggccgtgtaccacagcgccagcaagcagaaggcctgggaccacttcaccaaggcccagagaaagaacatcagcgtgtggtgcaagcaggccgaggagatcagaaacatccacaacgacgagctgatgggcatcagaagagaggaggagatggagatgagcgacgacgagatcgaggagatgaccgagaccaaggagaccgaggagagcgccctggtgagccaggccgaggccctgaaggaggagaacgacagcctgagatggcagctggacgcctacagaaacgaggtggagctgctgaagcaggagcagggcaaggtgcacagagaggacgaccccaacaaggagcagcagctgaagctgctgcagcaggccctgcagggcatgcagcagcacctgctgaaggtgcaggaggagtacaagaagaaggaggccgagctggagaagctgaaggacgacaagctgcaggtggagaagatgaagaagtag

SEQ ID NO: 80091 - DNA, 1119 bp, Artificial Sequence
  Description of Artificial Sequence: Synthetic coding sequence
atggagagcgaggagctggccgacagagtgctggacgtggtggagagaagcctgagcaactaccccttcgacttccagggcgccagaatcatcaccggccaggaggagggcgcctacggctggatcaccatcaactacctgctgggcaagttcagccagaagaccagatggttcagcatcgtgccctacgagaccaacaaccaggagaccttcggcgccctggacctgggcggcgccagcacccaggtgaccttcgtgccccagaaccagaccatcgagagccccgacaacgccctgcagttcagactgtacggcaaggactacaacgtgtacacccacagcttcctgtgctacggcaaggaccaggccctgtggcagaagctggccaaggacatccaggtggccagcaacgagatcctgagagacccctgcttccaccccggctacaagaaggtggtgaacgtgagcgacctgtacaagaccccctgcaccaagagattcgagatgaccctgcccttccagcagttcgagatccagggcatcggcaactaccagcagtgccaccagagcatcctggagctgttcaacaccagctactgcccctacagccagtgcgccttcaacggcatcttcctgccccccctgcagggcgacttcggcgccttcagcgccttctacttcgtgatgaagttcctgaacctgaccagcgagaaggtgagccaggagaaggtgaccgagatgatgaagaagttctgcgcccagccctgggaggagatcaagaccagctacgccggcgtgaaggagaagtacctgagcgagtactgcttcagcggcacctacatcctgagcctgctgctgcagggctaccacttcaccgccgacagctgggagcacatccacttcatcggcaagatccagggcagcgacgccggctggaccctgggctacatgctgaacctgaccaacatgatccccgccgagcagcccctgagcacccccctgagccacagcacctacgtgttcctgatggtgctgttcagcctggtgctgttcaccgtggccatcatcggcctgctgatcttccacaagcccagctacttctggaaggacatggtgtag

SEQ ID NO: 80092 - DNA, 1533 bp, Artificial Sequence
  Description of Artificial Sequence: Synthetic coding sequence
atggaggacaccaaggagagcaacgtgaagaccttctgcagcaagaacatcctggccatcctgggcttcagcagcatcatcgccgtgatcgccctgctggccgtgggcctgacccagaacaaggccctgcccgagaacgtgaagtacggcatcgtgctggacgccggcagcagccacaccagcctgtacatctacaagtggcccgccgagaaggagaacgacaccggcgtggtgcaccaggtggaggagtgcagagtgaagggccccggcatcagcaagttcgtgcagaaggtgaacgagatcggcatctacctgaccgactgcatggagagagccagagaggtgatccccagaagccagcaccaggagacccccgtgtacctgggcgccaccgccggcatgagactgctgagaatggagagcgaggagctggccgacagagtgctggacgtggtggagagaagcctgagcaactaccccttcgacttccagggcgccagaatcatcaccggccaggaggagggcgcctacggctggatcaccatcaactacctgctgggcaagttcagccagaagaccagatggttcagcatcgtgccctacgagaccaacaaccaggagaccttcggcgccctggacctgggcggcgccagcacccaggtgaccttcgtgccccagaaccagaccatcgagagccccgacaacgccctgcagttcagactgtacggcaaggactacaacgtgtacacccacagcttcctgtgctacggcaaggaccaggccctgtggcagaagctggccaaggacatccaggtggccagcaacgagatcctgagagacccctgcttccaccccggctacaagaaggtggtgaacgtgagcgacctgtacaagaccccctgcaccaagagattcgagatgaccctgcccttccagcagttcgagatccagggcatcggcaactaccagcagtgccaccagagcatcctggagctgttcaacaccagctactgcccctacagccagtgcgccttcaacggcatcttcctgccccccctgcagggcgacttcggcgccttcagcgccttctacttcgtgatgaagttcctgaacctgaccagcgagaaggtgagccaggagaaggtgaccgagatgatgaagaagttctgcgcccagccctgggaggagatcaagaccagctacgccggcgtgaaggagaagtacctgagcgagtactgcttcagcggcacctacatcctgagcctgctgctgcagggctaccacttcaccgccgacagctgggagcacatccacttcatcggcaagatccagggcagcgacgccggctggaccctgggctacatgctgaacctgaccaacatgatccccgccgagcagcccctgagcacccccctgagccacagcacctacgtgttcctgatggtgctgttcagcctggtgctgttcaccgtggccatcatcggcctgctgatcttccacaagcccagctacttctggaaggacatggtgtag

SEQ ID NO: 80093 - DNA, 921 bp, Artificial Sequence
  Description of Artificial Sequence: Synthetic coding sequence
atgaagggcaccaaggacctgaccagccagcagaaggagagcaacgtgaagaccttctgcagcaagaacatcctggccatcctgggcttcagcagcatcatcgccgtgatcgccctgctggccgtgggcctgacccagaacaaggccctgcccgagaacgtgaagtacggcatcgtgctggacgccggcagcagccacaccagcctgtacatctacaagtggcccgccgagaaggagaacgacaccggcgtggtgcaccaggtggaggagtgcagagtgaagggccccggcatcagcaagttcgtgcagaaggtgaacgagatcggcatctacctgaccgactgcatggagagagccagagaggtgatccccagaagccagcaccaggagacccccgtgtacctgggcgccaccgccggcatgagactgctgagaatggagagcgaggagctggccgacagagtgctggacgtggtggagagaagcctgagcaactaccccttcgacttccagggcgccagaatcatcaccggccaggaggagggcgcctacggctggatcaccatcaactacctgctgggcaagttcagccagaagaccagatggttcagcatcgtgccctacgagaccaacaaccaggagaccttcggcgccctggacctgggcggcgccagcacccaggtgaccttcgtgccccagaaccagaccatcgagagccccgacaacgccctgcagttcagactgtacggcaaggactacaacgtgtacacccacagcttcctgtgctacggcaaggaccaggccctgtggcagaagctggccaaggacatccaggccagcatcacccagagcagacccgcccccttcaccagcgccccccccgcccccaccagctgctgcttcctgttccagatccagtag

SEQ ID NO: 80094 - DNA, 1569 bp, Artificial Sequence
  Description of Artificial Sequence: Synthetic coding sequence
atgggcagagaggagctgttcctgaccttcagcttcagcagcggcttccaggagagcaacgtgaagaccttctgcagcaagaacatcctggccatcctgggcttcagcagcatcatcgccgtgatcgccctgctggccgtgggcctgacccagaacaaggccctgcccgagaacgtgaagtacggcatcgtgctggacgccggcagcagccacaccagcctgtacatctacaagtggcccgccgagaaggagaacgacaccggcgtggtgcaccaggtggaggagtgcagagtgaagggccccggcatcagcaagttcgtgcagaaggtgaacgagatcggcatctacctgaccgactgcatggagagagccagagaggtgatccccagaagccagcaccaggagacccccgtgtacctgggcgccaccgccggcatgagactgctgagaatggagagcgaggagctggccgacagagtgctggacgtggtggagagaagcctgagcaactaccccttcgacttccagggcgccagaatcatcaccggccaggaggagggcgcctacggctggatcaccatcaactacctgctgggcaagttcagccagaagaccagatggttcagcatcgtgccctacgagaccaacaaccaggagaccttcggcgccctggacctgggcggcgccagcacccaggtgaccttcgtgccccagaaccagaccatcgagagccccgacaacgccctgcagttcagactgtacggcaaggactacaacgtgtacacccacagcttcctgtgctacggcaaggaccaggccctgtggcagaagctggccaaggacatccaggtggccagcaacgagatcctgagagacccctgcttccaccccggctacaagaaggtggtgaacgtgagcgacctgtacaagaccccctgcaccaagagattcgagatgaccctgcccttccagcagttcgagatccagggcatcggcaactaccagcagtgccaccagagcatcctggagctgttcaacaccagctactgcccctacagccagtgcgccttcaacggcatcttcctgccccccctgcagggcgacttcggcgccttcagcgccttctacttcgtgatgaagttcctgaacctgaccagcgagaaggtgagccaggagaaggtgaccgagatgatgaagaagttctgcgcccagccctgggaggagatcaagaccagctacgccggcgtgaaggagaagtacctgagcgagtactgcttcagcggcacctacatcctgagcctgctgctgcagggctaccacttcaccgccgacagctgggagcacatccacttcatcggcaagatccagggcagcgacgccggctggaccctgggctacatgctgaacctgaccaacatgatccccgccgagcagcccctgagcacccccctgagccacagcacctacgtgttcctgatggtgctgttcagcctggtgctgttcaccgtggccatcatcggcctgctgatcttccacaagcccagctacttctggaaggacatggtgtag

SEQ ID NO: 80095 - DNA, 1554 bp, Artificial Sequence
  Description of Artificial Sequence: Synthetic coding sequence
atgaagggcaccaaggacctgaccagccagcagaaggagagcaacgtgaagaccttctgcagcaagaacatcctggccatcctgggcttcagcagcatcatcgccgtgatcgccctgctggccgtgggcctgacccagaacaaggccctgcccgagaacgtgaagtacggcatcgtgctggacgccggcagcagccacaccagcctgtacatctacaagtggcccgccgagaaggagaacgacaccggcgtggtgcaccaggtggaggagtgcagagtgaagggccccggcatcagcaagttcgtgcagaaggtgaacgagatcggcatctacctgaccgactgcatggagagagccagagaggtgatccccagaagccagcaccaggagacccccgtgtacctgggcgccaccgccggcatgagactgctgagaatggagagcgaggagctggccgacagagtgctggacgtggtggagagaagcctgagcaactaccccttcgacttccagggcgccagaatcatcaccggccaggaggagggcgcctacggctggatcaccatcaactacctgctgggcaagttcagccagaagaccagatggttcagcatcgtgccctacgagaccaacaaccaggagaccttcggcgccctggacctgggcggcgccagcacccaggtgaccttcgtgccccagaaccagaccatcgagagccccgacaacgccctgcagttcagactgtacggcaaggactacaacgtgtacacccacagcttcctgtgctacggcaaggaccaggccctgtggcagaagctggccaaggacatccaggtggccagcaacgagatcctgagagacccctgcttccaccccggctacaagaaggtggtgaacgtgagcgacctgtacaagaccccctgcaccaagagattcgagatgaccctgcccttccagcagttcgagatccagggcatcggcaactaccagcagtgccaccagagcatcctggagctgttcaacaccagctactgcccctacagccagtgcgccttcaacggcatcttcctgccccccctgcagggcgacttcggcgccttcagcgccttctacttcgtgatgaagttcctgaacctgaccagcgagaaggtgagccaggagaaggtgaccgagatgatgaagaagttctgcgcccagccctgggaggagatcaagaccagctacgccggcgtgaaggagaagtacctgagcgagtactgcttcagcggcacctacatcctgagcctgctgctgcagggctaccacttcaccgccgacagctgggagcacatccacttcatcggcaagatccagggcagcgacgccggctggaccctgggctacatgctgaacctgaccaacatgatccccgccgagcagcccctgagcacccccctgagccacagcacctacgtgttcctgatggtgctgttcagcctggtgctgttcaccgtggccatcatcggcctgctgatcttccacaagcccagctacttctggaaggacatggtgtag

SEQ ID NO: 80096 - DNA, 1119 bp, Artificial Sequence; identical to SEQ ID NO: 80091
  Description of Artificial Sequence: Synthetic coding sequence

SEQ ID NO: 80097 - DNA, 1209 bp, Artificial Sequence
  Description of Artificial Sequence: Synthetic coding sequence
atggagagagccagagaggtgatccccagaagccagcaccaggagacccccgtgtacctgggcgccaccgccggcatgagactgctgagaatggagagcgaggagctggccgacagagtgctggacgtggtggagagaagcctgagcaactaccccttcgacttccagggcgccagaatcatcaccggccaggaggagggcgcctacggctggatcaccatcaactacctgctgggcaagttcagccagaagaccagatggttcagcatcgtgccctacgagaccaacaaccaggagaccttcggcgccctggacctgggcggcgccagcacccaggtgaccttcgtgccccagaaccagaccatcgagagccccgacaacgccctgcagttcagactgtacggcaaggactacaacgtgtacacccacagcttcctgtgctacggcaaggaccaggccctgtggcagaagctggccaaggacatccaggtggccagcaacgagatcctgagagacccctgcttccaccccggctacaagaaggtggtgaacgtgagcgacctgtacaagaccccctgcaccaagagattcgagatgaccctgcccttccagcagttcgagatccagggcatcggcaactaccagcagtgccaccagagcatcctggagctgttcaacaccagctactgcccctacagccagtgcgccttcaacggcatcttcctgccccccctgcagggcgacttcggcgccttcagcgccttctacttcgtgatgaagttcctgaacctgaccagcgagaaggtgagccaggagaaggtgaccgagatgatgaagaagttctgcgcccagccctgggaggagatcaagaccagctacgccggcgtgaaggagaagtacctgagcgagtactgcttcagcggcacctacatcctgagcctgctgctgcagggctaccacttcaccgccgacagctgggagcacatccacttcatcggcaagatccagggcagcgacgccggctggaccctgggctacatgctgaacctgaccaacatgatccccgccgagcagcccctgagcacccccctgagccacagcacctacgtgttcctgatggtgctgttcagcctggtgctgttcaccgtggccatcatcggcctgctgatcttccacaagcccagctacttctggaaggacatggtgtag

SEQ ID NO: 80098 - DNA, 1419 bp, Artificial Sequence
  Description of Artificial Sequence: Synthetic coding sequence
atggccggcaaggtgagaagcctgctgccccccctgctgctggccgccgccggcctggccggcctgctgctgctgtgcgtgcccaccagagacgtgagagagccccccgccctgaagtacggcatcgtgctggacgccggcagcagccacaccagcatgttcatctacaagtggcccgccgacaaggagaacgacaccggcatcgtgggccagcacagcagctgcgacgtgcccggcggcggcatcagcagctacgccgacaaccccagcggcgccagccagagcctggtgggctgcctggagcaggccctgcaggacgtgcccaaggagagacacgccggcacccccctgtacctgggcgccaccgccggcatgagactgctgaacctgaccaaccccgaggccagcaccagcgtgctgatggccgtgacccacaccctgacccagtaccccttcgacttcagaggcgccagaatcctgagcggccaggaggagggcgtgttcggctgggtgaccgccaactacctgctggagaacttcatcaagtacggctgggtgggcagatggttcagacccagaaagggcaccctgggcgccatggacctgggcggcgccagcacccagatcaccttcgagaccaccagccccgccgaggacagagccagcgaggtgcagctgcacctgtacggccagcactacagagtgtacacccacagcttcctgtgctacggcagagaccaggtgctgcagagactgctggccagcgccctgcagacccacggcttccacccctgctggcccagaggcttcagcacccaggtgctgctgggcgacgtgtaccagagcccctgcaccatggcccagagaccccagaacttcaacagcagcgccagagtgagcctgagcggcagcagcgacccccacctgtgcagagacctggtgagcggcctgttcagcttcagcagctgccccttcagcagatgcagcttcaacggcgtgttccagccccccgtggccggcaacttcgtggccttcagcgccttcttctacaccgtggacttcctgagaaccagcatgggcctgcccgtggccaccctgcagcagctggaggccgccgccgtgaacgtgtgcaaccagacctgggcccagcagctgctgagcagaggctacggcttcgacgagagagccttcggcggcgtgatcttccagaagaaggccgccgacaccgccgtgggctgggccctgggctacatgctgaacctgaccaacctgatccccgccgacccccccggcctgagaaagggcaccgacttcagcagctgggtggtgctgctgctgctgttcgccagcgccctgctggccgccctggtgctgctgctgagacaggtgcacagcgccaagctgcccagcaccatctag

SEQ ID NO: 80099 - DNA, 1488 bp, Artificial Sequence
  Description of Artificial Sequence: Synthetic coding sequence
atggccggcaaggtgagaagcctgctgccccccctgctgctggccgccgccggcctggccggcctgctgctgctgtgcgtgcccaccagagacgtgagagagccccccgccctgaagtacggcatcgtgctggacgccggcagcagccacaccagcatgttcatctacaagtggcccgccgacaaggagaacgacaccggcatcgtgggccagcacagcagctgcgacgtgcccggcggcggcatcagcagctacgccgacaaccccagcggcgccagccagagcctggtgggctgcctggagcaggccctgcaggacgtgcccaaggagagacacgccggcacccccctgtacctgggcgccaccgccggcatgagactgctgaacctgaccaaccccgaggccagcaccagcgtgctgatggccgtgacccacaccctgacccagtaccccttcgacttcagaggcgccagaatcctgagcggccaggaggagggcgtgttcggctgggtgaccgccaactacctgctggagaacttcatcaagtacggctgggtgggcagatggttcagacccagaaagggcaccctgggcgccatggacctgggcggcgccagcacccagatcaccttcgagaccaccagccccgccgaggacagagccagcgaggtgcagctgcacctgtacggccagcactacagagtgtacacccacagcttcctgtgctacggcagagaccaggtgctgcagagactgctggccagcgccctgcagacccacggcttccacccctgctggcccagaggcttcagcacccaggtgctgctgggcgacgtgtaccagagcccctgcaccatggcccagagaccccagaacttcaacagcagcgccagagtgagcctgagcggcagcagcgacccccacctgtgcagagacctggtgagcggcctgttcagcttcagcagctgccccttcagcagatgcagcttcaacggcgtgttccagccccccgtggccggcaacttcgtggccttcagcgccttcttctacaccgtggacttcctgagaaccagcatgggcctgcccgtggccaccctgcagcagctggaggccgccgccgtgaacgtgtgcaaccagacctgggcccagctgcaggccagagtgcccggccagagagccagactggccgactactgcgccggcgccatgttcgtgcagcagctgctgagcagaggctacggcttcgacgagagagccttcggcggcgtgatcttccagaagaaggccgccgacaccgccgtgggctgggccctgggctacatgctgaacctgaccaacctgatccccgccgacccccccggcctgagaaagggcaccgacttcagcagctgggtggtgctgctgctgctgttcgccagcgccctgctggccgccctggtgctgctgctgagacaggtgcacagcgccaagctgcccagcaccatctag

SEQ ID NO: 80100 - DNA, 1590 bp, Artificial Sequence
  Description of Artificial Sequence: Synthetic coding sequence
atgttcaccgtgctgaccagacagccctgcgagcaggccggcctgaaggccctgtacagaacccccaccatcatcgccctggtggtgctgctggtgagcatcgtggtgctggtgagcatcaccgtgatccagatccacaagcaggaggtgctgccccccggcctgaagtacggcatcgtgctggacgccggcagcagcagaaccaccgtgtacgtgtaccagtggcccgccgagaaggagaacaacaccggcgtggtgagccagaccttcaagtgcagcgtgaagggcagcggcatcagcagctacggcaacaacccccaggacgtgcccagagccttcgaggagtgcatgcagaaggtgaagggccaggtgcccagccacctgcacggcagcacccccatccacctgggcgccaccgccggcatgagactgctgagactgcagaacgagaccgccgccaacgaggtgctggagagcatccagagctacttcaagagccagcccttcgacttcagaggcgcccagatcatcagcggccaggaggagggcgtgtacggctggatcaccgccaactacctgatgggcaacttcctggagaagaacctgtggcacatgtgggtgcacccccacggcgtggagaccaccggcgccctggacctgggcggcgccagcacccagatcagcttcgtggccggcgagaagatggacctgaacaccagcgacatcatgcaggtgagcctgtacggctacgtgtacaccctgtacacccacagcttccagtgctacggcagaaacgaggccgagaagaagttcctggccatgctgctgcagaacagccccaccaagaaccacctgaccaacccctgctaccccagagactacagcatcagcttcaccatgggccacgtgttcgacagcctgtgcaccgtggaccagagacccgagagctacaaccccaacgacgtgatcaccttcgagggcaccggcgaccccagcctgtgcaaggagaaggtggccagcatcttcgacttcaaggcctgccacgaccaggagacctgcagcttcgacggcgtgtaccagcccaagatcaagggccccttcgtggccttcgccggcttctactacaccgccagcgccctgaacctgagcggcagcttcagcctggacaccttcaacagcagcacctggaacttctgcagccagaactggagccagctgcccctgctgctgcccaagttcgacgaggtgtacgccagaagctactgcttcagcgccaactacatctaccacctgttcgtgaacggctacaagttcaccgaggagacctggccccagatccacttcgagaaggaggtgggcaacagcagcatcgcctggagcctgggctacatgctgagcctgaccaaccagatccccgccgagagccccctgatcagactgcccatcgagccccccgtgttcgtgggcaccctggccttcttcaccgccgccgccctgctgtgcctggccttcctggcctacctgtgcagcgccaccagaagaaagagacacagcgagcacgccttcgaccacgccgtggacagcgactag

SEQ ID NO: 80101 - DNA, 1590 bp, Artificial Sequence; identical to SEQ ID NO: 80100
  Description of Artificial Sequence: Synthetic coding sequence

SEQ ID NO: 80102 - DNA, 1287 bp, Artificial Sequence
  Description of Artificial Sequence: Synthetic coding sequence
atggccaccagctggggcaccgtgttcttcatgctggtggtgagctgcgtgtgcagcgccgtgagccacagaaaccagcagacctggttcgagggcatcttcctgagcagcatgtgccccatcaacgtgagcgccagcaccctgtacggcatcatgttcgacgccggcagcaccggcaccagaatccacgtgtacaccttcgtgcagaagatgcccggccagctgcccatcctggagggcgaggtgttcgacagcgtgaagcccggcctgagcgccttcgtggaccagcccaagcagggcgccgagaccgtgcagggcctgctggaggtggccaaggacagcatccccagaagccactggaagaagacccccgtggtgctgaaggccaccgccggcctgagactgctgcccgagcacaaggccaaggccctgctgttcgaggtgaaggagatcttcagaaagagccccttcctggtgcccaagggcagcgtgagcatcatggacggcagcgacgagggcatcctggcctgggtgaccgtgaacttcctgaccggccagctgcacggccacagacaggagaccgtgggcaccctggacctgggcggcgccagcacccagatcaccttcctgccccagttcgagaagaccctggagcagacccccagaggctacctgaccagcttcgagatgttcaacagcacctacaagctgtacacccacagctacctgggcttcggcctgaaggccgccagactggccaccctgggcgccctggagaccgagggcaccgacggccacaccttcagaagcgcctgcctgcccagatggctggaggccgagtggatcttcggcggcgtgaagtaccagtacggcggcaaccaggagggcgaggtgggcttcgagccctgctacgccgaggtgctgagagtggtgagaggcaagctgcaccagcccgaggaggtgcagagaggcagcttctacgccttcagctactactacgacagagccgtggacaccgacatgatcgactacgagaagggcggcatcctgaaggtggaggacttcgagagaaaggccagagaggtgtgcgacaacctggagaacttcaccagcggcagccccttcctgtgcatggacctgagctacatcaccgccctgctgaaggacggcttcggcttcgccgacagcaccgtgctgcagctgaccaagaaggtgaacaacatcgagaccggctgggccctgggcgccaccttccacctgctgcagagcctgggcatcagccactag

SEQ ID NO: 80103 - DNA, 1404 bp, Artificial Sequence
  Description of Artificial Sequence: Synthetic coding sequence
atgcagccccagcacggcccctggcagaccagaatgagaaagatcagcaaccacggcagcctgagagtggccaaggtggcctaccccctgggcctgtgcgtgggcgtgttcatctacgtggcctacatcaagtggcacagagccaccgccacccaggccttcttcagcatcaccagagccgcccccggcgccagatggggccagcaggcccacagccccctgggcaccgccgccgacggccacgaggtgttctacggcatcatgttcgacgccggcagcaccggcaccagagtgcacgtgttccagttcaccagaccccccagagagacccccaccctgacccacgagaccttcaaggccctgaagcccggcctgagcgcctacgccgacgacgtggagaagagcgcccagggcatcagagagctgctggacgtggccaagcaggacatccccttcgacttctggaaggccacccccctggtgctgaaggccaccgccggcctgagactgctgcccggcgagaaggcccagaagctgctgcagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagcccgccaaggacggcaaggagctggtgagcccctgcctgagccccagcttcaagggcgagtgggagcacgccgaggtgacctacagagtgagcggccagaaggccgccgccagcctgcacgagctgtgcgccgccagagtgagcgaggtgctgcagaacagagtgcacagaaccgaggaggtgaagcacgtggacttctacgccttcagctactactacgacctggccgccggcgtgggcctgatcgacgccgagaagggcggcagcctggtggtgggcgacttcgagatcgccgccaagtacgtgtgcagaaccctggagacccagccccagagcagccccttcagctgcatggacctgacctacgtgagcctgctgctgcaggagttcggcttccccagaagcaaggtgctgaagctgaccagaaagatcgacaacgtggagaccagctgggccctgggcgccatcttccactacatcgacagcctgaacagacagaagagccccgccagctag

SEQ ID NO: 80104 - DNA, 1452 bp, Artificial Sequence
  Description of Artificial Sequence: Synthetic coding sequence
atgaagaagggcatcagatacgagaccagcagaaagaccagctacatcttccagccccagcacggcccctggcagaccagaatgagaaagatcagcaaccacggcagcctgagagtggccaaggtggcctaccccctgggcctgtgcgtgggcgtgttcatctacgtggcctacatcaagtggcacagagccaccgccacccaggccttcttcagcatcaccagagccgcccccggcgccagatggggccagcaggcccacagccccctgggcaccgccgccgacggccacgaggtgttctacggcatcatgttcgacgccggcagcaccggcaccagagtgcacgtgttccagttcaccagaccccccagagagacccccaccctgacccacgagaccttcaaggccctgaagcccggcctgagcgcctacgccgacgacgtggagaagagcgcccagggcatcagagagctgctggacgtggccaagcaggacatccccttcgacttctggaaggccacccccctggtgctgaaggccaccgccggcctgagactgctgcccggcgagaaggcccagaagctgctgcagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagcccgccaaggacggcaaggagctggtgagcccctgcctgagccccagcttcaagggcgagtgggagcacgccgaggtgacctacagagtgagcggccagaaggccgccgccagcctgcacgagctgtgcgccgccagagtgagcgaggtgctgcagaacagagtgcacagaaccgaggaggtgaagcacgtggacttctacgccttcagctactactacgacctggccgccggcgtgggcctgatcgacgccgagaagggcggcagcctggtggtgggcgacttcgagatcgccgccaagtacgtgtgcagaaccctggagacccagccccagagcagccccttcagctgcatggacctgacctacgtgagcctgctgctgcaggagttcggcttccccagaagcaaggtgctgaagctgaccagaaagatcgacaacgtggagaccagctgggccctgggcgccatcttccactacatcgacagcctgaacagacagaagagccccgccagctag

SEQ ID NO: 80105 - DNA, 1104 bp, Artificial Sequence
  Description of Artificial Sequence: Synthetic coding sequence
atgttcgacgccggcagcaccggcaccagagtgcacgtgttccagttcaccagaccccccagagagacccccaccctgacccacgagaccttcaaggccctgaagcccggcctgagcgcctacgccgacgacgtggagaagagcgcccagggcatcagagagctgctggacgtggccaagcaggacatccccttcgacttctggaaggccacccccctggtgctgaaggccaccgccggcctgagactgctgcccggcgagaaggcccagaagctgctgcagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagcccgccaaggacggcaaggagctggtgagcccctgcctgagccccagcttcaagggcgagtgggagcacgccgaggtgacctacagagtgagcggccagaaggccgccgccagcctgcacgagctgtgcgccgccagagtgagcgaggtgctgcagaacagagtgcacagaaccgaggaggtgaagcacgtggacttctacgccttcagctactactacgacctggccgccggcgtgggcctgatcgacgccgagaagggcggcagcctggtggtgggcgacttcgagatcgccgccaagtacggcggcagccacctggagagagagggcacctgcctgatccccagcgtgagcgaccccggcgacaccgccgccgagcagcccctgctgatgcacggcccccacctgagacagcccgccacccccggcgtgagactgagccaggagcagagcgccgaggcccacagcgagaactag

SEQ ID NO: 80106 - DNA, 1455 bp, Artificial Sequence
  Description of Artificial Sequence: Synthetic coding sequence
atgaagaagggcatcagatacgagaccagcagaaagaccagctacatcttccagcagccccagcacggcccctggcagaccagaatgagaaagatcagcaaccacggcagcctgagagtggccaaggtggcctaccccctgggcctgtgcgtgggcgtgttcatctacgtggcctacatcaagtggcacagagccaccgccacccaggccttcttcagcatcaccagagccgcccccggcgccagatggggccagcaggcccacagccccctgggcaccgccgccgacggccacgaggtgttctacggcatcatgttcgacgccggcagcaccggcaccagagtgcacgtgttccagttcaccagaccccccagagagacccccaccctgacccacgagaccttcaaggccctgaagcccggcctgagcgcctacgccgacgacgtggagaagagcgcccagggcatcagagagctgctggacgtggccaagcaggacatccccttcgacttctggaaggccacccccctggtgctgaaggccaccgccggcctgagactgctgcccggcgagaaggcccagaagctgctgcagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagcccgccaaggacggcaaggagctggtgagcccctgcctgagccccagcttcaagggcgagtgggagcacgccgaggtgacctacagagtgagcggccagaaggccgccgccagcctgcacgagctgtgcgccgccagagtgagcgaggtgctgcagaacagagtgcacagaaccgaggaggtgaagcacgtggacttctacgccttcagctactactacgacctggccgccggcgtgggcctgatcgacgccgagaagggcggcagcctggtggtgggcgacttcgagatcgccgccaagtacgtgtgcagaaccctggagacccagccccagagcagccccttcagctgcatggacctgacctacgtgagcctgctgctgcaggagttcggcttccccagaagcaaggtgctgaagctgaccagaaagatcgacaacgtggagaccagctgggccctgggcgccatcttccactacatcgacagcctgaacagacagaagagccccgccagctag

SEQ ID NO: 80107 - DNA, 888 bp, Artificial Sequence
  Description of Artificial Sequence: Synthetic coding sequence
tgagtgctgaaggccaccgccggcctgagactgctgcccggcgagaaggcccagaagctgctgcagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagcccgccaaggacggcaaggagctggtgagcccctgcctgagccccagcttcaagggcgagtgggagcacgccgaggtgacctacagagtgagcggccagaaggccgccgccagcctgcacgagctgtgcgccgccagagtgagcgaggtgctgcagaacagagtgcacagaaccgaggaggtgaagcacgtggacttctacgccttcagctactactacgacctggccgccggcgtgggcctgatcgacgccgagaagggcggcagcctggtggtgggcgacttcgagatcgccgccaagtacggcggcagccacctggagagagagggcacctgcctgatccccagcgtgagcgaccccggcgacaccgccgccgagcagcccctgctgatgcacggcccccacctgagacagcccgccacccccggcgtgagactgagccaggagcagagcgccgaggcccacagcgagaactag

SEQ ID NO: 80108 - DNA, 681 bp, Artificial Sequence
  Description of Artificial Sequence: Synthetic coding sequence
atgccccagcacggcccctggcagaccagaatgagaaagatcagcaaccacggcagcctgagagtggccaaggtggcctaccccctgggcctgtgcgtgggcgtgttcatctacgtggcctacatcaagtggcacagagccaccgccacccaggccttcttcagcatcaccagagccgcccccggcgccagatggggccagcaggcccacagccccctgggcaccgccgccgacggccacgaggtgttctacggcatcatgttcgacgccggcagcaccggcaccagagtgcacgtgttccagttcaccagaccccccagagagacccccaccctgacccacgagaccttcaaggccctgaagcccggcctgagcgcctacgccgacgacgtggagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctactag

SEQ ID NO: 80109 - DNA, 588 bp, Artificial Sequence
  Description of Artificial Sequence: Synthetic coding sequence
atgcagccccagcacggcccctggcagaccagaatgagaaagatcagcaaccacggcagcctgagagtggccaaggtggcctaccccctgggcctgtgcgtgggcgtgttcatctacgtggcctacatcaagtggcacagagccaccgccacccaggccttcttcagcatcaccagagccgcccccggcgccagatggggccagcaggcccacagccccctgggcaccgccgccgacggccacgaggtgttctacggcatcatgttcgacgccggcagcaccggcaccagagtgcacgtgttccagttcaccagaccccccagagagacccccaccctgacccacgagaccttcaaggccctgaagcccggcctgagcgcctacgccgacgacgtggagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgcctag

SEQ ID NO: 80110 - DNA, 903 bp, Artificial Sequence
  Description of Artificial Sequence: Synthetic coding sequence
atgaagaagggcatcagatacgagaccagcagaaagaccagctacatcttccagcagccccagcacggcccctggcagaccagaatgagaaagatcagcaaccacggcagcctgagagtggccaaggtggcctaccccctgggcctgtgcgtgggcgtgttcatctacgtggcctacatcaagtggcacagagccaccgccacccaggccttcttcagcatcaccagagccgcccccggcgccagatggggccagcaggcccacagccccctgggcaccgccgccgacggccacgaggtgttctacggcatcatgttcgacgccggcagcaccggcaccagagtgcacgtgttccagttcaccagaccccccagagagacccccaccctgacccacgagaccttcaaggccctgaagcccggcctgagcgcctacgccgacgacgtggagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagcccgccaaggacggcaaggagctggtgagcccctgcctgagccccagcttcaagggcgagtgggagcacgccgaggtgacctacagagtgagcggccagaaggcctag

SEQ ID NO: 80111 - DNA, 453 bp, Artificial Sequence
  Description of Artificial Sequence: Synthetic coding sequence
tgacccggcagaggcagccccaaggacagactgccccccgcccccagaaagagagccctggtgagcgtgggcgtggccgagagagccgtgcacgagacccccaccctgacccacgagaccttcaaggccctgaagcccggcctgagcgcctacgccgacgacgtggagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctactag

SEQ ID NO: 80112 - DNA, 1314 bp, Artificial Sequence
  Description of Artificial Sequence: Synthetic coding sequence
atgaagaagggcatcagatacgagaccagcagaaagaccagctacatcttccagcagccccagcacggcccctggcagaccagaatgagaaagatcagcaaccacggcagcctgagagtggccaaggtggcctaccccctgggcctgtgcgtgggcgtgttcatctacgtggcctacatcaagtggcacagagccaccgccacccaggccttcttcagcatcaccagagccgcccccggcgccagatggggccagcaggcccacagccccctgggcaccgccgccgacggccacgaggtgttctacggcatcatgttcgacgccggcagcaccggcaccagagtgcacgtgttccagttcaccagaccccccagagagacccccaccctgacccacgagaccttcaaggccctgaagcccggcctgagcgcctacgccgacgacgtggagaagagcgcccagggcatcagagagctgctggacgtggccaagcaggacatccccttcgacttctggaaggccacccccctggtgctgaaggccaccgccggcctgagactgctgcccggcgagaaggcccagaagctgctgcagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagcccgccgccagcctgcacgagctgtgcgccgccagagtgagcgaggtgctgcagaacagagtgcacagaaccgaggaggtgaagcacgtggacttctacgccttcagctactactacgacctggccgccggcgtgggcctgatcgacgccgagaagggcggcagcctggtggtgggcgacttcgagatcgccgccaagtacggcggcagccacctggagagagagggcacctgcctgatccccagcgtgagcgaccccggcgacaccgccgccgagcagcccctgctgatgcacggcccccacctgagacagcccgccacccccggcgtgagactgagccaggagcagagcgccgaggcccacagcgagaactag

SEQ ID NO: 80113 - DNA, 945 bp, Artificial Sequence
  Description of Artificial Sequence: Synthetic coding sequence
tgaaacagaggcgtggtgagcagaggctggagacccggctggagaagacccggcagaggcagccccaaggacagactgccccccgcccccagaaagagagccctggtgagcgtgggcgtggccgagagagccgtgcacgagacccccaccctgacccacgagaccttcaaggccctgaagcccggcctgagcgcctacgccgacgacgtggagaagagcgcccagggcatcagagagctgctggacgtggccaagcaggacatccccttcgacttctggaaggccacccccctggtgctgaaggccaccgccggcctgagactgctgcccggcgagaaggcccagaagctgctgcagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagcccgccaaggacggcaaggagctggtgagcccctgcctgagccccagcttcaagggcgagtgggagcacgccgaggtgacctacagagtgagcggccagaaggccgccgccagcctgcacgagctgtgcgccgccagagtgagcgaggtgctgcagaacagagtgcacagaaccgaggaggtgaagcacgtggacttctacgccttcagctactactacgacctggccgccggcgtgggctag

SEQ ID NO: 80114 - DNA, 567 bp, Artificial Sequence
  Description of Artificial Sequence: Synthetic coding sequence
atgaagaagggcatcagatacgagaccagcagaaagaccagctacatcttccagccccagcacggcccctggcagaccagaatgagaaagatcagcaaccacggcagcctgagagtggccaaggtggcctaccccctgggcctgtgcgtgggcgtgttcatctacgtggcctacatcaagtggcacagagccaccgccacccaggccttcttcagcatcaccagagccgcccccggcgccagatggggccagcaggcccacagccccctgggcaccgccgccgacggccacgaggtgttctacggcatcatgttcgacgccggcagcaccggcaccagagtgcacgtgttccagttcaccagaccccccagagagacccccaccctgacccacgagaccttcaaggccctgaagcccggcctgagcgcctacgccgacgacgtggagaagagcgcccagggcatcagagagctgctggacgtggccaagcaggacatccccttcgacttctggaaggccacccccctggtgctgaaggccaccgccggcctgagactgctgccctag

SEQ ID NO: 80115 - DNA, 891 bp, Artificial Sequence
  Description of Artificial Sequence: Synthetic coding sequence
atgccccagcacggcccctggcagaccagaatgagaaagatcagcaaccacggcagcctgagagtggccaaggtggcctaccccctgggcctgtgcgtgggcgtgttcatctacgtggcctacatcaagtggcacagagccaccgccacccaggccttcttcagcatcaccagagccgcccccggcgccagatggggccagcaggcccacagccccctgggcaccgccgccgacggccacgaggtgttctacggcatcatgttcgacgccggcagcaccggcaccagagtgcacgtgttccagttcaccagaccccccagagagacccccaccctgacccacgagaccttcaaggccctgaagcccggcctgagcgcctacgccgacgacgtggagaagagcgcccagggcatcagagagctgctggacgtggccaagcaggacatccccttcgacttctggaaggccacccccctggtgctgaaggccaccgccggcctgagactgctgcccggcgagaaggcccagaagctgctgcagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagccctag

SEQ ID NO: 80116 - DNA, 936 bp, Artificial Sequence
  Description of Artificial Sequence: Synthetic coding sequence
tgaggcagcaccggcaccagagtgcacgtgttccagttcaccagaccccccagagagacccccaccctgacccacgagaccttcaaggccctgaagcccggcctgagcgcctacgccgacgacgtggagaagagcgcccagggcatcagagagctgctggacgtggccaagcaggacatccccttcgacttctggaaggccacccccctggtgctgaaggccaccgccggcctgagactgctgcccggcgagaaggcccagaagctgctgcagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagcccgccgccagcctgcacgagctgtgcgccgccagagtgagcgaggtgctgcagaacagagtgcacagaaccgaggaggtgaagcacgtggacttctacgccttcagctactactacgacctggccgccggcgtgggcctgatcgacgccgagaagggcggcagcctggtggtgggcgacttcgagatcgccgccaagtacgtgtgcagaaccctggagacccagccccagagcagccccttcagctgcatggacctgacctacgtgagcctgctgctgcaggagttcggcttccccagaagcaaggtgctgaagtag

SEQ ID NO: 80117 - DNA, 942 bp, Artificial Sequence
  Description of Artificial Sequence: Synthetic coding sequence
aacagaggcgtggtgagcagaggctggagacccggctggagaagacccggcagaggcagccccaaggacagactgccccccgcccccagaaagagagccctggtgagcgtgggcgtggccgagagagccgtgcacgagacccccaccctgacccacgagaccttcaaggccctgaagcccggcctgagcgcctacgccgacgacgtggagaagagcgcccagggcatcagagagctgctggacgtggccaagcaggacatccccttcgacttctggaaggccacccccctggtgctgaaggccaccgccggcctgagactgctgcccggcgagaaggcccagaagctgctgcagaaggtgaagaaggtgttcaaggccagccccttcctggtgggcgacgactgcgtgagcatcatgaacggcaccgacgagggcgtgagcgcctggatcaccatcaacttcctgaccggcagcctgaagacccccggcggcagcagcgtgggcatgctggacctgggcggcggcagcacccagatcgccttcctgcccagagtggagggcaccctgcaggccagcccccccggctacctgaccgccctgagaatgttcaacagaacctacaagctgtacagctacagctacctgggcctgggcctgatgagcgccagactggccatcctgggcggcgtggagggccagcccgccaaggacggcaaggagctggtgagcccctgcctgagccccagcttcaagggcgagtgggagcacgccgaggtgacctacagagtgagcggccagaaggccgccgccagcctgcacgagctgtgcgccgccagagtgagcgaggtgctgcagaacagagtgcacagaaccgaggaggtgaagcacgtggacttctacgccttcagctactactacgacctggccgccggcgtgggctag

SEQ ID NO: 80118 - DNA, 2778 bp, Artificial Sequence
  Description of Artificial Sequence: Synthetic coding sequence
atggagagagacggctgcgccggcggcggcagcagaggcggcgagggcggcagagcccccagagagggccccgccggcaacggcagagacagaggcagaagccacgccgccgaggcccccggcgacccccaggccgccgccagcctgctggcccccatggacgtgggcgaggagcccctggagaaggccgccagagccagaaccgccaaggaccccaacacctacaaggtgctgagcctggtgctgagcgtgtgcgtgctgaccaccatcctgggctgcatcttcggcctgaagcccagctgcgccaaggaggtgaagagctgcaagggcagatgcttcgagagaaccttcggcaactgcagatgcgacgccgcctgcgtggagctgggcaactgctgcctggactaccaggagacctgcatcgagcccgagcacatctggacctgcaacaagttcagatgcggcgagaagagactgaccagaagcctgtgcgcctgcagcgacgactgcaaggacaagggcgactgctgcatcaactacagcagcgtgtgccagggcgagaagagctgggtggaggagccctgcgagagcatcaacgagccccagtgccccgccggcttcgagaccccccccaccctgctgttcagcctggacggcttcagagccgagtacctgcacacctggggcggcctgctgcccgtgatcagcaagctgaagaagtgcggcacctacaccaagaacatgagacccgtgtaccccaccaagaccttccccaaccactacagcatcgtgaccggcctgtaccccgagagccacggcatcatcgacaacaagatgtacgaccccaagatgaacgccagcttcagcctgaagagcaaggagaagttcaaccccgagtggtacaagggcgagcccatctgggtgaccgccaagtaccagggcctgaagagcggcaccttcttctggcccggcagcgacgtggagatcaacggcatcttccccgacatctacaagatgtacaacggcagcgtgcccttcgaggagagaatcctggccgtgctgcagtggctgcagctgcccaaggacgagagaccccacttctacaccctgtacctggaggagcccgacagcagcggccacagctacggccccgtgagcagcgaggtgatcaaggccctgcagagagtggacggcatggtgggcatgctgatggacggcctgaaggagctgaacctgcacagatgcctgaacctgatcctgatcagcgaccacggcatggagcagggcagctgcaagaagtacatctacctgaacaagtacctgggcgacgtgaagaacatcaaggtgatctacggccccgccgccagactgagacccagcgacgtgcccgacaagtactacagcttcaactacgagggcatcgccagaaacctgagctgcagagagcccaaccagcacttcaagccctacctgaagcacttcctgcccaagagactgcacttcgccaagagcgacagaatcgagcccctgaccttctacctggacccccagtggcagctggccctgaaccccagcgagagaaagtactgcggcagcggcttccacggcagcgacaacgtgttcagcaacatgcaggccctgttcgtgggctacggccccggcttcaagcacggcatcgaggccgacaccttcgagaacatcgaggtgtacaacctgatgtgcgacctgctgaacctgacccccgcccccaacaacggcacccacggcagcctgaaccacctgctgaagaaccccgtgtacacccccaagcaccccaaggaggtgcaccccctggtgcagtgccccttcaccagaaaccccagagacaacctgggctgcagctgcaaccccagcatcctgcccatcgaggacttccagacccagttcaacctgaccgtggccgaggagaagatcatcaagcacgagaccctgccctacggcagacccagagtgctgcagaaggagaacaccatctgcctgctgagccagcaccagttcatgagcggctacagccaggacatcctgatgcccctgtggaccagctacaccgtggacagaaacgacagcttcagcaccgaggacttcagcaactgcctgtaccaggacttcagaatccccctgagccccgtgcacaagtgcagcttctacaagaacaacaccaaggtgagctacggcttcctgagccccccccagctgaacaagaacagcagcggcatctacagcgaggccctgctgaccaccaacatcgtgcccatgtaccagagcttccaggtgatctggagatacttccacgacaccctgctgagaaagtacgccgaggagagaaacggcgtgaacgtggtgagcggccccgtgttcgacttcgactacgacggcagatgcgacagcctggagaacctgagacagaagagaagagtgatcagaaaccaggagatcctgatccccacccacttcttcatcgtgctgaccagctgcaaggacaccagccagacccccctgcactgcgagaacctggacaccctggccttcatcctgccccacagaaccgacaacagcgagagctgcgtgcacggcaagcacgacagcagctgggtggaggagctgctgatgctgcacagagccagaatcaccgacgtggagcacatcaccggcctgagcttctaccagcagagaaaggagcccgtgagcgacatcctgaagctgaagacccacctgcccaccttcagccaggaggactag

SEQ ID NO: 80119 - DNA, 2592 bp, Artificial Sequence
  Description of Artificial Sequence: Synthetic coding sequence
atggccagaagaagcagcttccagagctgccagatcatcagcctgttcaccttcgccgtgggcgtgaacatctgcctgggcttcaccgcccacagaatcaagagagccgagggctgggaggagggcccccccaccgtgctgagcgacagcccctggaccaacatcagcggcagctgcaagggcagatgcttcgagctgcaggaggccggcccccccgactgcagatgcgacaacctgtgcaagagctacaccagctgctgccacgacttcgacgagctgtgcctgaagaccgccagaggctgggagtgcaccaaggacagatgcggcgaggtgagaaacgaggagaacgcctgccactgcagcgaggactgcctggccagaggcgactgctgcaccaactaccaggtggtgtgcaagggcgagagccactgggtggacgacgactgcgaggagatcaaggccgccgagtgccccgccggcttcgtgagaccccccctgatcatcttcagcgtggacggcttcagagccagctacatgaagaagggcagcaaggtgatgcccaacatcgagaagctgagaagctgcggcacccacagcccctacatgagacccgtgtaccccaccaagaccttccccaacctgtacaccctggccaccggcctgtaccccgagagccacggcatcgtgggcaacagcatgtacgaccccgtgttcgacgccaccttccacctgagaggcagagagaagttcaaccacagatggtggggcggccagcccctgtggatcaccgccaccaagcagggcgtgaaggccggcaccttcttctggagcgtggtgatcccccacgagagaagaatcctgaccatcctgcagtggctgaccctgcccgaccacgagagacccagcgtgtacgccttctacagcgagcagcccgacttcagcggccacaagtacggccccttcggccccgagatgaccaaccccctgagagagatcgacaagatcgtgggccagctgatggacggcctgaagcagctgaagctgcacagatgcgtgaacgtgatcttcgtgggcgaccacggcatggaggacgtgacctgcgacagaaccgagttcctgagcaactacctgaccaacgtggacgacatcaccctggtgcccggcaccctgggcagaatcagaagcaagttcagcaacaacgccaagtacgaccccaaggccatcatcgccaacctgacctgcaagaagcccgaccagcacttcaagccctacctgaagcagcacctgcccaagagactgcactacgccaacaacagaagaatcgaggacatccacctgctggtggagagaagatggcacgtggccagaaagcccctggacgtgtacaagaagcccagcggcaagtgcttcttccagggcgaccacggcttcgacaacaaggtgaacagcatgcagaccgtgttcgtgggctacggcagcaccttcaagtacaagaccaaggtgccccccttcgagaacatcgagctgtacaacgtgatgtgcgacctgctgggcctgaagcccgcccccaacaacggcacccacggcagcctgaaccacctgctgagaaccaacaccttcagacccaccatgcccgaggaggtgaccagacccaactaccccggcatcatgtacctgcagagcgacttcgacctgggctgcacctgcgacgacaaggtggagcccaagaacaagctggacgagctgaacaagagactgcacaccaagggcagcaccgaggagagacacctgctgtacggcagacccgccgtgctgtacagaaccagatacgacatcctgtaccacaccgacttcgagagcggctacagcgagatcttcctgatgcccctgtggaccagctacaccgtgagcaagcaggccgaggtgagcagcgtgcccgaccacctgaccagctgcgtgagacccgacgtgagagtgagccccagcttcagccagaactgcctggcctacaagaacgacaagcagatgagctacggcttcctgttccccccctacctgagcagcagccccgaggccaagtacgacgccttcctggtgaccaacatggtgcccatgtaccccgccttcaagagagtgtggaactacttccagagagtgctggtgaagaagtacgccagcgagagaaacggcgtgaacgtgatcagcggccccatcttcgactacgactacgacggcctgcacgacaccgaggacaagatcaagcagtacgtggagggcagcagcatccccgtgcccacccactactacagcatcatcaccagctgcctggacttcacccagcccgccgacaagtgcgacggccccctgagcgtgagcagcttcatcctgccccacagacccgacaacgaggagagctgcaacagcagcgaggacgagagcaagtgggtggaggagctgatgaagatgcacaccgccagagtgagagacatcgagcacctgaccagcctggacttcttcagaaagaccagcagaagctaccccgagatcctgaccctgaagacctacctgcacacctacgagagcgagatctag

SEQ ID NO: 80120 - DNA, 2748 bp, Artificial Sequence
  Description of Artificial Sequence: Synthetic coding sequence
atggccagaagaagcagcttccagagctgccagatcatcagcctgttcaccttcgccgtgggcgtgaacatctgcctgggcttcaccgcccacagaatcaagagagccgagggctgggaggagggcccccccaccgtgctgagcgacagcccctggaccaacatcagcggcagctgcaagggcagatgcttcgagctgcaggaggccggcccccccgactgcagatgcgacaacctgtgcaagagctacaccagctgctgccacgacttcgacgagctgtgcctgaagaccgccagaggctgggagtgcaccaaggacagatgcggcgaggtgagaaacgaggagaacgcctgccactgcagcgaggactgcctggccagaggcgactgctgcaccaactaccaggtggtgtgcaagggcgagagccactgggtggacgacgactgcgaggagatcaaggccgccgagtgccccgccggcttcgtgagaccccccctgatcatcttcagcgtggacggcttcagagccagctacatgaagaagggcagcaaggtgatgcccaacatcgagaagctgagaagctgcggcacccacagcccctacatgagacccgtgtaccccaccaagaccttccccaacctgtacaccctggccaccggcctgtaccccgagagccacggcatcgtgggcaacagcatgtacgaccccgtgttcgacgccaccttccacctgagaggcagagagaagttcaaccacagatggtggggcggccagcccctgtggatcaccgccaccaagcagggcgtgaaggccggcaccttcttctggagcgtggtgatcccccacgagagaagaatcctgaccatcctgcagtggctgaccctgcccgaccacgagagacccagcgtgtacgccttctacagcgagcagcccgacttcagcggccacaagtacggccccttcggccccgaggagagcagctacggcagccccttcacccccgccaagagacccaagagaaaggtggcccccaagagaagacaggagagacccgtggccccccccaagaagagaagaagaaagatccacagaatggaccactacgccgccgagaccagacaggacaagatgaccaaccccctgagagagatcgacaagatcgtgggccagctgatggacggcctgaagcagctgaagctgcacagatgcgtgaacgtgatcttcgtgggcgaccacggcatggaggacgtgacctgcgacagaaccgagttcctgagcaactacctgaccaacgtggacgacatcaccctggtgcccggcaccctgggcagaatcagaagcaagttcagcaacaacgccaagtacgaccccaaggccatcatcgccaacctgacctgcaagaagcccgaccagcacttcaagccctacctgaagcagcacctgcccaagagactgcactacgccaacaacagaagaatcgaggacatccacctgctggtggagagaagatggcacgtggccagaaagcccctggacgtgtacaagaagcccagcggcaagtgcttcttccagggcgaccacggcttcgacaacaaggtgaacagcatgcagaccgtgttcgtgggctacggcagcaccttcaagtacaagaccaaggtgccccccttcgagaacatcgagctgtacaacgtgatgtgcgacctgctgggcctgaagcccgcccccaacaacggcacccacggcagcctgaaccacctgctgagaaccaacaccttcagacccaccatgcccgaggaggtgaccagacccaactaccccggcatcatgtacctgcagagcgacttcgacctgggctgcacctgcgacgacaaggtggagcccaagaacaagctggacgagctgaacaagagactgcacaccaagggcagcaccgaggagagacacctgctgtacggcagacccgccgtgctgtacagaaccagatacgacatcctgtaccacaccgacttcgagagcggctacagcgagatcttcctgatgcccctgtggaccagctacaccgtgagcaagcaggccgaggtgagcagcgtgcccgaccacctgaccagctgcgtgagacccgacgtgagagtgagccccagcttcagccagaactgcctggcctacaagaacgacaagcagatgagctacggcttcctgttccccccctacctgagcagcagccccgaggccaagtacgacgccttcctggtgaccaacatggtgcccatgtaccccgccttcaagagagtgtggaactacttccagagagtgctggtgaagaagtacgccagcgagagaaacggcgtgaacgtgatcagcggccccatcttcgactacgactacgacggcctgcacgacaccgaggacaagatcaagcagtacgtggagggcagcagcatccccgtgcccacccactactacagcatcatcaccagctgcctggacttcacccagcccgccgacaagtgcgacggccccctgagcgtgagcagcttcatcctgccccacagacccgacaacgaggagagctgcaacagcagcgaggacgagagcaagtgggtggaggagctgatgaagatgcacaccgccagagtgagagacatcgagcacctgaccagcctggacttcttcagaaagaccagcagaagctaccccgagatcctgaccctgaagacctacctgcacacctacgagagcgagatctag

SEQ ID NO: 80121 - DNA, 2667 bp, Artificial Sequence
  Description of Artificial Sequence: Synthetic coding sequence
atggccagaagaagcagcttccagagctgccagatcatcagcctgttcaccttcgccgtgggcgtgaacatctgcctgggcttcaccgcccacagaatcaagagagccgagggctgggaggagggcccccccaccgtgctgagcgacagcccctggaccaacatcagcggcagctgcaagggcagatgcttcgagctgcaggaggccggcccccccgactgcagatgcgacaacctgtgcaagagctacaccagctgctgccacgacttcgacgagctgtgcctgaagaccgccagaggctgggagtgcaccaaggacagatgcggcgaggtgagaaacgaggagaacgcctgccactgcagcgaggactgcctggccagaggcgactgctgcaccaactaccaggtggtgtgcaagggcgagagccactgggtggacgacgactgcgaggagatcaaggccgccgagtgccccgccggcttcgtgagaccccccctgatcatcttcagcgtggacggcttcagagccagctacatgaagaagggcagcaaggtgatgcccaacatcgagaagctgagaagctgcggcacccacagcccctacatgagacccgtgtaccccaccaagaccttccccaacctgtacaccctggccaccggcctgtaccccgagagccacggcatcgtgggcaacagcatgtacgaccccgtgttcgacgccaccttccacctgagaggcagagagaagttcaaccacagatggtggggcggccagcccctgtggatcaccgccaccaagcagggcgtgaaggccggcaccttcttctggagcgtggtgatcccccacgagagaagaatcctgaccatcctgcagtggctgaccctgcccgaccacgagagacccagcgtgtacgccttctacagcgagcagcccgacttcagcggccacaagtacggccccttcggccccgagatgaccaaccccctgagagagatcgacaagatcgtgggccagctgatggacggcctgaagcagctgaagctgcacagatgcgtgaacgtgatcttcgtgggcgaccacggcatggaggacgtgacctgcgacagaaccgagttcctgagcaactacctgaccaacgtggacgacatcaccctggtgcccggcaccctgggcagaatcagaagcaagttcagcaacaacgccaagtacgaccccaaggccatcatcgccaacctgacctgcaagaagcccgaccagcacttcaagccctacctgaagcagcacctgcccaagagactgcactacgccaacaacagaagaatcgaggacatccacctgctggtggagagaagatggcacgtggccagaaagcccctggacgtgtacaagaagcccagcggcaagtgcttcttccagggcgaccacggcttcgacaacaaggtgaacagcatgcagaccgtgttcgtgggctacggcagcaccttcaagtacaagaccaaggtgccccccttcgagaacatcgagctgtacaacgtgatgtgcgacctgctgggcctgaagcccgcccccaacaacggcacccacggcagcctgaaccacctgctgagaaccaacaccttcagacccaccatgcccgaggaggtgaccagacccaactaccccggcatcatgtacctgcagagcgacttcgacctgggctgcacctgcgacgacaaggtggagcccaagaacaagctggacgagctgaacaagagactgcacaccaagggcagcaccgaggccgagaccagaaagttcagaggcagcagaaacgagaacaaggagaacatcaacggcaacttcgagcccagaaaggagagacacctgctgtacggcagacccgccgtgctgtacagaaccagatacgacatcctgtaccacaccgacttcgagagcggctacagcgagatcttcctgatgcccctgtggaccagctacaccgtgagcaagcaggccgaggtgagcagcgtgcccgaccacctgaccagctgcgtgagacccgacgtgagagtgagccccagcttcagccagaactgcctggcctacaagaacgacaagcagatgagctacggcttcctgttccccccctacctgagcagcagccccgaggccaagtacgacgccttcctggtgaccaacatggtgcccatgtaccccgccttcaagagagtgtggaactacttccagagagtgctggtgaagaagtacgccagcgagagaaacggcgtgaacgtgatcagcggccccatcttcgactacgactacgacggcctgcacgacaccgaggacaagatcaagcagtacgtggagggcagcagcatccccgtgcccacccactactacagcatcatcaccagctgcctggacttcacccagcccgccgacaagtgcgacggccccctgagcgtgagcagcttcatcctgccccacagacccgacaacgaggagagctgcaacagcagcgaggacgagagcaagtgggtggaggagctgatgaagatgcacaccgccagagtgagagacatcgagcacctgaccagcctggacttcttcagaaagaccagcagaagctaccccgagatcctgaccctgaagacctacctgcacacctacgagagcgagatctag

SEQ ID NO: 80122 - DNA, 2628 bp, Artificial Sequence
  Description of Artificial Sequence: Synthetic coding sequence
atggagagcaccctgaccctggccaccgagcagcccgtgaagaagaacaccctgaagaagtacaagatcgcctgcatcgtgctgctggccctgctggtgatcatgagcctgggcctgggcctgggcctgggcctgagaaagctggagaagcagggcagctgcagaaagaagtgcttcgacgccagcttcagaggcctggagaactgcagatgcgacgtggcctgcaaggacagaggcgactgctgctgggacttcgaggacacctgcgtggagagcaccagaatctggatgtgcaacaagttcagatgcggcgagaccagactggaggccagcctgtgcagctgcagcgacgactgcctgcagagaaaggactgctgcgccgactacaagagcgtgtgccagggcgagaccagctggctggaggagaactgcgacaccgcccagcagagccagtgccccgagggcttcgacctgccccccgtgatcctgttcagcatggacggcttcagagccgagtacctgtacacctgggacaccctgatgcccaacatcaacaagctgaagacctgcggcatccacagcaagtacatgagagccatgtaccccaccaagaccttccccaaccactacaccatcgtgaccggcctgtaccccgagagccacggcatcatcgacaacaacatgtacgacgtgaacctgaacaagaacttcagcctgagcagcaaggagcagaacaaccccgcctggtggcacggccagcccatgtggctgaccgccatgtaccagggcctgaaggccgccacctacttctggcccggcagcgaggtggccatcaacggcagcttccccagcatctacatgccctacaacggcagcgtgcccttcgaggagagaatcagcaccctgctgaagtggctggacctgcccaaggccgagagacccagattctacaccatgtacttcgaggagcccgacagcagcggccacgccggcggccccgtgagcgccagagtgatcaaggccctgcaggtggtggaccacgccttcggcatgctgatggagggcctgaagcagagaaacctgcacaactgcgtgaacatcatcctgctggccgaccacggcatggaccagacctactgcaacaagatggagtacatgaccgactacttccccagaatcaacttcttctacatgtacgagggccccgcccccagaatcagagcccacaacatcccccacgacttcttcagcttcaacagcgaggagatcgtgagaaacctgagctgcagaaagcccgaccagcacttcaagccctacctgacccccgacctgcccaagagactgcactacgccaagaacgtgagaatcgacaaggtgcacctgttcgtggaccagcagtggctggccgtgagaagcaagagcaacaccaactgcggcggcggcaaccacggctacaacaacgagttcagaagcatggaggccatcttcctggcccacggccccagcttcaaggagaagaccgaggtggagcccttcgagaacatcgaggtgtacaacctgatgtgcgacctgctgagaatccagcccgcccccaacaacggcacccacggcagcctgaaccacctgctgaaggtgcccttctacgagcccagccacgccgaggaggtgagcaagttcagcgtgtgcggcttcgccaaccccctgcccaccgagagcctggactgcttctgcccccacctgcagaacagcacccagctggagcaggtgaaccagatgctgaacctgacccaggaggagatcaccgccaccgtgaaggtgaacctgcccttcggcagacccagagtgctgcagaagaacgtggaccactgcctgctgtaccacagagagtacgtgagcggcttcggcaaggccatgagaatgcccatgtggagcagctacaccgtgccccagctgggcgacaccagccccctgccccccaccgtgcccgactgcctgagagccgacgtgagagtgccccccagcgagagccagaagtgcagcttctacctggccgacaagaacatcacccacggcttcctgtacccccccgccagcaacagaaccagcgacagccagtacgacgccctgatcaccagcaacctggtgcccatgtacgaggagttcagaaagatgtgggactacttccacagcgtgctgctgatcaagcacgccaccgagagaaacggcgtgaacgtggtgagcggccccatcttcgactacaactacgacggccacttcgacgcccccgacgagatcaccaagcacctggccaacaccgacgtgcccatccccacccactacttcgtggtgctgaccagctgcaagaacaagagccacacccccgagaactgccccggctggctggacgtgctgcccttcatcatcccccacagacccaccaacgtggagagctgccccgagggcaagcccgaggccctgtgggtggaggagagattcaccgcccacatcgccagagtgagagacgtggagctgctgaccggcctggacttctaccaggacaaggtgcagcccgtgagcgagatcctgcagctgaagacctacctgcccaccttcgagaccaccatctag

SEQ ID NO: 80123 - DNA, 1992 bp, Artificial Sequence
  Description of Artificial Sequence: Synthetic coding sequence
atggagagcaccctgaccctggccaccgagcagcccgtgaagaagaacaccctgaagaagtacaagatcgcctgcatcgtgctgctggccctgctggtgatcatgagcctgggcctgggcctgggcctgggcctgagaaagctggagaagcagggcagctgcagaaagaagtgcttcgacgccagcttcagaggcctggagaactgcagatgcgacgtggcctgcaaggacagaggcgactgctgctgggacttcgaggacacctgcgtggagagcaccagaatctggatgtgcaacaagttcagatgcggcgagaccagactggaggccagcctgtgcagctgcagcgacgactgcctgcagagaaaggactgctgcgccgactacaagagcgtgtgccagggcgagaccagctggctggaggagaactgcgacaccgcccagcagagccagtgccccgagggcttcgacctgccccccgtgatcctgttcagcatggacggcttcagagccgagtacctgtacacctgggacaccctgatgcccaacatcaacaagctgaagacctgcggcatccacagcaagtacatgagagccatgtaccccaccaagaccttccccaaccactacaccatcgtgaccggcctgtaccccgagagccacggcatcatcgacaacaacatgtacgacgtgaacctgaacaagaacttcagcctgagcagcaaggagcagaacaaccccgcctggtggcacggccagcccatgtggctgaccgccatgtaccagggcctgaaggccgccacctacttctggcccggcagcgaggtggccatcaacggcagcttccccagcatctacatgccctacaacggcagcgtgcccttcgaggagagaatcagcaccctgctgaagtggctggacctgcccaaggccgagagacccagattctacaccatgtacttcgaggagcccgacagcagcggccacgccggcggccccgtgagcgccagagtgatcaaggccctgcaggtggtggaccacgccttcggcatgctgatggagggcctgaagcagagaaacctgcacaactgcgtgaacatcatcctgctggccgaccacggcatggaccagacctactgcaacaagatggagtacatgaccgactacttccccagaatcaacttcttctacatgtacgagggccccgcccccagaatcagagcccacaacatcccccacgacttcttcagcttcaacagcgaggagatcgtgagaaacctgagctgcagaaagcccgaccagcacttcaagccctacctgacccccgacctgcccaagagactgcactacgccaagaacgtgagaatcgacaaggtgcacctgttcgtggaccagcagtggctggccgtgagaagcaagagcaacaccaactgcggcggcggcaaccacggctacaacaacgagttcagaagcatggaggccatcttcctggcccacggccccagcttcaaggagaagaccgaggtggagcccttcgagaacatcgaggtgtacaacctgatgtgcgacctgctgagaatccagcccgcccccaacaacggcacccacggcagcctgaaccacctgctgaaggtgcccttctacgagcccagccacgccgaggaggtgagcaagttcagcgtgtgcggcttcgccaaccccctgcccaccgagagcctggactgcttctgcccccacctgcagaacagcacccagctggagcaggtgaaccagatgctgaacctgacccaggaggagatcaccgccaccgtgaaggtgaacctgcccttcggcagacccagagtgctgcagaagaacgtggaccactgcctgctgtaccacagagagtacgtgagcggcttcggcaaggccatgagaatgcccatgtggagcagctacaccgtgccccagctgcccgccatcgagcaccagatcgccaacatgatgctgtag

SEQ ID NO: 80124 - DNA, 2628 bp, Artificial Sequence; identical to SEQ ID NO: 80122
  Description of Artificial Sequence: Synthetic coding sequence

SEQ ID NO: 80125 - DNA, 765 bp, Artificial Sequence
  Description of Artificial Sequence: Synthetic coding sequence
atgagcctgggcctgggcctgggcctgggcctgagaaagctggagaagcagggcagctgcagaaagaagtgcttcgacgccagcttcagaggcctggagaactgcagatgcgacgtggcctgcaaggacagaggcgactgctgctgggacttcgaggacacctgcgtggagagcaccagaatctggatgtgcaacaagttcagatgcggcgagaccagactggaggccagcctgtgcagctgcagcgacgactgcctgcagagaaaggactgctgcgccgactacaagagcgtgtgccagggcgagaccagctggctggaggagaactgcgacaccgcccagcagagccagtgccccgagggcttcgacctgccccccgtgatcctgttcagcatggacggcttcagagccgagtacctgtacacctgggacaccctgatgcccaacatcaacaagctgaagacctgcggcatccacagcaagtacatgagagccatgtaccccaccaagaccttccccaaccactacaccatcgtgaccggcctgtaccccgagagccacggcatcatcgacaacaacatgtacgacgtgaacctgaacaagaacttcagcctgagcagcaaggagcagaacaaccccgcctggtggcacggccagcccgtgtgcagcatcctgcacgtggccaccgaggtgaccagcatcagccagtgcgacagaagaaccctgttcagcctgagcggcgccagcagcatgagccccatctag

SEQ ID NO: 80126 - DNA, 774 bp, Artificial Sequence
  Description of Artificial Sequence: Synthetic coding sequence
atgagcctgggcctgggcctgggcctgggcctgagaaagctggagaagcagggcagctgcagaaagaagtgcttcgacgccagcttcagaggcctggagaactgcagatgcgacgtggcctgcaaggacagaggcgactgctgctgggacttcgaggacacctgcgtggagagcaccagaatctggatgtgcaacaagttcagatgcggcgagaccagactggaggccagcctgtgcagctgcagcgacgactgcctgcagagaaaggactgctgcgccgactacaagagcgtgtgccagggcgagaccagctggctggaggagaactgcgacaccgcccagcagagccagtgccccgagggcttcgacctgccccccgtgatcctgttcagcatggacggcttcagagccgagtacctgtacacctgggacaccctgatgcccaacatcaacaagctgaagacctgcggcatccacagcaagtacatgagagccatgtaccccaccaagaccttccccaaccactacaccatcgtgaccggcctgtaccccgagagccacggcatcatcgacaacaacatgtacgacgtgaacctgaacaagaacttcagcctgagcagcaaggagcagaacaaccccgcctggtggcacggccagcccatgtggctgaccgccatgtaccagggcctgaaggccgccacctacttctggcccggcagcgaggtggccatcaacggcagcttccccagcatctacatgccctacaacggctag

SEQ ID NO: 80127 - DNA, 1200 bp, Artificial Sequence
  Description of Artificial Sequence: Synthetic coding sequence
atggccagccccggcaagcccggcgccgacgaggcccaggaggaggagggcgagctggagggcggcagcgccggccccagagccgccatcctggagcaggccgaggagctgttcctgctgtgcgacaaggaggccaagggcttcatcaccaagcacgacctgcagggcctgcagagcgacctgcccctgacccccgagcagctggaggccgtgttcgagagcctggacagagcccacaccggcttcctgaccgccagagagttctgcctgggcctgggcatgttcgtgggcgtggccagcgcccagggcgccaacccctgcagaacccccgaggagaccttcgagagcggcggcctggacgtgcagggcaccgccggcagcctggacgaggaggaggaggaggaggagagattccacaccgtgctggagcagctgggcgtggcccccgtgctgggcaagcagagagccgtgagaaccctgtgggccagactgcagagagagagacccgagctgctgggcagcttcgaggacgtgctgatcagagccagcgcctgcctggaggaggccgccagagagagagacggcctggagcaggccctgagaagaagagagagcgagcacgagagagaggtgagagccctgtacgaggagaccgagcagctgagagagcagagcagaagaccccccagccagaacttcgccagaggcgagagaagaagcagactggagctggagctgcagagcagagagcaggacctggagagagccggcctgagacagagagagctggagcagcagctgcacgcccaggccgccgagcacctggaggcccaggcccagaacagccagctgtggagagcccacgaggccctgagaacccagctggagggcgcccaggagcagatcagaagactggagagcgaggccagaggcagacaggagcagacccagagagacgtggtggccgtgagcagaaacatgcagaaggagaaggtgagcctgctgagacagctggagctgctgagagagctgaacaccagactgagagacgacagagacgcctgcgaggccagaagagccggcagcagctgcagaaaggccctgaccaccgccagactgcccggccccacctgctgctgctgctgctgctgggccagaccccccagaagaggcagcggccacctgcccagcgccagatag

SEQ ID NO: 80128 - DNA, 885 bp, Artificial Sequence
  Description of Artificial Sequence: Synthetic coding sequence
atggccagccccggcaagcccggcgccgacgaggcccaggaggaggagggcgagctggagggcggcagcgccggccccagagccgccatcctggagcaggccgaggagctgttcctgctgtgcgacaaggaggccaagggcttcatcaccaagcacgacctgcagggcctgcagagcgacctgcccctgacccccgagcagctggaggccgtgttcgagagcctggacagagcccacaccggcttcctgaccgccagagagttctgcctgggcctgggcatgttcgtgggcgtggccagcgcccagggcgccaacccctgcagaacccccgaggagaccttcgagagcggcggcctggacgtgcagggcaccgccggcagcctggacgaggaggaggaggaggaggagagattccacaccgtgctggagcagctgggcgtggcccccgtgctgggcaagcagagagccgtgagaaccctgtgggccagactgcagagagagagacccgagctgctgggcagcttcgaggacgtgctgatcagagccagcgcctgcctggaggaggccgccagagagagagacggcctggagcaggccctgagaagaagagagagcgagcacgagagagaggtgagagccctgtacgaggagaccgagcagctgagagagcagagcagaagaccccccagccagaacttcgccagaggcgagagaagaagcagactggagctggagctgcagagcagagagcaggacctggagagagccggcctgagacagagagagagaagaggcagaagactgcaggagcacgccgagagagagagccagcccgccaccgccaccggcgccgcccagggcgccgagtacaccgccgccggctag

SEQ ID NO: 80129 - DNA, 267 bp, Artificial Sequence
  Description of Artificial Sequence: Synthetic coding sequence
atggccagccccggcaagcccggcgccgacgaggcccaggaggaggagggcgagctggagggcggcagcgccggccccagagccgccatcctggagcaggccgaggagctgttcctgctgtgcgacaaggaggccaagggcttcatcaccaagcacgacctgcagggcctgcagagcgacctgcccctgacccccgagcagctggaggccgtgttcgagagcctggacagagcccacaccggcttcctgaccgccagagagttctag

SEQ ID NO: 80130 - DNA, 105 bp, Artificial Sequence
  Description of Artificial Sequence: Synthetic coding sequence
atggccagccccggcaagcccggcgccgacgaggcccaggaggaggagggcgagctggagggcggcagcgccggccccagagccgccatcctggagcaggcctag

SEQ ID NO: 80131 - DNA, 885 bp, Artificial Sequence; identical to SEQ ID NO: 80128
  Description of Artificial Sequence: Synthetic coding sequence

SEQ ID NO: 80132 - DNA, 162 bp, Artificial Sequence
  Description of Artificial Sequence: Synthetic coding sequence
atggccagccccggcaagcccggcgccgacgaggcccaggaggaggagggcgagctggagggcggcagcgccggccccagagccgccatcctggagcaggccgaggagctgttcctgctgtgcgacaaggaggccaagggcttcatcaccaagcacgactag

SEQ ID NO: 80133 - DNA, 246 bp, Artificial Sequence
  Description of Artificial Sequence: Synthetic coding sequence
atggccagccccggcaagcccggcgccgacgaggcccaggaggaggagggcgagctggagggcggcagcgccggccccagagccgccatcctggagcaggccgaggagctgttcctgctgtgcgacaaggaggccaagggcttcatcaccaagcacgacctgcagggcctgcagagcgacctgcccctgacccccgagcagctggaggccgtgttcgagagcctggacagagcccacaccggctag

SEQ ID NO: 80134 - DNA, 1188 bp, Artificial Sequence
  Description of Artificial Sequence: Synthetic coding sequence
atggccgcccccgacggcagagtggtgagcagaccccagagactgggccagggcagcggccagggccccaagggcagcggcgcctgcctgcaccccctggacagcctggagcagaaggagacccaggagcagaccagcggccagctggtgatgctgagaaaggcccaggagttcttccagacctgcgacgccgagggcaagggcttcatcgccagaaaggacatgcagagactgcacaaggagctgcccctgagcctggaggagctggaggacgtgttcgacgccctggacgccgacggcaacggctacctgaccccccaggagttcaccaccggcttcagccacttcttcttcagccagaacaaccccagccaggaggacgccggcgagcaggtggcccagagacacgaggagaaggtgtacctgagcagaggcgacgaggacctgggcgacatgggcgaggacgaggaggcccagttcagaatgctgatggacagactgggcgcccagaaggtgctggaggacgagagcgacgtgaagcagctgtggctgcagctgaagaaggaggagccccacctgctgagcaacttcgaggacttcctgaccagaatcatcagccagctgcaggaggcccacgaggagaagaacgagctggagtgcgccctgaagagaaagatcgccgcctacgacgaggagatccagcacctgtacgaggagatggagcagcagatcaagagcgagaaggagcagttcctgctgaaggacaccgagagattccaggccagaagccaggagctggagcagaagctgctgtgcaaggagcaggagctggagcagctgacccagaagcagaagagactggagggccagtgcaccgccctgcaccacgacaagcacgagaccaaggccgagaacaccaagctgaagctgaccaaccaggagctggccagagagctggagagaaccagctgggagctgcaggacgcccagcagcagctggagagcctgcagcaggaggcctgcaagctgcaccaggagaaggagatggaggtgtacagagtgaccgagagcctgcagagagagaaggccggcctgctgaagcagctggacttcctgagatgcgtgggcggccactggcccgtgctgagagccccccccagaagcctgggcagcgagggccccgtgtag

SEQ ID NO: 80135 - DNA, 2196 bp, Artificial Sequence
  Description of Artificial Sequence: Synthetic coding sequence
atggccgcccccgacggcagagtggtgagcagaccccagagactgggccagggcagcggccagggccccaagggcagcggcgcctgcctgcaccccctggacagcctggagcagaaggagacccaggagcagaccagcggccagctggtgatgctgagaaaggcccaggagttcttccagacctgcgacgccgagggcaagggcttcatcgccagaaaggacatgcagagactgcacaaggagctgcccctgagcctggaggagctggaggacgtgttcgacgccctggacgccgacggcaacggctacctgaccccccaggagttcaccaccggcttcagccacttcttcttcagccagaacaaccccagccaggaggacgccggcgagcaggtggcccagagacacgaggagaaggtgtacctgagcagaggcgacgaggacctgggcgacatgggcgaggacgaggaggcccagttcagaatgctgatggacagactgggcgcccagaaggtgctggaggacgagagcgacgtgaagcagctgtggctgcagctgaagaaggaggagccccacctgctgagcaacttcgaggacttcctgaccagaatcatcagccagctgcaggaggcccacgaggagaagaacgagctggagtgcgccctgaagagaaagatcgccgcctacgacgaggagatccagcacctgtacgaggagatggagcagcagatcaagagcgagaaggagcagttcctgctgaaggacaccgagagattccaggccagaagccaggagctggagcagaagctgctgtgcaaggagcaggagctggagcagctgacccagaagcagaagagactggagggccagtgcaccgccctgcaccacgacaagcacgagaccaaggccgagaacaccaagctgaagctgaccaaccaggagctggccagagagctggagagaaccagctgggagctgcaggacgcccagcagcagctggagagcctgcagcaggaggcctgcaagctgcaccaggagaaggagatggaggtgtacagagtgaccgagagcctgcagagagagaaggccggcctgctgaagcagctggacttcctgagagagagaaacaagcacctgagagacgagagagacatctgcttccagaagaacaaggccgccaaggccaacaccgccgccagcagagccagctggaagaagagaagcggcagcgtgatcggcaagtacgtggacagcagaggcatcctgagaagccagagcgaggaggaggaggaggtgttcggcatccccagaagaagcagcctgggcctgagcggctaccccctgaccgaggaggagcccggcaccggcgagcccggccccggcggcccctaccccagacccctgagaagaatcatcagcgtggaggaggaccccctgccccagctgctggacggcggcttcgagcagcccctgagcaagtgcagcgaggaggaggaggtgagcgaccagggcgtgcagggccagatccccgaggccccccccctgaagctgacccccaccagccccagaggccagcccgtgggcaaggaggccctgtgcaaggaggagagcagccccagcgcccccgacagactgttcaagatcgtgttcgtgggcaacagcgccgtgggcaagaccagcttcctgagaagattctgcgaggacagattcagccccggcatggccgccaccgtgggcatcgactacagagtgaagaccctgaacgtggacaacagccaggtggccctgcagctgtgggacaccgccggccaggagagatacagatgcatcacccagcagttcttcagaaaggccgacggcgtgatcgtgatgtacgacctgaccgacaagcagagcttcctgagcgtgagaagatggctgagcagcgtggaggaggccgtgggcgacagagtgcccgtgctgctgctgggcaacaagctggacaacgagaaggagagagaggtgcccagaggcctgggcgagcagctggccaccgagaacaacctgatcttctacgagtgcagcgcctacagcggccacaacaccaaggagagcctgctgcacctggccagattcctgaaggagcaggaggacaccgtgagagaggacaccatccaggtgggccaccccgccaagaagaagagctgctgcggctag

SEQ ID NO: 80136 - DNA, 1389 bp, Artificial Sequence
  Description of Artificial Sequence: Synthetic coding sequence
atggccgcccccgacggcagagtggtgagcagaccccagagactgggccagggcagcggccagggccccaagggcagcggcgcctgcctgcaccccctggacagcctggagcagaaggagacccaggagcagaccagcggccagctggtgatgctgagaaaggcccaggagttcttccagacctgcgacgccgagggcaagggcttcatcgccagaaaggacatgcagagactgcacaaggagctgcccctgagcctggaggagctggaggacgtgttcgacgccctggacgccgacggcaacggctacctgaccccccaggagttcaccaccggcttcagccacttcttcttcagccagaacaaccccagccaggaggacgccggcgagcaggtggcccagagacacgaggagaaggtgtacctgagcagaggcgacgaggacctgggcgacatgggcgaggacgaggaggcccagttcagaatgctgatggacagactgggcgcccagaaggtgctggaggacgagagcgacgtgaagcagctgtggctgcagctgaagaaggaggagccccacctgctgagcaacttcgaggacttcctgaccagaatcatcagccagctgcaggaggcccacgaggagaagaacgagctggagtgcgccctgaagagaaagatcgccgcctacgacgaggagatccagcacctgtacgaggagatggagcagcagatcaagagcgagaaggagcagttcctgctgaaggacaccgagagattccaggccagaagccaggagctggagcagaagctgctgtgcaaggagcaggagctggagcagctgacccagaagcagaagagactggagggccagtgcaccgccctgcaccacgacaagcacgagaccaaggccgagaacaccaagctgaagctgaccaaccaggagctggccagagagctggagagaaccagctgggagctgcaggacgcccagcagcagctggagagcctgcagcaggaggcctgcaagctgcaccaggagaaggagatggaggtgtacagagtgaccgagagcctgcagagagagaaggccggcctgctgaagcagctggacttcctgagagagagaaacaagcacctgagagacgagagagacatctgcttccagaagaacaaggccgccaaggccaacaccgccgccagcagagccagctggaagaagagaagcggcagcgtgatcggcaagtacgtggacagcagaggcatcctgagaagatggccccagagagacagaggcatccccaccctgcagtaccagacccagagagacctggaggactgcaagcacgagatgaagaagatctgcaaggccgaggtgaccctggagatgtag

SEQ ID NO: 80137 - DNA, 357 bp, Artificial Sequence
  Description of Artificial Sequence: Synthetic coding sequence
tgagagaaggagatggaggtgtacagagtgaccgagagcctgcagagagagaaggccggcctgctgaagcagctggacttcctgagagagagaaacaagcacctgagagacgagagagacatctgcttccagaagaacaaggccgccaaggccaacaccgccgccagcagagccagctggaagaagagaagcggcagcgtgatcggcaagtacgtggacagcagaggcatcctgagaagatggccccagagagacagaggcatccccaccctgcagtaccagacccagagagacctggaggactgcaagcacgagatgaagaagatctgcaaggccgaggtgaccctggagatgtag

SEQ ID NO: 80138 - DNA, 1923 bp, Artificial Sequence
  Description of Artificial Sequence: Synthetic coding sequence
atggtgagcaaccccgtgcacggcctgcccttcctgcccggcaccagcttcaaggacagcaccaagaccgccttccacagaagccagaccctgagctacagaaacggctacgccatcgtgagaagacccaccgtgggcatcggcggcgacagactgcagttcaaccagctgagccaggccgagctggacgagctggccagcaaggcccccgtgctgacctacggccagcccaagcaggccccccccgccgacttcatccccgcccacgtggccttcgacaagaaggtgctgaagttcgacgcctacttccaggaggacgtgcccatgagcaccgaggagcagtacagaatcagacaggtgaacatctactactacctggaggacgacagcatgagcgtgatcgagcccgtggtggagaacagcggcatcctgcagggcaagctgatcaagagacagagactggccaagaacgacagaggcgaccactaccactggaaggacctgaacagaggcatcaacatcaccatctacggcaagaccttcagagtggtggactgcgaccagttcacccaggtgttcctggagagccagggcatcgagctgaacccccccgagaagatggccctggacccctacaccgagctgagaaagcagcccctgagaaagtacgtgacccccagcgacttcgaccagctgaagcagttcctgaccttcgacaagcaggtgctgagattctacgccatctgggacgacaccgacagcatgtacggcgagtgcagaacctacatcatccactactacctgatggacgacaccgtggagatcagagaggtgcacgagagaaacgacggcagagaccccttccccctgctgatgaacagacagagagtgcccaaggtgctggtggagaacgccaagaacttcccccagtgcgtgctggagatcagcgaccaggaggtgctggagtggtacaccgccaaggacttcatcgtgggcaagagcctgaccatcctgggcagaaccttcttcatctacgactgcgaccccttcaccagaagatactacaaggagaagttcggcatcaccgacctgcccagaatcgacgtgagcaagagagagcccccccccgtgaagcaggagctgcccccctacaacggcttcggcctggtggaggacagcgcccagaactgcttcgccctgatccccaaggcccccaagaaggacgtgatcaagatgctggtgaacgacaacaaggtgctgagatacctggccgtgctggagagccccatccccgaggacaaggacagaagattcgtgttcagctacttcctggccaccgacatgatcagcatcttcgagccccccgtgagaaacagcggcatcatcggcggcaagtacctgggcagaaccaaggtggtgaagccctacagcaccgtggacaaccccgtgtactacggccccagcgacttcttcatcggcgccgtgatcgaggtgttcggccacagattcatcatcctggacaccgacgagtacgtgctgaagtacatggagagcaacgccgcccagtacagccccgaggccctggccagcatccagaaccacgtgagaaagagagaggcccccgcccccgaggccgagagcaagcagaccgagaaggaccccggcgtgcaggagctggaggccctgatcgacaccatccagaagcagctgaaggaccacagctgcaaggacaacatcagagaggccttccagatctacgacaaggaggccagcggctacgtggacagagacatgttcttcaagatctgcgagagcctgaacgtgcccgtggacgacagcctggtgaaggagctgatcagaatgtgcagccacggcgagggcaagatcaactactacaacttcgtgagagccttcagcaactag

SEQ ID NO: 80139 - DNA, 1653 bp, Artificial Sequence
  Description of Artificial Sequence: Synthetic coding sequence
atgagctggcccgtgctgaagttcgacgcctacttccaggaggacgtgcccatgagcaccgaggagcagtacagaatcagacaggtgaacatctactactacctggaggacgacagcatgagcgtgatcgagcccgtggtggagaacagcggcatcctgcagggcaagctgatcaagagacagagactggccaagaacgacagaggcgaccactaccactggaaggacctgaacagaggcatcaacatcaccatctacggcaagaccttcagagtggtggactgcgaccagttcacccaggtgttcctggagagccagggcatcgagctgaacccccccgagaagatggccctggacccctacaccgagctgagaaagcagcccctgagaaagtacgtgacccccagcgacttcgaccagctgaagcagttcctgaccttcgacaagcaggtgctgagattctacgccatctgggacgacaccgacagcatgtacggcgagtgcagaacctacatcatccactactacctgatggacgacaccgtggagatcagagaggtgcacgagagaaacgacggcagagaccccttccccctgctgatgaacagacagagagtgcccaaggtgctggtggagaacgccaagaacttcccccagtgcgtgctggagatcagcgaccaggaggtgctggagtggtacaccgccaaggacttcatcgtgggcaagagcctgaccatcctgggcagaaccttcttcatctacgactgcgaccccttcaccagaagatactacaaggagaagttcggcatcaccgacctgcccagaatcgacgtgagcaagagagagcccccccccgtgaagcaggagctgcccccctacaacggcttcggcctggtggaggacagcgcccagaactgcttcgccctgatccccaaggcccccaagaaggacgtgatcaagatgctggtgaacgacaacaaggtgctgagatacctggccgtgctggagagccccatccccgaggacaaggacagaagattcgtgttcagctacttcctggccaccgacatgatcagcatcttcgagccccccgtgagaaacagcggcatcatcggcggcaagtacctgggcagaaccaaggtggtgaagccctacagcaccgtggacaaccccgtgtactacggccccagcgacttcttcatcggcgccgtgatcgaggtgttcggccacagattcatcatcctggacaccgacgagtacgtgctgaagtacatggagagcaacgccgcccagtacagccccgaggccctggccagcatccagaaccacgtgagaaagagagaggcccccgcccccgaggccgagagcaagcagaccgagaaggaccccggcgtgcaggagctggaggccctgatcgacaccatccagaagcagctgaaggaccacagctgcaaggacaacatcagagaggccttccagatctacgacaaggaggccagcggctacgtggacagagacatgttcttcaagatctgcgagagcctgaacgtgcccgtggacgacagcctggtgaaggaggtgacctgcaagagactgctgctgcccgccttcaccttccccagccccgtgtggatccccctgtgcggcctgtag

SEQ ID NO: 80140 - DNA, 1866 bp, Artificial Sequence
  Description of Artificial Sequence: Synthetic coding sequence
atgctgaagaccgccttccacagaagccagaccctgagctacagaaacggctacgccatcgtgagaagacccaccgtgggcatcggcggcgacagactgcagttcaaccagctgagccaggccgagctggacgagctggccagcaaggcccccgtgctgacctacggccagcccaagcaggccccccccgccgacttcatccccgcccacgtggccttcgacaagaaggtgctgaagttcgacgcctacttccaggaggacgtgcccatgagcaccgaggagcagtacagaatcagacaggtgaacatctactactacctggaggacgacagcatgagcgtgatcgagcccgtggtggagaacagcggcatcctgcagggcaagctgatcaagagacagagactggccaagaacgacagaggcgaccactaccactggaaggacctgaacagaggcatcaacatcaccatctacggcaagaccttcagagtggtggactgcgaccagttcacccaggtgttcctggagagccagggcatcgagctgaacccccccgagaagatggccctggacccctacaccgagctgagaaagcagcccctgagaaagtacgtgacccccagcgacttcgaccagctgaagcagttcctgaccttcgacaagcaggtgctgagattctacgccatctgggacgacaccgacagcatgtacggcgagtgcagaacctacatcatccactactacctgatggacgacaccgtggagatcagagaggtgcacgagagaaacgacggcagagaccccttccccctgctgatgaacagacagagagtgcccaaggtgctggtggagaacgccaagaacttcccccagtgcgtgctggagatcagcgaccaggaggtgctggagtggtacaccgccaaggacttcatcgtgggcaagagcctgaccatcctgggcagaaccttcttcatctacgactgcgaccccttcaccagaagatactacaaggagaagttcggcatcaccgacctgcccagaatcgacgtgagcaagagagagcccccccccgtgaagcaggagctgcccccctacaacggcttcggcctggtggaggacagcgcccagaactgcttcgccctgatccccaaggcccccaagaaggacgtgatcaagatgctggtgaacgacaacaaggtgctgagatacctggccgtgctggagagccccatccccgaggacaaggacagaagattcgtgttcagctacttcctggccaccgacatgatcagcatcttcgagccccccgtgagaaacagcggcatcatcggcggcaagtacctgggcagaaccaaggtggtgaagccctacagcaccgtggacaaccccgtgtactacggccccagcgacttcttcatcggcgccgtgatcgaggtgttcggccacagattcatcatcctggacaccgacgagtacgtgctgaagtacatggagagcaacgccgcccagtacagccccgaggccctggccagcatccagaaccacgtgagaaagagagaggcccccgcccccgaggccgagagcaagcagaccgagaaggaccccggcgtgcaggagctggaggccctgatcgacaccatccagaagcagctgaaggaccacagctgcaaggacaacatcagagaggccttccagatctacgacaaggaggccagcggctacgtggacagagacatgttcttcaagatctgcgagagcctgaacgtgcccgtggacgacagcctggtgaaggagctgatcagaatgtgcagccacggcgagggcaagatcaactactacaacttcgtgagagccttcagcaactag

SEQ ID NO: 80141 - DNA, 2250 bp, Artificial Sequence
  Description of Artificial Sequence: Synthetic coding sequence
atggccctgcccctgctgcccggcaacagcttcaacagaaacgtgggcaaggagaagttccacaagagccagcactggggcttctgcaacaacgtgatgatgctggtgagcgacgagaagcccggcatcggcggcgagcccctgctgggccagaagatcaagcccaagtgcagcatctaccccaagggcgacggcagcgacgtgcccagctgggtggccttcgacaagcaggtgctgagcttcgacgcctacctggaggaggaggtgctggacaagagccagaccaactacagaatcagatactacaagatctacttctaccccgaggacgacaccatccaggtgaacgagcccgaggtgaagaacagcggcctgctgcagggcaccagcatcagaagacacagaatcaccctgcccccccccgacgaggaccagttctacaccgtgtaccacttcaacgtgggcaccgaggtggtgttctacggcagaaccttcaagatctacgactgcgacgccttcaccagaaacttcctgagaaagatcggcgtgaaggtgaacccccccgtgcagtgccccgaggacccctacatgaagatcagaagagaggtggtggagcacgtggagcccctgagaccctacgagagcctggacaccctgaagcagttcctgcagtaccacggcaagatcctgtgcttcttctgcctgtgggacgacagcgtgagcatgttcggcgacagaagagagctgatcctgcactacttcctgtgcgacgacaccatcgagatcaaggagctgctgccccacagcagcggcagagacgccctgaagatgttcctgagaagaagcaagctgcccaagaactgcccccccagagtgtaccagcccggccagatcaccgacagagccgtgctgaacagctacggcgacttcatcaagaaccaggccgacggctacctgttcgacagatacaagctgggcaaggtggaccaggagttctacaaggacagcgacctgagcctgggcgtgaccatcaacgtgtggggcagaaaggtgctgctgtacgactgcgacgagttcaccaagagctactacaagagcaagtacggcatcgagaacttcaccagcgtgagctgcaagccccccagccccccccccaagatcgagagaaagttccccccctacaacggcttcggcagcgaggaggacagcctgagaaactgcatcgacctgaagcccaccccccacagaagaaacttcaagaagttcatggagaaggacagctacggcagcaagagcaacatcctgagattcttcgccaagctggtgaccgacaagtgcgtggacctggacagaatgttcgtgatcagctactacctgggcgacgacaccatcagcgtgttcgagcccatcgagagaaacagcggcatcgccggcggcatgttcctgaagagaagcagagtgaagaagcccggccaggaggtgttcaagagcgagctgagcgagtacatcaaggccgaggagctgtacatcggcgtgaccgtgaacgtgaacggctacctgttcagactgctgaacgccgacgagtacaccctgaactacatggagcagaacaccgacaagtaccccttcagcaacctgaagctggccctgcagaagctgaagcaggaggagggcaagagcagagagctgaagcaggtgttcaaggccgccgacagcaagcacaccaacatggtggactacaacaccttcagagacatcctgatgagcctgaccgtgggcaacctggccgagcaggagttcgtgaccatcgccagacactacagagtgcccgagggcacctgcagcgacatggacttcctgatcgccctggcccacgagaagttcaagaagaacatgttcgagaacttcgacaccttcatctacagctgcgtgtacgaggacagagagaagaagaacgtgctgcccaccaaggacatcaagagactgtgcaagagcagcagactgcccctgagcgacgacctgctggagagcctgctgagcagattcgaggacagcgagaagcagatcgactacaagagcttcttcagcgccctgaactggagaaagaaccccgtgcccgagctgcagcccgccagctacctgaaggagagatgcgaggacgtgtggctgggcatgcccagccccatccccgccaagtacatcgactactggaccttcctgaaggacgccttcggcctggaggaggagtag

SEQ ID NO: 80142 - DNA, 489 bp, Artificial Sequence
  Description of Artificial Sequence: Synthetic coding sequence
atgagcctgaccgtgggcaacctggccgagcaggagttcgtgaccatcgccagacactacagagtgcccgagggcacctgcagcgacatggacttcctgatcgccctggcccacgagaagttcaagaagaacatgttcgagaacttcgacaccttcatctacagctgcgtgtacgaggacagagagaagaagaacgtgctgcccaccaaggacatcaagagactgtgcaagagcagcagactgcccctgagcgacgacctgctggagagcctgctgagcagattcgaggacagcgagaagcagatcgactacaagagcttcttcagcgccctgaactggagaaagaaccccgtgcccgagctgcagcccgccagctacctgaaggagagatgcgaggacgtgtggctgggcatgcccagccccatccccgccaagtacatcgactactggaccttcctgaaggacgccttcggcctggaggaggagtag

SEQ ID NO: 80143 - DNA, 753 bp, Artificial Sequence
  Description of Artificial Sequence: Synthetic coding sequence
atgaagatcagaagagaggtggtggagcacgtggagcccctgagaccctacgagagcctggacaccctgaagcagttcctgcagtaccacggcaagatcctgtgcttcttctgcctgtgggacgacagcgtgagcatgttcggcgacagaagagagctgatcctgcactacttcctgtgcgacgacaccatcgagatcaaggagctgctgccccacagcagcggcagagacgccctgaagatgttcctgagaagaagcaagctgcccaagaactgcccccccagagtgtaccagcccggccagatcaccgacagagccgtgctgaacagctacggcgacttcatcaagaaccaggccgacggctacctgttcgacagatacaagctgggcaaggtggaccaggagttctacaaggacagcgacctgagcctgggcgtgaccatcaacgtgtggggcagaaaggtgctgctgtacgactgcgacgagttcaccaagagctactacaagagcaagtacggcatcgagaacttcaccagcgtgagctgcaagccccccagccccccccccaagatcgagagaaagttccccccctacaacggcttcggcagcgaggaggacagcctgagaaactgcatcgacctgaagcccaccccccacagaagaaacttcaagaagttcatggagaaggacagctacggcagcaagagcaacatcctgttcttctgcaagaccagccacagacagatgtgctag

SEQ ID NO: 80144 - DNA, 2334 bp, Artificial Sequence
  Description of Artificial Sequence: Synthetic coding sequence
ggcggccagaccaccagacccggcggcgccgccgcctgcagagccctgagcagcggcaccctggacttcagaaccctgagcgccatggccctgcccctgctgcccggcaacagcttcaacagaaacgtgggcaaggagaagttccacaagagccagcactggggcttctgcaacaacgtgatgatgctggtgagcgacgagaagcccggcatcggcggcgagcccctgctgggccagaagatcaagcccaagtgcagcatctaccccaagggcgacggcagcgacgtgcccagctgggtggccttcgacaagcaggtgctgagcttcgacgcctacctggaggaggaggtgctggacaagagccagaccaactacagaatcagatactacaagatctacttctaccccgaggacgacaccatccaggtgaacgagcccgaggtgaagaacagcggcctgctgcagggcaccagcatcagaagacacagaatcaccctgcccccccccgacgaggaccagttctacaccgtgtaccacttcaacgtgggcaccgaggtggtgttctacggcagaaccttcaagatctacgactgcgacgccttcaccagaaacttcctgagaaagatcggcgtgaaggtgaacccccccgtgcagtgccccgaggacccctacatgaagatcagaagagaggtggtggagcacgtggagcccctgagaccctacgagagcctggacaccctgaagcagttcctgcagtaccacggcaagatcctgtgcttcttctgcctgtgggacgacagcgtgagcatgttcggcgacagaagagagctgatcctgcactacttcctgtgcgacgacaccatcgagatcaaggagctgctgccccacagcagcggcagagacgccctgaagatgttcctgagaagaagcaagctgcccaagaactgcccccccagagtgtaccagcccggccagatcaccgacagagccgtgctgaacagctacggcgacttcatcaagaaccaggccgacggctacctgttcgacagatacaagctgggcaaggtggaccaggagttctacaaggacagcgacctgagcctgggcgtgaccatcaacgtgtggggcagaaaggtgctgctgtacgactgcgacgagttcaccaagagctactacaagagcaagtacggcatcgagaacttcaccagcgtgagctgcaagccccccagccccccccccaagatcgagagaaagttccccccctacaacggcttcggcagcgaggaggacagcctgagaaactgcatcgacctgaagcccaccccccacagaagaaacttcaagaagttcatggagaaggacagctacggcagcaagagcaacatcctgagattcttcgccaagctggtgaccgacaagtgcgtggacctggacagaatgttcgtgatcagctactacctgggcgacgacaccatcagcgtgttcgagcccatcgagagaaacagcggcatcgccggcggcatgttcctgaagagaagcagagtgaagaagcccggccaggaggtgttcaagagcgagctgagcgagtacatcaaggccgaggagctgtacatcggcgtgaccgtgaacgtgaacggctacctgttcagactgctgaacgccgacgagtacaccctgaactacatggagcagaacaccgacaagtaccccttcagcaacctgaagctggccctgcagaagctgaagcaggaggagggcaagagcagagagctgaagcaggtgttcaaggccgccgacagcaagcacaccaacatggtggactacaacaccttcagagacatcctgatgagcctgaccgtgggcaacctggccgagcaggagttcgtgaccatcgccagacactacagagtgcccgagggcacctgcagcgacatggacttcctgatcgccctggcccacgagaagttcaagaagaacatgttcgagaacttcgacaccttcatctacagctgcgtgtacgaggacagagagaagaagaacgtgctgcccaccaaggacatcaagagactgtgcaagagcagcagactgcccctgagcgacgacctgctggagagcctgctgagcagattcgaggacagcgagaagcagatcgactacaagagcttcttcagcgccctgaactggagaaagaaccccgtgcccgagctgcagcccgccagctacctgaaggagagatgcgaggacgtgtggctgggcatgcccagccccatccccgccaagtacatcgactactggaccttcctgaaggacgccttcggcctggaggaggagtag

SEQ ID NO: 80145 - DNA, 2193 bp, Artificial Sequence
  Description of Artificial Sequence: Synthetic coding sequence
tgaaacaacaccgccggcagaagaagatgcctgcccggccccctgttctgggaccccggcttcagcgacaccgagagacacggccccgccagcgccgccggccagcagctgcagccccagagagagaagggcgacggcagcgacgtgcccagctgggtggccttcgacaagcaggtgctgagcttcgacgcctacctggaggaggaggtgctggacaagagccagaccaactacagaatcagatactacaagatctacttctaccccgaggacgacaccatccaggtgaacgagcccgaggtgaagaacagcggcctgctgcagggcaccagcatcagaagacacagaatcaccctgcccccccccgacgaggaccagttctacaccgtgtaccacttcaacgtgggcaccgaggtggtgttctacggcagaaccttcaagatctacgactgcgacgccttcaccagaaacttcctgagaaagatcggcgtgaaggtgaacccccccgtgcagtgccccgaggacccctacatgaagatcagaagagaggtggtggagcacgtggagcccctgagaccctacgagagcctggacaccctgaagcagttcctgcagtaccacggcaagatcctgtgcttcttctgcctgtgggacgacagcgtgagcatgttcggcgacagaagagagctgatcctgcactacttcctgtgcgacgacaccatcgagatcaaggagctgctgccccacagcagcggcagagacgccctgaagatgttcctgagaagaagcaagctgcccaagaactgcccccccagagtgtaccagcccggccagatcaccgacagagccgtgctgaacagctacggcgacttcatcaagaaccaggccgacggctacctgttcgacagatacaagctgggcaaggtggaccaggagttctacaaggacagcgacctgagcctgggcgtgaccatcaacgtgtggggcagaaaggtgctgctgtacgactgcgacgagttcaccaagagctactacaagagcaagtacggcatcgagaacttcaccagcgtgagctgcaagccccccagccccccccccaagatcgagagaaagttccccccctacaacggcttcggcagcgaggaggacagcctgagaaactgcatcgacctgaagcccaccccccacagaagaaacttcaagaagttcatggagaaggacagctacggcagcaagagcaacatcctgagattcttcgccaagctggtgaccgacaagtgcgtggacctggacagaatgttcgtgatcagctactacctgggcgacgacaccatcagcgtgttcgagcccatcgagagaaacagcggcatcgccggcggcatgttcctgaagagaagcagagtgaagaagcccggccaggaggtgttcaagagcgagctgagcgagtacatcaaggccgaggagctgtacatcggcgtgaccgtgaacgtgaacggctacctgttcagactgctgaacgccgacgagtacaccctgaactacatggagcagaacaccgacaagtaccccttcagcaacctgaagctggccctgcagaagctgaagcaggaggagggcaagagcagagagctgaagcaggtgttcaaggccgccgacagcaagcacaccaacatggtggactacaacaccttcagagacatcctgatgagcctgaccgtgggcaacctggccgagcaggagttcgtgaccatcgccagacactacagagtgcccgagggcacctgcagcgacatggacttcctgatcgccctggcccacgagaagttcaagaagaacatgttcgagaacttcgacaccttcatctacagctgcgtgtacgaggacagagagaagaagaacgtgctgcccaccaaggacatcaagagactgtgcaagagcagcagactgcccctgagcgacgacctgctggagagcctgctgagcagattcgaggacagcgagaagcagatcgactacaagagcttcttcagcgccctgaactggagaaagaaccccgtgcccgagctgcagcccgccagctacctgaaggagagatgcgaggacgtgtggctgggcatgcccagccccatccccgccaagtacatcgactactggaccttcctgaaggacgccttcggcctggaggaggagtag

SEQ ID NO: 80146 - DNA, 720 bp, Artificial Sequence
  Description of Artificial Sequence: Synthetic coding sequence
atggccagcgaggagctggcctgcaagctggagagaagactgagaagagaggaggccgaggagagcggcccccagctggcccccctgggcgcccccgcccccgagcccaagcccgagcccgagccccccgccagagcccccaccgccagcgccgacgccgagctgagcgcccagctgagcagaagactggacatcaacgagggcgccgccagacccagaagatgcagagtgttcaacccctacaccgagttccccgagttcagcagaagactgatcaaggacctggagagcatgttcaagctgtacgacgccggcagagacggcttcatcgacctgatggagctgaagctgatgatggagaagctgggcgccccccagacccacctgggcctgaagagcatgatcaaggaggtggacgaggacttcgacggcaagctgagcttcagagagttcctgctgatcttccacaaggccgccgccggcgagctgcaggaggacagcggcctgatggccctggccaagctgagcgagatcgacgtggccctggagggcgtgaagggcgccaagaacttcttcgaggccaaggtgcaggccctgagcagcgccagcaagttcgaggccgagctgaaggccgagcaggacgagagaaagagagaggaggaggagagaagactgagacaggccgccttccagaagctgaaggccaacttcaacacctag

SEQ ID NO: 80147 - DNA, 432 bp, Artificial Sequence
  Description of Artificial Sequence: Synthetic coding sequence
atgggcgagctgcagtacgacgccggcagagacggcttcatcgacctgatggagctgaagctgatgatggagaagctgggcgccccccagacccacctgggcctgaagagcatgatcaaggaggtggacgaggacttcgacggcaagctgagcttcagagagttcctgctgatcttccacaaggccgccgccggcgagctgcaggaggacagcggcctgatggccctggccaagctgagcgagatcgacgtggccctggagggcgtgaagggcgccaagaacttcttcgaggccaaggtgcaggccctgagcagcgccagcaagttcgaggccgagctgaaggccgagcaggacgagagaaagagagaggaggaggagagaagactgagacaggccgccttccagaagctgaaggccaacttcaacacctag

SEQ ID NO: 80148 - DNA, 384 bp, Artificial Sequence
  Description of Artificial Sequence: Synthetic coding sequence
atggagctgaagctgatgatggagaagctgggcgccccccagacccacctgggcctgaagagcatgatcaaggaggtggacgaggacttcgacggcaagctgagcttcagagagttcctgctgatcttccacaaggccgccgccggcgagctgcaggaggacagcggcctgatggccctggccaagctgagcgagatcgacgtggccctggagggcgtgaagggcgccaagaacttcttcgaggccaaggtgcaggccctgagcagcgccagcaagttcgaggccgagctgaaggccgagcaggacgagagaaagagagaggaggaggagagaagactgagacaggccgccttccagaagctgaaggccaacttcaacacctag

SEQ ID NO: 80149 - DNA, 384 bp, Artificial Sequence; identical to SEQ ID NO: 80148
  Description of Artificial Sequence: Synthetic coding sequence

SEQ ID NO: 80150 - DNA, 429 bp, Artificial Sequence
  Description of Artificial Sequence: Synthetic coding sequence
atgttcaagctgtacgacgccggcagagacggcttcatcgacctgatggagctgaagctgatgatggagaagctgggcgccccccagacccacctgggcctgaagagcatgatcaaggaggtggacgaggacttcgacggcaagctgagcttcagagagttcctgctgatcttccacaaggccgccgccggcgagctgcaggaggacagcggcctgatggccctggccaagctgagcgagatcgacgtggccctggagggcgtgaagggcgccaagaacttcttcgaggccaaggtgcaggccctgagcagcgccagcaagttcgaggccgagctgaaggccgagcaggacgagagaaagagagaggaggaggagagaagactgagacaggccgccttccagaagctgaaggccaacttcaacacctag

SEQ ID NO: 80151 - DNA, 2466 bp, Artificial Sequence
  Description of Artificial Sequence: Synthetic coding sequence
atgcccaccagagtgtgctgctgctgcagcgccctgagacccagatacaagagactggtggacaacatcttccccgaggaccccaaggacggcctggtgaagaccgacatggagaagctgaccttctacgccgtgagcgcccccgagaagctggacagaatcggcagctacctggccgagagactgagcagagacgtggtgagacacagaagcggctacgtgctgatcgccatggaggccctggaccagctgctgatggcctgccacagccagagcatcaagcccttcgtggagagcttcctgcacatggtggccaagctgctggagagcggcgagcccaagctgcaggtgctgggcaccaacagcttcgtgaagttcgccaacatcgaggaggacacccccagctaccacagaagatacgacttcttcgtgagcagattcagcgccatgtgccacagctgccacagcgaccccgagatcagaaccgagatcagaatcgccggcatcagaggcatccagggcgtggtgagaaagaccgtgaacgacgagctgagagccaccatctgggagccccagcacatggacaagatcgtgcccagcctgctgttcaacatgcagaagatcgaggaggtggacagcagaatcggcccccccagcagccccagcgccaccgacaaggaggagaaccccgccgtgctggccgagaactgcttcagagagctgctgggcagagccaccttcggcaacatgaacaacgccgtgagacccgtgttcgcccacctggaccaccacaagctgtgggaccccaacgagttcgccgtgcactgcttcaagatcatcatgtacagcatccaggcccagtacagccaccacgtgatccaggagatcctgggccacctggacgccagaaagaaggacgcccccagagtgagagccggcatcatccaggtgctgctggaggccgtggccatcgccgccaagggcagcatcggccccaccgtgctggaggtgttcaacaccctgctgaagcacctgagactgagcgtggagttcgaggccaacgacctgcagggcggcagcgtgggcagcgtgaacctgaacaccagcagcaaggacaacgacgagaagatcgtgcagaacgccatcatccagaccatcggcttcttcggcagcaacctgcccgactaccagagaagcgagatcatgatgttcatcatgggcaaggtgcccgtgttcggcaccagcacccacaccctggacatcagccagctgggcgacctgggcaccagaagaatccagatcatgctgctgagaagcctgctgatggtgaccagcggctacaaggccaagaccatcgtgaccgccctgcccggcagcttcctggaccccctgctgagccccagcctgatggaggactacgagctgagacagctggtgctggaggtgatgcacaacctgatggacagacacgacaacagagccaagctgagaggcatcagaatcatccccgacgtggccgacctgaagatcaagagagagaagatctgcagacaggacaccagcttcatgaagaagaacggccagcagctgtacagacacatctacctgggctgcaaggaggaggacaacgtgcagaagaactacgagctgctgtacaccagcctggccctgatcaccatcgagctggccaacgaggaggtggtgatcgacctgatcagactggccatcgccctgcaggacagcgccatcatcaacgaggacaacctgcccatgttccacagatgcggcatcatggccctggtggccgcctacctgaacttcgtgagccagatgatcgccgtgcccgccttctgccagcacgtgagcaaggtgatcgagatcagaaccatggaggccccctacttcctgcccgagcacatcttcagagacaagtgcatgctgcccaagagcctggagaagcacgagaaggacctgtacttcctgaccaacaagatcgccgagagcctgggcggcagcggctacagcgtggagagactgagcgtgccctacgtgccccaggtgaccgacgaggacagactgagcagaagaaagagcatcgtggacaccgtgagcatccaggtggacatcctgagcaacaacgtgcccagcgacgacgtggtgagcaacaccgaggagatcaccttcgaggccctgaagaaggccatcgacaccagcggcatggaggagcaggagaaggagaagagaagactggtgatcgagaagttccagaaggcccccttcgaggagatcgccgcccagtgcgagagcaaggccaacctgctgcacgacagactggcccagatcctggagctgaccatcagacccccccccagccccagcggcaccctgaccatcaccagcggccacgcccagtaccagagcgtgcccgtgtacgagatgaagttccccgacctgtgcgtgtactag

SEQ ID NO: 80152 - DNA, 2466 bp, Artificial Sequence
  Description of Artificial Sequence: Synthetic coding sequence
atgaagagcagagtgtgctgctgctgcagcgccctgagacccagatacaagagactggtggacaacatcttccccgaggaccccaaggacggcctggtgaagaccgacatggagaagctgaccttctacgccgtgagcgcccccgagaagctggacagaatcggcagctacctggccgagagactgagcagagacgtggtgagacacagaagcggctacgtgctgatcgccatggaggccctggaccagctgctgatggcctgccacagccagagcatcaagcccttcgtggagagcttcctgcacatggtggccaagctgctggagagcggcgagcccaagctgcaggtgctgggcaccaacagcttcgtgaagttcgccaacatcgaggaggacacccccagctaccacagaagatacgacttcttcgtgagcagattcagcgccatgtgccacagctgccacagcgaccccgagatcagaaccgagatcagaatcgccggcatcagaggcatccagggcgtggtgagaaagaccgtgaacgacgagctgagagccaccatctgggagccccagcacatggacaagatcgtgcccagcctgctgttcaacatgcagaagatcgaggaggtggacagcagaatcggcccccccagcagccccagcgccaccgacaaggaggagaaccccgccgtgctggccgagaactgcttcagagagctgctgggcagagccaccttcggcaacatgaacaacgccgtgagacccgtgttcgcccacctggaccaccacaagctgtgggaccccaacgagttcgccgtgcactgcttcaagatcatcatgtacagcatccaggcccagtacagccaccacgtgatccaggagatcctgggccacctggacgccagaaagaaggacgcccccagagtgagagccggcatcatccaggtgctgctggaggccgtggccatcgccgccaagggcagcatcggccccaccgtgctggaggtgttcaacaccctgctgaagcacctgagactgagcgtggagttcgaggccaacgacctgcagggcggcagcgtgggcagcgtgaacctgaacaccagcagcaaggacaacgacgagaagatcgtgcagaacgccatcatccagaccatcggcttcttcggcagcaacctgcccgactaccagagaagcgagatcatgatgttcatcatgggcaaggtgcccgtgttcggcaccagcacccacaccctggacatcagccagctgggcgacctgggcaccagaagaatccagatcatgctgctgagaagcctgctgatggtgaccagcggctacaaggccaagaccatcgtgaccgccctgcccggcagcttcctggaccccctgctgagccccagcctgatggaggactacgagctgagacagctggtgctggaggtgatgcacaacctgatggacagacacgacaacagagccaagctgagaggcatcagaatcatccccgacgtggccgacctgaagatcaagagagagaagatctgcagacaggacaccagcttcatgaagaagaacggccagcagctgtacagacacatctacctgggctgcaaggaggaggacaacgtgcagaagaactacgagctgctgtacaccagcctggccctgatcaccatcgagctggccaacgaggaggtggtgatcgacctgatcagactggccatcgccctgcaggacagcgccatcatcaacgaggacaacctgcccatgttccacagatgcggcatcatggccctggtggccgcctacctgaacttcgtgagccagatgatcgccgtgcccgccttctgccagcacgtgagcaaggtgatcgagatcagaaccatggaggccccctacttcctgcccgagcacatcttcagagacaagtgcatgctgcccaagagcctggagaagcacgagaaggacctgtacttcctgaccaacaagatcgccgagagcctgggcggcagcggctacagcgtggagagactgagcgtgccctacgtgccccaggtgaccgacgaggacagactgagcagaagaaagagcatcgtggacaccgtgagcatccaggtggacatcctgagcaacaacgtgcccagcgacgacgtggtgagcaacaccgaggagatcaccttcgaggccctgaagaaggccatcgacaccagcggcatggaggagcaggagaaggagaagagaagactggtgatcgagaagttccagaaggcccccttcgaggagatcgccgcccagtgcgagagcaaggccaacctgctgcacgacagactggcccagatcctggagctgaccatcagacccccccccagccccagcggcaccctgaccatcaccagcggccacgcccagtaccagagcgtgcccgtgtacgagatgaagttccccgacctgtgcgtgtactag

SEQ ID NO: 80153 - DNA, 2334 bp, Artificial Sequence
  Description of Artificial Sequence: Synthetic coding sequence
atgcccaagggcgtgtgctgctgctgcagcgccctgagacccagatacaagagactggtggacaacatcttccccgaggaccccaaggacggcctggtgaagaccgacatggagaagctgaccttctacgccgtgagcgcccccgagaagctggacagaatcggcagctacctggccgagagactgagcagagacgtggtgagacacagaagcggctacgtgctgatcgccatggaggccctggaccagctgctgatggcctgccacagccagagcatcaagcccttcgtggagagcttcctgcacatggtggccaagctgctggagagcggcgagcccaagctgcaggtgctgggcaccaacagcttcgtgaagttcgccaacatcgaggaggacacccccagctaccacagaagatacgacttcttcgtgagcagattcagcgccatgtgccacagctgccacagcgaccccgagatcagaaccgagatcagaatcgccggcatcagaggcatccagggcgtggtgagaaagaccgtgaacgacgagctgagagccaccatctgggagccccagcacatggacaagatcgtgcccagcctgctgttcaacatgcagaagatcgaggaggtggacagcagaatcggcccccccagcagccccagcgccaccgacaaggaggagaaccccgccgtgctggccgagaactgcttcagagagctgctgggcagagccaccttcggcaacatgaacaacgccgtgagacccgtgttcgcccacctggaccaccacaagctgtgggaccccaacgagttcgccgtgcactgcttcaagatcatcatgtacagcatccaggcccagtacagccaccacgtgatccaggagatcctgggccacctggacgccagaaagaaggacgcccccagagtgagagccggcatcatccaggtgctgctggaggccgtggccatcgccgccaagggcagcatcggccccaccgtgctggaggtgttcaacaccctgctgaagcacctgagactgagcgtggagttcgaggccaacgacctgcagggcggcagcgtgggcagcgtgaacctgaacaccagcagcaaggacaacgacgagaagatcgtgcagaacgccatcatccagaccatcggcttcttcggcagcaacctgcccgactaccagagaagcgagatcatgatgttcatcatgggcaaggtgcccgtgttcggcaccagcacccacaccctggacatcagccagctgggcgacctgggcaccagaagaatccagatcatgctgctgagaagcctgctgatggtgaccagcggctacaaggccaagaccatcgtgaccgccctgcccggcagcttcctggaccccctgctgagccccagcctgatggaggactacgagctgagacagctggtgctggaggtgatgcacaacctgatggacagacacgacaacagagccaagctgagaggcatcagaatcatccccgacgtggccgacctgaagatcaagagagagaagatctgcagacaggacaccagcttcatgaagaagaacggccagcagctgtacagacacatctacctgggctgcaaggaggaggacaacgtgcagaagaactacgagctgctgtacaccagcctggccctgatcaccatcgagctggccaacgaggaggtggtgatcgacctgatcagactggccatcgccctgcaggacagcgccatcatcaacgaggacaacctgcccatgttccacagatgcggcatcatggccctggtggccgcctacctgaacttcgtgagccagatgatcgccgtgcccgccttctgccacaagatcgccgagagcctgggcggcagcggctacagcgtggagagactgagcgtgccctacgtgccccaggtgaccgacgaggacagactgagcagaagaaagagcatcgtggacaccgtgagcatccaggtggacatcctgagcaacaacgtgcccagcgacgacgtggtgagcaacaccgaggagatcaccttcgaggccctgaagaaggccatcgacaccagcggcatggaggagcaggagaaggagaagagaagactggtgatcgagaagttccagaaggcccccttcgaggagatcgccgcccagtgcgagagcaaggccaacctgctgcacgacagactggcccagatcctggagctgaccatcagacccccccccagccccagcggcaccctgaccatcaccagcggccacgcccagtaccagagcgtgcccgtgtacgagatgaagttccccgacctgtgcgtgtactag

SEQ ID NO: 80154 - DNA, 603 bp, Artificial Sequence
  Description of Artificial Sequence: Synthetic coding sequence
atgctggccagactgctgaagttcgaggaggccccctacttcctgcccgagcacatcttcagagacaagtgcatgctgcccaagagcctggagaagcacgagaaggacctgtacttcctgaccaacaagatcgccgagagcctgggcggcagcggctacagcgtggagagactgagcgtgccctacgtgccccaggtgaccgacgaggacagactgagcagaagaaagagcatcgtggacaccgtgagcatccaggtggacatcctgagcaacaacgtgcccagcgacgacgtggtgagcaacaccgaggagatcaccttcgaggccctgaagaaggccatcgacaccagcggcatggaggagcaggagaaggagaagagaagactggtgatcgagaagttccagaaggcccccttcgaggagatcgccgcccagtgcgagagcaaggccaacctgctgcacgacagactggcccagatcctggagctgaccatcagacccccccccagccccagcggcaccctgaccatcaccagcggccacgcccagtaccagagcgtgcccgtgtacgagatgaagttccccgacctgtgcgtgtactag

SEQ ID NO: 80155 - DNA, 2358 bp, Artificial Sequence
  Description of Artificial Sequence: Synthetic coding sequence
atggagaagctgaccttctacgccgtgagcgcccccgagaagctggacagaatcggcagctacctggccgagagactgagcagagacgtggtgagacacagaagcggctacgtgctgatcgccatggaggccctggaccagctgctgatggcctgccacagccagagcatcaagcccttcgtggagagcttcctgcacatggtggccaagctgctggagagcggcgagcccaagctgcaggtgctgggcaccaacagcttcgtgaagttcgccaacatcgaggaggacacccccagctaccacagaagatacgacttcttcgtgagcagattcagcgccatgtgccacagctgccacagcgaccccgagatcagaaccgagatcagaatcgccggcatcagaggcatccagggcgtggtgagaaagaccgtgaacgacgagctgagagccaccatctgggagccccagcacatggacaagatcgtgcccagcctgctgttcaacatgcagaagatcgaggaggtggacagcagaatcggcccccccagcagccccagcgccaccgacaaggaggagaaccccgccgtgctggccgagaactgcttcagagagctgctgggcagagccaccttcggcaacatgaacaacgccgtgagacccgtgttcgcccacctggaccaccacaagctgtgggaccccaacgagttcgccgtgcactgcttcaagatcatcatgtacagcatccaggcccagtacagccaccacgtgatccaggagatcctgggccacctggacgccagaaagaaggacgcccccagagtgagagccggcatcatccaggtgctgctggaggccgtggccatcgccgccaagggcagcatcggccccaccgtgctggaggtgttcaacaccctgctgaagcacctgagactgagcgtggagttcgaggccaacgacctgcagggcggcagcgtgggcagcgtgaacctgaacaccagcagcaaggacaacgacgagaagatcgtgcagaacgccatcatccagaccatcggcttcttcggcagcaacctgcccgactaccagagaagcgagatcatgatgttcatcatgggcaaggtgcccgtgttcggcaccagcacccacaccctggacatcagccagctgggcgacctgggcaccagaagaatccagatcatgctgctgagaagcctgctgatggtgaccagcggctacaaggccaagaccatcgtgaccgccctgcccggcagcttcctggaccccctgctgagccccagcctgatggaggactacgagctgagacagctggtgctggaggtgatgcacaacctgatggacagacacgacaacagagccaagctgagaggcatcagaatcatccccgacgtggccgacctgaagatcaagagagagaagatctgcagacaggacaccagcttcatgaagaagaacggccagcagctgtacagacacatctacctgggctgcaaggaggaggacaacgtgcagaagaactacgagctgctgtacaccagcctggccctgatcaccatcgagctggccaacgaggaggtggtgatcgacctgatcagactggccatcgccctgcaggacagcgccatcatcaacgaggacaacctgcccatgttccacagatgcggcatcatggccctggtggccgcctacctgaacttcgtgagccagatgatcgccgtgcccgccttctgccagcacgtgagcaaggtgatcgagatcagaaccatggaggccccctacttcctgcccgagcacatcttcagagacaagtgcatgctgcccaagagcctggagaagcacgagaaggacctgtacttcctgaccaacaagatcgccgagagcctgggcggcagcggctacagcgtggagagactgagcgtgccctacgtgccccaggtgaccgacgaggacagactgagcagaagaaagagcatcgtggacaccgtgagcatccaggtggacatcctgagcaacaacgtgcccagcgacgacgtggtgagcaacaccgaggagatcaccttcgaggccctgaagaaggccatcgacaccagcggcatggaggagcaggagaaggagaagagaagactggtgatcgagaagttccagaaggcccccttcgaggagatcgccgcccagtgcgagagcaaggccaacctgctgcacgacagactggcccagatcctggagctgaccatcagacccccccccagccccagcggcaccctgaccatcaccagcggccacgcccagtaccagagcgtgcccgtgtacgagatgaagttccccgacctgtgcgtgtactag

SEQ ID NO: 80156 - DNA, 1482 bp, Artificial Sequence
  Description of Artificial Sequence: Synthetic coding sequence
atgctgaaggccctgttcctgaccatgctgaccctggccctggtgaagagccaggacaccgaggagaccatcacctacacccagtgcaccgacggctacgagtgggaccccgtgagacagcagtgcaaggacatcgacgagtgcgacatcgtgcccgacgcctgcaagggcggcatgaagtgcgtgaaccactacggcggctacctgtgcctgcccaagaccgcccagatcatcgtgaacaacgagcagccccagcaggagacccagcccgccgagggcaccagcggcgccaccaccggcgtggtggccgccagcagcatggccaccagcggcgtgctgcccggcggcggcttcgtggccagcgccgccgccgtggccggccccgagatgcagaccggcagaaacaacttcgtgatcagaagaaaccccgccgacccccagagaatccccagcaaccccagccacagaatccagtgcgccgccggctacgagcagagcgagcacaacgtgtgccaggacatcgacgagtgcaccgccggcacccacaactgcagagccgaccaggtgtgcatcaacctgagaggcagcttcgcctgccagtgcccccccggctaccagaagagaggcgagcagtgcgtggacatcgacgagtgcaccatccccccctactgccaccagagatgcgtgaacacccccggcagcttctactgccagtgcagccccggcttccagctggccgccaacaactacacctgcgtggacatcaacgagtgcgacgccagcaaccagtgcgcccagcagtgctacaacatcctgggcagcttcatctgccagtgcaaccagggctacgagctgagcagcgacagactgaactgcgaggacatcgacgagtgcagaaccagcagctacctgtgccagtaccagtgcgtgaacgagcccggcaagttcagctgcatgtgcccccagggctaccaggtggtgagaagcagaacctgccaggacatcaacgagtgcgagaccaccaacgagtgcagagaggacgagatgtgctggaactaccacggcggcttcagatgctaccccagaaacccctgccaggacccctacatcctgacccccgagaacagatgcgtgtgccccgtgagcaacgccatgtgcagagagctgccccagagcatcgtgtacaagtacatgagcatcagaagcgacagaagcgtgcccagcgacatcttccagatccaggccaccaccatctacgccaacaccatcaacaccttcagaatcaagagcggcaacgagaacggcgagttctacctgagacagaccagccccgtgagcgccatgctggtgctggtgaagagcctgagcggccccagagagcacatcgtggacctggagatgctgaccgtgagcagcatcggcaccttcagaaccagcagcgtgctgagactgaccatcatcgtgggccccttcagcttctag

SEQ ID NO: 80157 - DNA, 1482 bp, Artificial Sequence; identical to SEQ ID NO: 80156
  Description of Artificial Sequence: Synthetic coding sequence

SEQ ID NO: 80158 - DNA, 1482 bp, Artificial Sequence; identical to SEQ ID NO: 80156
  Description of Artificial Sequence: Synthetic coding sequence

SEQ ID NO: 80159 - DNA, 1050 bp, Artificial Sequence
  Description of Artificial Sequence: Synthetic coding sequence
atggaggacaccagcgccttcagaaagcagcccagactgctgagcatcatgaacagcctgagcagcgagcacaacgtgtgccaggacatcgacgagtgcaccgccggcacccacaactgcagagccgaccaggtgtgcatcaacctgagaggcagcttcgcctgccagtgcccccccggctaccagaagagaggcgagcagtgcgtggacatcgacgagtgcaccatccccccctactgccaccagagatgcgtgaacacccccggcagcttctactgccagtgcagccccggcttccagctggccgccaacaactacacctgcgtggacatcaacgagtgcgacgccagcaaccagtgcgcccagcagtgctacaacatcctgggcagcttcatctgccagtgcaaccagggctacgagctgagcagcgacagactgaactgcgaggacatcgacgagtgcagaaccagcagctacctgtgccagtaccagtgcgtgaacgagcccggcaagttcagctgcatgtgcccccagggctaccaggtggtgagaagcagaacctgccaggacatcaacgagtgcgagaccaccaacgagtgcagagaggacgagatgtgctggaactaccacggcggcttcagatgctaccccagaaacccctgccaggacccctacatcctgacccccgagaacagatgcgtgtgccccgtgagcaacgccatgtgcagagagctgccccagagcatcgtgtacaagtacatgagcatcagaagcgacagaagcgtgcccagcgacatcttccagatccaggccaccaccatctacgccaacaccatcaacaccttcagaatcaagagcggcaacgagaacggcgagttctacctgagacagaccagccccgtgagcgccatgctggtgctggtgaagagcctgagcggccccagagagcacatcgtggacctggagatgctgaccgtgagcagcatcggcaccttcagaaccagcagcgtgctgagactgaccatcatcgtgggccccttcagcttctag

SEQ ID NO: 80160 - DNA, 159 bp, Artificial Sequence
  Description of Artificial Sequence: Synthetic coding sequence
atgctgaaggccctgttcctgaccatgctgaccctggccctggtgaagagccaggacaccgaggagaccatcacctacacccagtgcaccgacggctacgagtgggaccccgtgagacagcagtgcaaggacatcgacgagtgcgacatcgtgccctag

SEQ ID NO: 80161 - DNA, 84 bp, Artificial Sequence
  Description of Artificial Sequence: Synthetic coding sequence
atgctgaaggccctgttcctgaccatgctgaccctggccctggtgaagagccaggacaccgaggagaccatcacctacacctag

SEQ ID NO: 80162 - DNA, 1068 bp, Artificial Sequence
  Description of Artificial Sequence: Synthetic coding sequence
atgaagtgcgtgaaccactacggcggctacctgtgcctgcccaagaccgcccagatcatcgtgaacaacgagcagccccagcaggagacccagcccgccgagggcaccagcggcgccaccaccggcgtggtggccgccagcagcatggccaccagcggcgtgctgcccggcggcggcttcgtggccagcgccgccgccgtggccggccccgagatgcagaccggcagaaacaacttcgtgatcagaagaaaccccgccgacccccagagaatccccagcaaccccagccacagaatccagtgcgccgccggctacgagcagagcgagcacaacgtgtgccaggacatcgacgagtgcaccgccggcacccacaactgcagagccgaccaggtgtgcatcaacctgagaggcagcttcgcctgccagtgcccccccggctaccagaagagaggcgagcagtgcgtggacatcgacgagtgcagaaccagcagctacctgtgccagtaccagtgcgtgaacgagcccggcaagttcagctgcatgtgcccccagggctaccaggtggtgagaagcagaacctgccaggacatcaacgagtgcgagaccaccaacgagtgcagagaggacgagatgtgctggaactaccacggcggcttcagatgctaccccagaaacccctgccaggacccctacatcctgacccccgagaacagatgcgtgtgccccgtgagcaacgccatgtgcagagagctgccccagagcatcgtgtacaagtacatgagcatcagaagcgacagaagcgtgcccagcgacatcttccagatccaggccaccaccatctacgccaacaccatcaacaccttcagaatcaagagcggcaacgagaacggcgagttctacctgagacagaccagccccgtgagcgccatgctggtgctggtgaagagcctgagcggccccagagagcacatcgtggacctggagatgctgaccgtgagcagcatcggcaccttcagaaccagcagcgtgctgagactgaccatcatcgtgggccccttcagcttctag

SEQ ID NO: 80163 - DNA, 264 bp, Artificial Sequence
  Description of Artificial Sequence: Synthetic coding sequence
atgctgaaggccctgttcctgaccatgctgaccctggccctggtgaagagccaggacaccgaggagaccatcacctacacccagtgcaccgacggctacgagtgggaccccgtgagacagcagtgcaaggacatcgacgagtgcgacatcgtgcccgacgcctgcaagggcggcatgaagtgcgtgaaccactacggcggctacctgtgcctgcccaagaccgcccagatcatcgtgaacaacgagcagccccagcaggagtag

SEQ ID NO: 80164 - DNA, 519 bp, Artificial Sequence
  Description of Artificial Sequence: Synthetic coding sequence
atgctgaaggccctgttcctgaccatgctgaccctggccctggtgaagagccaggacaccgaggagaccatcacctacacccagtgcaccgacggctacgagtgggaccccgtgagacagcagtgcaaggacatcgacgagtgcgacatcgtgcccgacgcctgcaagggcggcatgaagtgcgtgaaccactacggcggctacctgtgcctgcccaagaccgcccagatcatcgtgaacaacgagcagccccagcaggagacccagcccgccgagggcaccagcggcgccaccaccggcgtggtggccgccagcagcatggccaccagcggcgtgctgcccggcggcggcttcgtggccagcgccgccgccgtggccggccccgagatgcagaccggcagaaacaacttcgtgatcagaagaaaccccgccgacccccagagaatccccagcaaccccagccacagaatccagtgcgccgccggctacgagcagagcgagcacaacgtgtgccagtag

SEQ ID NO: 80165 - DNA, 360 bp, Artificial Sequence
  Description of Artificial Sequence: Synthetic coding sequence
atgctgaaggccctgttcctgaccatgctgaccctggccctggtgaagagccaggacaccgaggagaccatcacctacacccagtgcaccgacggctacgagtgggaccccgtgagacagcagtgcaaggacatcgacgagtgcgacatcgtgcccgacgcctgcaagggcggcatgaagtgcgtgaaccactacggcggctacctgtgcctgcccaagaccgcccagatcatcgtgaacaacgagcagccccagcaggagacccagcccgccgagggcaccagcggcgccaccaccggcgtggtggccgccagcagcatggccaccagcggcgtgctgcccggcggcggcttcgtgtag

SEQ ID NO: 80166 - DNA, 321 bp, Artificial Sequence
  Description of Artificial Sequence: Synthetic coding sequence
atgctgaaggccctgttcctgaccatgctgaccctggccctggtgaagagccaggacaccgaggagaccatcacctacacccagtgcaccgacggctacgagtgggaccccgtgagacagcagtgcaaggacatcgacgagtgcgacatcgtgcccgacgcctgcaagggcggcatgaagtgcgtgaaccactacggcggctacctgtgcctgcccaagaccgcccagatcatcgtgaacaacgagcagccccagcaggagacccagcccgccgagggcaccagcggcgccaccaccggcgtggtggccgccagcagctag

SEQ ID NO: 80167 - DNA, 189 bp, Artificial Sequence
  Description of Artificial Sequence: Synthetic coding sequence
atgctgaaggccctgttcctgaccatgctgaccctggccctggtgaagagccaggacaccgaggagaccatcacctacacccagtgcaccgacggctacgagtgggaccccgtgagacagcagtgcaaggacatcgacgagtgcgacatcgtgcccgacgcctgcaagggcggcatgaagtgcgtgtag

SEQ ID NO: 80168 - DNA, 1332 bp, Artificial Sequence
  Description of Artificial Sequence: Synthetic coding sequence
atgctgccctgcgccagctgcctgcccggcagcctgctgctgtgggccctgctgctgctgctgctgggcagcgccagcccccaggacagcgaggagcccgacagctacaccgagtgcaccgacggctacgagtgggaccccgacagccagcactgcagagacgtgaacgagtgcctgaccatccccgaggcctgcaagggcgagatgaagtgcatcaaccactacggcggctacctgtgcctgcccagaagcgccgccgtgatcaacgacctgcacggcgagggcccccccccccccgtgccccccgcccagcaccccaacccctgcccccccggctacgagcccgacgaccaggacagctgcgtggacgtggacgagtgcgcccaggccctgcacgactgcagacccagccaggactgccacaacctgcccggcagctaccagtgcacctgccccgacggctacagaaagatcggccccgagtgcgtggacatcgacgagtgcagatacagatactgccagcacagatgcgtgaacctgcccggcagcttcagatgccagtgcgagcccggcttccagctgggccccaacaacagaagctgcgtggacgtgaacgagtgcgacatgggcgccccctgcgagcagagatgcttcaacagctacggcaccttcctgtgcagatgccaccagggctacgagctgcacagagacggcttcagctgcagcgacatcgacgagtgcagctacagcagctacctgtgccagtacagatgcatcaacgagcccggcagattcagctgccactgcccccagggctaccagctgctggccaccagactgtgccaggacatcgacgagtgcgagagcggcgcccaccagtgcagcgaggcccagacctgcgtgaacttccacggcggctacagatgcgtggacaccaacagatgcgtggagccctacatccaggtgagcgagaacagatgcctgtgccccgccagcaaccccctgtgcagagagcagcccagcagcatcgtgcacagatacatgaccatcaccagcgagagaagcgtgcccgccgacgtgttccagatccaggccaccagcgtgtaccccggcgcctacaacgccttccagatcagagccggcaacagccagggcgacttctacatcagacagatcaacaacgtgagcgccatgctggtgctggccagacccgtgaccggccccagagagtacgtgctggacctggagatggtgaccatgaacagcctgatgagctacagagccagcagcgtgctgagactgaccgtgttcgtgggcgcctacaccttctag

SEQ ID NO: 80169 - DNA, 609 bp, Artificial Sequence
  Description of Artificial Sequence: Synthetic coding sequence
atgctgccctgcgccagctgcctgcccggcagcctgctgctgtgggccctgctgctgctgctgctgggcagcgccagcccccaggacagcgaggagcccgacagctacaccgagtgcaccgacggctacgagtgggaccccgacagccagcactgcagagacgtgaacgagtgcctgaccatccccgaggcctgcaagggcgagatgaagtgcatcaaccactacggcggctacctgtgcctgcccagaagcgccgccgtgatcaacgacctgcacggcgagggcccccccccccccgtgccccccgcccagcaccccaacccctgcccccccggctacgagcccgacgaccaggacagctgcgtggacgtggacgagtgcgcccaggccctgcacgactgcagacccagccaggactgccacaacctgcccggcagctaccagtgcacctgccccgacggctacagaaagatcggccccgagtgcgtggacatcgacgagtgcagatacagatactgccagcacagatgcgtgaacctgcccggcagcttcagatgccagtgcgagcccggcttccagctgggccccaacaacagaagctgcgtgtag

SEQ ID NO: 80170 - DNA, 552 bp, Artificial Sequence
  Description of Artificial Sequence: Synthetic coding sequence
atgctgccctgcgccagctgcctgcccggcagcctgctgctgtgggccctgctgctgctgctgctgggcagcgccagcccccaggacagcgaggagcccgacagctacaccgagtgcaccgacggctacgagtgggaccccgacagccagcactgcagagacgtgaacgagtgcctgaccatccccgaggcctgcaagggcgagatgaagtgcatcaaccactacggcggctacctgtgcctgcccagaagcgccgccgtgatcaacgacctgcacggcgagggcccccccccccccgtgccccccgcccagcaccccaacccctgcccccccggctacgagcccgacgaccaggacagctgcgtggacgtggacgagtgcgcccaggccctgcacgactgcagacccagccaggactgccacaacctgcccggcagctaccagtgcacctgccccgacggctacagaaagatcggccccgagtgcgtggacatcgacgagtgcagatacagatactgccagcacagatgcgtgaacctgcccggcagctag

SEQ ID NO: 80171 - DNA, 1332 bp, Artificial Sequence; identical to SEQ ID NO: 80168
  Description of Artificial Sequence: Synthetic coding sequence

SEQ ID NO: 80172 - DNA, 2466 bp, Artificial Sequence
  Description of Artificial Sequence: Synthetic coding sequence
atgagaggcttcaacctgctgctgttctggggctgctgcgtgatgcacagctgggagggccacatcagacccaccagaaagcccaacaccaagggcaacaactgcagagacagcaccctgtgccccgcctacgccacctgcaccaacaccgtggacagctactactgcgcctgcaagcagggcttcctgagcagcaacggccagaaccacttcaaggaccccggcgtgagatgcaaggacatcgacgagtgcagccagagcccccagccctgcggccccaacagcagctgcaagaacctgagcggcagatacaagtgcagctgcctggacggcttcagcagccccaccggcaacgactgggtgcccggcaagcccggcaacttcagctgcaccgacatcaacgagtgcctgaccagcagcgtgtgccccgagcacagcgactgcgtgaacagcatgggcagctacagctgcagctgccaggtgggcttcatcagcagaaacagcacctgcgaggacgtggacgagtgcgccgaccccagagcctgccccgagcacgccacctgcaacaacaccgtgggcaactacagctgcttctgcaaccccggcttcgagagcagcagcggccacctgagcttccagggcctgaaggccagctgcgaggacatcgacgagtgcaccgagatgtgccccatcaacagcacctgcaccaacacccccggcagctacttctgcacctgccaccccggcttcgcccccagcaacggccagctgaacttcaccgaccagggcgtggagtgcagagacatcgacgagtgcagacaggaccccagcacctgcggccccaacagcatctgcaccaacgccctgggcagctacagctgcggctgcatcgccggcttccaccccaaccccgagggcagccagaaggacggcaacttcagctgccagagagtgctgttcaagtgcaaggaggacgtgatccccgacaacaagcagatccagcagtgccaggagggcaccgccgtgaagcccgcctacgtgagcttctgcgcccagatcaacaacatcttcagcgtgctggacaaggtgtgcgagaacaagaccaccgtggtgagcctgaagaacaccaccgagagcttcgtgcccgtgctgaagcagatcagcacctggaccaagttcaccaaggaggagaccagcagcctggccaccgtgttcctggagagcgtggagagcatgaccctggccagcttctggaagcccagcgccaacatcacccccgccgtgagaaccgagtacctggacatcgagagcaaggtgatcaacaaggagtgcagcgaggagaacgtgaccctggacctggtggccaagggcgacaagatgaagatcggctgcagcaccatcgaggagagcgagagcaccgagaccaccggcgtggccttcgtgagcttcgtgggcatggagagcgtgctgaacgagagattcttcaaggaccaccaggcccccctgaccaccagcgagatcaagctgaagatgaacagcagagtggtgggcggcatcatgaccggcgagaagaaggacggcttcagcgaccccatcatctacaccctggagaacatccagcccaagcagaagttcgagagacccatctgcgtgagctggagcaccgacgtgaagggcggcagatggaccagcttcggctgcgtgatcctggaggccagcgagacctacaccatctgcagctgcaaccagatggccaacctggccgtgatcatggccagcggcgagctgaccatgggctgcgccatcatcgccggcttcctgcactacctgttcctggcctgcttcttctggatgctggtggaggccgtgatcctgttcctgatggtgagaaacctgaaggtggtgaactacttcagcagcagaaacatcaagatgctgcacatctgcgccttcggctacggcctgcccatgctggtggtggtgatcagcgccagcgtgcagccccagggctacggcatgcacaacagatgctggctgaacaccgagaccggcttcatctggagcttcctgggccccgtgtgcaccgtgatcgtgatcaacagcctgctgctgacctggaccctgtggatcctgagacagagactgagcagcgtgaacgccgaggtgagcaccctgaaggacaccagactgctgaccttcaaggccttcgcccagctgttcatcctgggctgcagctgggtgctgggcatcttccagatcggccccgtggccggcgtgatggcctacctgttcaccatcatcaacagcctgcagggcgccttcatcttcctgatccactgcctgctgaacggccaggtgagagaggagtacaagagatggatcaccggcaagaccaagcccagcagccagagccagaccagcagaatcctgctgagcagcatgcccagcgccagcaagaccggctag

SEQ ID NO: 80173 - DNA, 2661 bp, Artificial Sequence
  Description of Artificial Sequence: Synthetic coding sequence
atgagaggcttcaacctgctgctgttctggggctgctgcgtgatgcacagctgggagggccacatcagacccaccagaaagcccaacaccaagggcaacaactgcagagacagcaccctgtgccccgcctacgccacctgcaccaacaccgtggacagctactactgcgcctgcaagcagggcttcctgagcagcaacggccagaaccacttcaaggaccccggcgtgagatgcaaggacatcgacgagtgcagccagagcccccagccctgcggccccaacagcagctgcaagaacctgagcggcagatacaagtgcagctgcctggacggcttcagcagccccaccggcaacgactgggtgcccggcaagcccggcaacttcagctgcaccgacatcaacgagtgcctgaccagcagcgtgtgccccgagcacagcgactgcgtgaacagcatgggcagctacagctgcagctgccaggtgggcttcatcagcagaaacagcacctgcgaggacgtggacgagtgcgccgaccccagagcctgccccgagcacgccacctgcaacaacaccgtgggcaactacagctgcttctgcaaccccggcttcgagagcagcagcggccacctgagcttccagggcctgaaggccagctgcgaggacatcgacgagtgcaccgagatgtgccccatcaacagcacctgcaccaacacccccggcagctacttctgcacctgccaccccggcttcgcccccagcaacggccagctgaacttcaccgaccagggcgtggagtgcagagacatcgacgagtgcagacaggaccccagcacctgcggccccaacagcatctgcaccaacgccctgggcagctacagctgcggctgcatcgccggcttccaccccaaccccgagggcagccagaaggacggcaacttcagctgccagagagtgctgttcaagtgcaaggaggacgtgatccccgacaacaagcagatccagcagtgccaggagggcaccgccgtgaagcccgcctacgtgagcttctgcgcccagatcaacaacatcttcagcgtgctggacaaggtgtgcgagaacaagaccaccgtggtgagcctgaagaacaccaccgagagcttcgtgcccgtgctgaagcagatcagcacctggaccaagttcaccaaggaggagaccagcagcctggccaccgtgttcctggagagcgtggagagcatgaccctggccagcttctggaagcccagcgccaacatcacccccgccgtgagaaccgagtacctggacatcgagagcaaggtgatcaacaaggagtgcagcgaggagaacgtgaccctggacctggtggccaagggcgacaagatgaagatcggctgcagcaccatcgaggagagcgagagcaccgagaccaccggcgtggccttcgtgagcttcgtgggcatggagagcgtgctgaacgagagattcttcaaggaccaccaggcccccctgaccaccagcgagatcaagctgaagatgaacagcagagtggtgggcggcatcatgaccggcgagaagaaggacggcttcagcgaccccatcatctacaccctggagaacatccagcccaagcagaagttcgagagacccatctgcgtgagctggagcaccgacgtgaagggcggcagatggaccagcttcggctgcgtgatcctggaggccagcgagacctacaccatctgcagctgcaaccagatggccaacctggccgtgatcatggccagcggcgagctgaccatggacttcagcctgtacatcatcagccacgtgggcatcatcatcagcctggtgtgcctggtgctggccatcgccaccttcctgctgtgcagaagcatcagaaaccacaacacctacctgcacctgcacctgtgcgtgtgcctgctgctggccaagaccctgttcctggccggcatccacaagaccgacaacaagatgggctgcgccatcatcgccggcttcctgcactacctgttcctggcctgcttcttctggatgctggtggaggccgtgatcctgttcctgatggtgagaaacctgaaggtggtgaactacttcagcagcagaaacatcaagatgctgcacatctgcgccttcggctacggcctgcccatgctggtggtggtgatcagcgccagcgtgcagccccagggctacggcatgcacaacagatgctggctgaacaccgagaccggcttcatctggagcttcctgggccccgtgtgcaccgtgatcgtgatcaacagcctgctgctgacctggaccctgtggatcctgagacagagactgagcagcgtgaacgccgaggtgagcaccctgaaggacaccagactgctgaccttcaaggccttcgcccagctgttcatcctgggctgcagctgggtgctgggcatcttccagatcggccccgtggccggcgtgatggcctacctgttcaccatcatcaacagcctgcagggcgccttcatcttcctgatccactgcctgctgaacggccaggtgagagaggagtacaagagatggatcaccggcaagaccaagcccagcagccagagccagaccagcagaatcctgctgagcagcatgcccagcgccagcaagaccggctag

SEQ ID NO: 80174 - DNA, 2604 bp, Artificial Sequence
  Description of Artificial Sequence: Synthetic coding sequence
atgagaggcttcaacctgctgctgttctggggctgctgcgtgatgcacagctgggagggccacatcagacccaccagaaagcccaacaccaagggcaacaactgcagagacagcaccctgtgccccgcctacgccacctgcaccaacaccgtggacagctactactgcgcctgcaagcagggcttcctgagcagcaacggccagaaccacttcaaggaccccggcgtgagatgcaaggacatcaacgagtgcctgaccagcagcgtgtgccccgagcacagcgactgcgtgaacagcatgggcagctacagctgcagctgccaggtgggcttcatcagcagaaacagcacctgcgaggacgtggacgagtgcgccgaccccagagcctgccccgagcacgccacctgcaacaacaccgtgggcaactacagctgcttctgcaaccccggcttcgagagcagcagcggccacctgagcttccagggcctgaaggccagctgcgaggacatcgacgagtgcaccgagatgtgccccatcaacagcacctgcaccaacacccccggcagctacttctgcacctgccaccccggcttcgcccccagcaacggccagctgaacttcaccgaccagggcgtggagtgcagagacatcgacgagtgcagacaggaccccagcacctgcggccccaacagcatctgcaccaacgccctgggcagctacagctgcggctgcatcgccggcttccaccccaaccccgagggcagccagaaggacggcaacttcagctgccagagagtgctgttcaagtgcaaggaggacgtgatccccgacaacaagcagatccagcagtgccaggagggcaccgccgtgaagcccgcctacgtgagcttctgcgcccagatcaacaacatcttcagcgtgctggacaaggtgtgcgagaacaagaccaccgtggtgagcctgaagaacaccaccgagagcttcgtgcccgtgctgaagcagatcagcacctggaccaagttcaccaaggaggagaccagcagcctggccaccgtgttcctggagagcgtggagagcatgaccctggccagcttctggaagcccagcgccaacatcacccccgccgtgagaaccgagtacctggacatcgagagcaaggtgatcaacaaggagtgcagcgaggagaacgtgaccctggacctggtggccaagggcgacaagatgaagatcggctgcagcaccatcgaggagagcgagagcaccgagaccaccggcgtggccttcgtgagcttcgtgggcatggagagcgtgctgaacgagagattcttcaaggaccaccaggcccccctgaccaccagcgagatcaagctgaagatgaacagcagagtggtgggcggcatcatgaccggcgagaagaaggacggcttcagcgaccccatcatctacaccctggagaacatccagcccaagcagaagttcgagagacccatctgcgtgagctggagcaccgacgtgaagggcggcagatggaccagcttcggctgcgtgatcctggaggccagcgagacctacaccatctgcagctgcaaccagatggccaacctggccgtgatcatggccagcggcgagctgaccatggacttcagcctgtacatcatcagccacgtgggcatcatcatcagcctggtgtgcctggtgctggccatcgccaccttcctgctgtgcagaagcatcagaaaccacaacacctacctgcacctgcacctgtgcgtgtgcctgctgctggccaagaccctgttcctggccggcatccacaagaccgacaacaagatgggctgcgccatcatcgccggcttcctgcactacctgttcctggcctgcttcttctggatgctggtggaggccgtgatcctgttcctgatggtgagaaacctgaaggtggtgaactacttcagcagcagaaacatcaagatgctgcacatctgcgccttcggctacggcctgcccatgctggtggtggtgatcagcgccagcgtgcagccccagggctacggcatgcacaacagatgctggctgaacaccgagaccggcttcatctggagcttcctgggccccgtgtgcaccgtgatcgtggtgagcaagtactacaacagcctggccaagtgcgtgctgaaggaggagcagggcgacctgagagacctggagttccccggcacctgcgccgccgagagaatcaacagcctgctgctgacctggaccctgtggatcctgagacagagactgagcagcgtgaacgccgaggtgagcaccctgaaggacaccagactgctgaccttcaaggccttcgcccagctgttcatcctgggctgcagctgggtgctgggcatcttccagatcggccccgtggccggcgtgatggcctacctgttcaccatcatcaacagcctgcagggcgccttcatcttcctgatccactgcctgctgaacggccaggtgagagaggagtacaagagatggatcaccggcaagaccaagcccagcagccagagccagaccagcagaatcctgctgagcagcatgcccagcgccagcaagaccggctag

SEQ ID NO: 80175 - DNA, 2238 bp, Artificial Sequence
  Description of Artificial Sequence: Synthetic coding sequence
atgagaggcttcaacctgctgctgttctggggctgctgcgtgatgcacagctgggagggccacatcagacccaccagaaagcccaacaccaagggcaacaactgcagagacagcaccctgtgccccgcctacgccacctgcaccaacaccgtggacagctactactgcgcctgcaagcagggcttcctgagcagcaacggccagaaccacttcaaggaccccggcgtgagatgcaaggacatcgacgagtgcaccgagatgtgccccatcaacagcacctgcaccaacacccccggcagctacttctgcacctgccaccccggcttcgcccccagcaacggccagctgaacttcaccgaccagggcgtggagtgcagagacatcgacgagtgcagacaggaccccagcacctgcggccccaacagcatctgcaccaacgccctgggcagctacagctgcggctgcatcgccggcttccaccccaaccccgagggcagccagaaggacggcaacttcagctgccagagagtgctgttcaagtgcaaggaggacgtgatccccgacaacaagcagatccagcagtgccaggagggcaccgccgtgaagcccgcctacgtgagcttctgcgcccagatcaacaacatcttcagcgtgctggacaaggtgtgcgagaacaagaccaccgtggtgagcctgaagaacaccaccgagagcttcgtgcccgtgctgaagcagatcagcacctggaccaagttcaccaaggaggagaccagcagcctggccaccgtgttcctggagagcgtggagagcatgaccctggccagcttctggaagcccagcgccaacatcacccccgccgtgagaaccgagtacctggacatcgagagcaaggtgatcaacaaggagtgcagcgaggagaacgtgaccctggacctggtggccaagggcgacaagatgaagatcggctgcagcaccatcgaggagagcgagagcaccgagaccaccggcgtggccttcgtgagcttcgtgggcatggagagcgtgctgaacgagagattcttcaaggaccaccaggcccccctgaccaccagcgagatcaagctgaagatgaacagcagagtggtgggcggcatcatgaccggcgagaagaaggacggcttcagcgaccccatcatctacaccctggagaacatccagcccaagcagaagttcgagagacccatctgcgtgagctggagcaccgacgtgaagggcggcagatggaccagcttcggctgcgtgatcctggaggccagcgagacctacaccatctgcagctgcaaccagatggccaacctggccgtgatcatggccagcggcgagctgaccatggacttcagcctgtacatcatcagccacgtgggcatcatcatcagcctggtgtgcctggtgctggccatcgccaccttcctgctgtgcagaagcatcagaaaccacaacacctacctgcacctgcacctgtgcgtgtgcctgctgctggccaagaccctgttcctggccggcatccacaagaccgacaacaagatgggctgcgccatcatcgccggcttcctgcactacctgttcctggcctgcttcttctggatgctggtggaggccgtgatcctgttcctgatggtgagaaacctgaaggtggtgaactacttcagcagcagaaacatcaagatgctgcacatctgcgccttcggctacggcctgcccatgctggtggtggtgatcagcgccagcgtgcagccccagggctacggcatgcacaacagatgctggctgaacaccgagaccggcttcatctggagcttcctgggccccgtgtgcaccgtgatcgtgatcaacagcctgctgctgacctggaccctgtggatcctgagacagagactgagcagcgtgaacgccgaggtgagcaccctgaaggacaccagactgctgaccttcaaggccttcgcccagctgttcatcctgggctgcagctgggtgctgggcatcttccagatcggccccgtggccggcgtgatggcctacctgttcaccatcatcaacagcctgcagggcgccttcatcttcctgatccactgcctgctgaacggccaggtgagagaggagtacaagagatggatcaccggcaagaccaagcccagcagccagagccagaccagcagaatcctgctgagcagcatgcccagcgccagcaagaccggctag

SEQ ID NO: 80176 - DNA, 2130 bp, Artificial Sequence
  Description of Artificial Sequence: Synthetic coding sequence
atgagaggcttcaacctgctgctgttctggggctgctgcgtgatgcacagctgggagggccacatcagacccaccagaaagcccaacaccaagggcaacaactgcagagacagcaccctgtgccccgcctacgccacctgcaccaacaccgtggacagctactactgcgcctgcaagcagggcttcctgagcagcaacggccagaaccacttcaaggaccccggcgtgagatgcaaggacatcgacgagtgcagccagagcccccagccctgcggccccaacagcagctgcaagaacctgagcggcagatacaagtgcagctgcctggacggcttcagcagccccaccggcaacgactgggtgcccggcaagcccggcaacttcagctgcaccgacatcaacgagtgcctgaccagcagagtgctgttcaagtgcaaggaggacgtgatccccgacaacaagcagatccagcagtgccaggagggcaccgccgtgaagcccgcctacgtgagcttctgcgcccagatcaacaacatcttcagcgtgctggacaaggtgtgcgagaacaagaccaccgtggtgagcctgaagaacaccaccgagagcttcgtgcccgtgctgaagcagatcagcacctggaccaagttcaccaaggaggagaccagcagcctggccaccgtgttcctggagagcgtggagagcatgaccctggccagcttctggaagcccagcgccaacatcacccccgccgtgagaaccgagtacctggacatcgagagcaaggtgatcaacaaggagtgcagcgaggagaacgtgaccctggacctggtggccaagggcgacaagatgaagatcggctgcagcaccatcgaggagagcgagagcaccgagaccaccggcgtggccttcgtgagcttcgtgggcatggagagcgtgctgaacgagagattcttcaaggaccaccaggcccccctgaccaccagcgagatcaagctgaagatgaacagcagagtggtgggcggcatcatgaccggcgagaagaaggacggcttcagcgaccccatcatctacaccctggagaacatccagcccaagcagaagttcgagagacccatctgcgtgagctggagcaccgacgtgaagggcggcagatggaccagcttcggctgcgtgatcctggaggccagcgagacctacaccatctgcagctgcaaccagatggccaacctggccgtgatcatggccagcggcgagctgaccatggacttcagcctgtacatcatcagccacgtgggcatcatcatcagcctggtgtgcctggtgctggccatcgccaccttcctgctgtgcagaagcatcagaaaccacaacacctacctgcacctgcacctgtgcgtgtgcctgctgctggccaagaccctgttcctggccggcatccacaagaccgacaacaagatgggctgcgccatcatcgccggcttcctgcactacctgttcctggcctgcttcttctggatgctggtggaggccgtgatcctgttcctgatggtgagaaacctgaaggtggtgaactacttcagcagcagaaacatcaagatgctgcacatctgcgccttcggctacggcctgcccatgctggtggtggtgatcagcgccagcgtgcagccccagggctacggcatgcacaacagatgctggctgaacaccgagaccggcttcatctggagcttcctgggccccgtgtgcaccgtgatcgtgatcaacagcctgctgctgacctggaccctgtggatcctgagacagagactgagcagcgtgaacgccgaggtgagcaccctgaaggacaccagactgctgaccttcaaggccttcgcccagctgttcatcctgggctgcagctgggtgctgggcatcttccagatcggccccgtggccggcgtgatggcctacctgttcaccatcatcaacagcctgcagggcgccttcatcttcctgatccactgcctgctgaacggccaggtgagagaggagtacaagagatggatcaccggcaagaccaagcccagcagccagagccagaccagcagaatcctgctgagcagcatgcccagcgccagcaagaccggctag

SEQ ID NO: 80177 - DNA, 2466 bp, Artificial Sequence; identical to SEQ ID NO: 80172
  Description of Artificial Sequence: Synthetic coding sequence

SEQ ID NO: 80178 - DNA, 1662 bp, Artificial Sequence
  Description of Artificial Sequence: Synthetic coding sequence
atgcccctgccctggagcctggccctgcccctgctgctgagctgggtggccggcggcttcggcaacgccgccagcgccagacaccacggcctgctggccagcgccagacagcccggcgtgtgccactacggcaccaagctggcctgctgctacggctggagaagaaacagcaagggcgtgtgcgaggccacctgcgagcccggctgcaagttcggcgagtgcgtgggccccaacaagtgcagatgcttccccggctacaccggcaagacctgcagccaggacgtgaacgagtgcggcatgaagcccagaccctgccagcacagatgcgtgaacacccacggcagctacaagtgcttctgcctgagcggccacatgctgatgcccgacgccacctgcgtgaacagcagaacctgcgccatgatcaactgccagtacagctgcgaggacaccgaggagggcccccagtgcctgtgccccagcagcggcctgagactggcccccaacggcagagactgcctggacatcgacgagtgcgccagcggcaaggtgatctgcccctacaacagaagatgcgtgaacaccttcggcagctactactgcaagtgccacatcggcttcgagctgcagtacatcagcggcagatacgactgcatcgacatcaacgagtgcaccatggacagccacacctgcagccaccacgccaactgcttcaacacccagggcagcttcaagtgcaagtgcaagcagggctacaagggcaacggcctgagatgcagcgccatccccgagaacagcgtgaaggaggtgctgagagcccccggcaccatcaaggacagaatcaagaagctgctggcccacaagaacagcatgaagaagaaggccaagatcaagaacgtgacccccgagcccaccagaacccccacccccaaggtgaacctgcagcccttcaactacgaggagatcgtgagcagaggcggcaacagccacggcggcaagaagggcaacgaggagaagatgaaggagggcctggaggacgagaagagagaggagaaggccctgaagaacgacatcgaggagagaagcctgagaggcgacgtgttcttccccaaggtgaacgaggccggcgagttcggcctgatcctggtgcagagaaaggccctgaccagcaagctggagcacaaggacctgaacatcagcgtggactgcagcttcaaccacggcatctgcgactggaagcaggacagagaggacgacttcgactggaaccccgccgacagagacaacgccatcggcttctacatggccgtgcccgccctggccggccacaagaaggacatcggcagactgaagctgctgctgcccgacctgcagccccagagcaacttctgcctgctgttcgactacagactggccggcgacaaggtgggcaagctgagagtgttcgtgaagaacagcaacaacgccctggcctgggagaagaccaccagcgaggacgagaagtggaagaccggcaagatccagctgtaccagggcaccgacgccaccaagagcatcatcttcgaggccgagagaggcaagggcaagaccggcgagatcgccgtggacggcgtgctgctggtgagcggcctgtgccccgacagcctgctgagcgtggacgactag

SEQ ID NO: 80179 - DNA, 1665 bp, Artificial Sequence
  Description of Artificial Sequence: Synthetic coding sequence
atgcccctgccctggagcctggccctgcccctgctgctgagctgggtggccggcggcttcggcaacgccgccagcgccagacaccacggcctgctggccagcgccagacagcccggcgtgtgccactacggcaccaagctggcctgctgctacggctggagaagaaacagcaagggcgtgtgcgaggccacctgcgagcccggctgcaagttcggcgagtgcgtgggccccaacaagtgcagatgcttccccggctacaccggcaagacctgcagccaggacgtgaacgagtgcggcatgaagcccagaccctgccagcacagatgcgtgaacacccacggcagctacaagtgcttctgcctgagcggccacatgctgatgcccgacgccacctgcgtgaacagcagaacctgcgccatgatcaactgccagtacagctgcgaggacaccgaggagggcccccagtgcctgtgccccagcagcggcctgagactggcccccaacggcagagactgcctggacatcgacgagtgcgccagcggcaaggtgatctgcccctacaacagaagatgcgtgaacaccttcggcagctactactgcaagtgccacatcggcttcgagctgcagtacatcagcggcagatacgactgcatcgacatcaacgagtgcaccatggacagccacacctgcagccaccacgccaactgcttcaacacccagggcagcttcaagtgcaagtgcaagcagggctacaagggcaacggcctgagatgcagcgccatccccgagaacagcgtgaaggaggtgctgagagcccccggcaccatcaaggacagaatcaagaagctgctggcccacaagaacagcatgaagaagaaggccaagatcaagaacgtgacccccgagcccaccagaacccccacccccaaggtgaacctgcagcccttcaactacgaggagatcgtgagcagaggcggcaacagccacggcggcaagaagggcaacgaggagaagatgaaggagggcctggaggacgagaagagagaggagaaggccctgaagaacgacatcgaggagagaagcctgagaggcgacgtgttcttccccaaggtgaacgaggccggcgagttcggcctgatcctggtgcagagaaaggccctgaccagcaagctggagcacaaggccgacctgaacatcagcgtggactgcagcttcaaccacggcatctgcgactggaagcaggacagagaggacgacttcgactggaaccccgccgacagagacaacgccatcggcttctacatggccgtgcccgccctggccggccacaagaaggacatcggcagactgaagctgctgctgcccgacctgcagccccagagcaacttctgcctgctgttcgactacagactggccggcgacaaggtgggcaagctgagagtgttcgtgaagaacagcaacaacgccctggcctgggagaagaccaccagcgaggacgagaagtggaagaccggcaagatccagctgtaccagggcaccgacgccaccaagagcatcatcttcgaggccgagagaggcaagggcaagaccggcgagatcgccgtggacggcgtgctgctggtgagcggcctgtgccccgacagcctgctgagcgtggacgactag

SEQ ID NO: 80180 - DNA, 822 bp, Artificial Sequence
  Description of Artificial Sequence: Synthetic coding sequence
atgagaggcagccaggaggtgctgctgatgtggctgctggtgctggccgtgggcggcaccgagcacgcctacagacccggcagaagagtgtgcgccgtgagagcccacggcgaccccgtgagcgagagcttcgtgcagagagtgtaccagcccttcctgaccacctgcgacggccacagagcctgcagcacctacagaaccatctacagaaccgcctacagaagaagccccggcctggcccccgccagacccagatacgcctgctgccccggctggaagagaaccagcggcctgcccggcgcctgcggcgccgccatctgccagcccccctgcagaaacggcggcagctgcgtgcagcccggcagatgcagatgccccgccggctggagaggcgacacctgccagagcgacgtggacgagtgcagcgccagaagaggcggctgcccccagagatgcgtgaacaccgccggcagctactggtgccagtgctgggagggccacagcctgagcgccgacggcaccctgtgcgtgcccaagggcggcccccccagagtggcccccaaccccaccggcgtggacagcgccatgaaggaggaggtgcagagactgcagagcagagtggacctgctggaggagaagctgcagctggtgctggcccccctgcacagcctggccagccaggccctggagcacggcctgcccgaccccggcagcctgctggtgcacagcttccagcagctgggcagaatcgacagcctgagcgagcagatcagcttcctggaggagcagctgggcagctgcagctgcaagaaggacagctag

SEQ ID NO: 80181 - DNA, 822 bp, Artificial Sequence; identical to SEQ ID NO: 80180
  Description of Artificial Sequence: Synthetic coding sequence

SEQ ID NO: 80182 - DNA, 822 bp, Artificial Sequence; identical to SEQ ID NO: 80180
  Description of Artificial Sequence: Synthetic coding sequence

SEQ ID NO: 80183 - DNA, 822 bp, Artificial Sequence; identical to SEQ ID NO: 80180
  Description of Artificial Sequence: Synthetic coding sequence

SEQ ID NO: 80184 - DNA, 882 bp, Artificial Sequence
  Description of Artificial Sequence: Synthetic coding sequence
atgggcagcagagccgagctgtgcaccctgctgggcggcttcagcttcctgctgctgctgatccccggcgagggcgccaagggcggcagcctgagagagagccagggcgtgtgcagcaagcagaccctggtggtgcccctgcactacaacgagagctacagccagcccgtgtacaagccctacctgaccctgtgcgccggcagaagaatctgcagcacctacagaaccatgtacagagtgatgtggagagaggtgagaagagaggtgcagcagacccacgccgtgtgctgccagggctggaagaagagacaccccggcgccctgacctgcgaggccatctgcgccaagccctgcctgaacggcggcgtgtgcgtgagacccgaccagtgcgagtgcgcccccggctggggcggcaagcactgccacgtggacgtggacgagtgcagaaccagcatcaccctgtgcagccaccactgcttcaacaccgccggcagcttcacctgcggctgcccccacgacctggtgctgggcgtggacggcagaacctgcatggagggcagccccgagccccccaccagcgccagcatcctgagcgtggccgtgagagaggccgagaaggacgagagagccctgaagcaggagatccacgagctgagaggcagactggagagactggagcagtgggccggccaggccggcgcctgggtgagagccgtgctgcccgtgccccccgaggagctgcagcccgagcaggtggccgagctgtggggcagaggcgacagaatcgagagcctgagcgaccaggtgctgctgctggaggagagactgggcgcctgcagctgcgaggacaacagcctgggcctgggcgtgaaccacagatag

SEQ ID NO: 80185 - DNA, 882 bp, Artificial Sequence; identical to SEQ ID NO: 80184
  Description of Artificial Sequence: Synthetic coding sequence

SEQ ID NO: 80186 - DNA, 882 bp, Artificial Sequence
  Description of Artificial Sequence: Synthetic coding sequence
atgggcagcagagccgagctgtgcaccctgctgggcggcttcagcttcctgctgctgctgatccccggcgagggcgccaagggcggcagcctgagagagagccagggcgtgtgcagcaagcagaccctggtggtgcccctgcactacaacgagagctacagccagcccgtgtacaagccctacctgaccctgtgcgccggcagaagaatctgcagcacctacagaaccatgtacagagtgatgtggagagaggtgaagagagaggtgcagcagacccacgccgtgtgctgccagggctggaagaagagacaccccggcgccctgacctgcgaggccatctgcgccaagccctgcctgaacggcggcgtgtgcgtgagacccgaccagtgcgagtgcgcccccggctggggcggcaagcactgccacgtggacgtggacgagtgcagaaccagcatcaccctgtgcagccaccactgcttcaacaccgccggcagcttcacctgcggctgcccccacgacctggtgctgggcgtggacggcagaacctgcatggagggcagccccgagccccccaccagcgccagcatcctgagcgtggccgtgagagaggccgagaaggacgagagagccctgaagcaggagatccacgagctgagaggcagactggagagactggagcagtgggccggccaggccggcgcctgggtgagagccgtgctgcccgtgccccccgaggagctgcagcccgagcaggtggccgagctgtggggcagaggcgacagaatcgagagcctgagcgaccaggtgctgctgctggaggagagactgggcgcctgcagctgcgaggacaacagcctgggcctgggcgtgaaccacagatag

SEQ ID NO: 80187 - DNA, 777 bp, Artificial Sequence
  Description of Artificial Sequence: Synthetic coding sequence
atgggcagcagagccgagctgtgcaccctgctgggcggcttcagcttcctgctgctgctgatccccggcgagggcgccaagggcggcagcctgagagagagccagggcgtgtgcagcaagcagaccctggtggtgcccctgcactacaacgagagctacagccagcccgtgtacaagccctacctgaccctgtgcgccggcagaagaatctgcagcacctacagaaccatgtacagagtgatgtggagagaggtgagaagagaggtgcagcagacccacgccgtgtgctgccagggctggaagaagagacaccccggcgccctgacctgcgaggccatctgcgccaagccctgcctgaacggcggcgtgtgcgtgagacccgaccagtgcgagtgcgcccccggctggggcggcaagcactgccacgtgggcagcttcacctgcggctgcccccacgacctggtgctgggcgtggacggcagaacctgcatggagggcagccccgagccccccaccagcgccagcatcctgagcgtggccgtgagagaggccgagaaggacgagagagccctgaagcaggagatccacgagctgagaggcagactggagagactggagcagtgggccggccaggccggcgcctgggtgagagccgtgctgcccgtgccccccgaggagctgcagcccgagcaggtggccgagctgtggggcagaggcgacagaatcgagagcctgagcgaccaggtgctgctgctggaggagagactgggcgcctag

SEQ ID NO: 80188 - DNA, 882 bp, Artificial Sequence; identical to SEQ ID NO: 80184
  Description of Artificial Sequence: Synthetic coding sequence

SEQ ID NO: 80189 - DNA, 882 bp, Artificial Sequence; identical to SEQ ID NO: 80184
  Description of Artificial Sequence: Synthetic coding sequence

SEQ ID NO: 80190 - DNA, 882 bp, Artificial Sequence; identical to SEQ ID NO: 80184
  Description of Artificial Sequence: Synthetic coding sequence

SEQ ID NO: 80191 - DNA, 777 bp, Artificial Sequence; identical to SEQ ID NO: 80187
  Description of Artificial Sequence: Synthetic coding sequence

SEQ ID NO: 80192 - DNA, 777 bp, Artificial Sequence; identical to SEQ ID NO: 80187
  Description of Artificial Sequence: Synthetic coding sequence

SEQ ID NO: 80193 - DNA, 777 bp, Artificial Sequence
  Description of Artificial Sequence: Synthetic coding sequence
atgggcagcagagccgagctgtgcaccctgctgggcggcttcagcttcctgctgctgctgatccccggcgagggcgccaagggcggcagcctgagagagagccagggcgtgtgcagcaagcagaccctggtggtgcccctgcactacaacgagagctacagccagcccgtgtacaagccctacctgaccctgtgcgccggcagaagaatctgcagcacctacagaaccatgtacagagtgatgtggagagaggtgaagagagaggtgcagcagacccacgccgtgtgctgccagggctggaagaagagacaccccggcgccctgacctgcgaggccatctgcgccaagccctgcctgaacggcggcgtgtgcgtgagacccgaccagtgcgagtgcgcccccggctggggcggcaagcactgccacgtgggcagcttcacctgcggctgcccccacgacctggtgctgggcgtggacggcagaacctgcatggagggcagccccgagccccccaccagcgccagcatcctgagcgtggccgtgagagaggccgagaaggacgagagagccctgaagcaggagatccacgagctgagaggcagactggagagactggagcagtgggccggccaggccggcgcctgggtgagagccgtgctgcccgtgccccccgaggagctgcagcccgagcaggtggccgagctgtggggcagaggcgacagaatcgagagcctgagcgaccaggtgctgctgctggaggagagactgggcgcctag

SEQ ID NO: 80194 - DNA, 882 bp, Artificial Sequence; identical to SEQ ID NO: 80184
  Description of Artificial Sequence: Synthetic coding sequence

SEQ ID NO: 80195 - DNA, 882 bp, Artificial Sequence; identical to SEQ ID NO: 80184
  Description of Artificial Sequence: Synthetic coding sequence

SEQ ID NO: 80196 - DNA, 882 bp, Artificial Sequence; identical to SEQ ID NO: 80184
  Description of Artificial Sequence: Synthetic coding sequence

SEQ ID NO: 80197 - DNA, 882 bp, Artificial Sequence; identical to SEQ ID NO: 80186
  Description of Artificial Sequence: Synthetic coding sequence

SEQ ID NO: 80198 - DNA, 882 bp, Artificial Sequence; identical to SEQ ID NO: 80184
  Description of Artificial Sequence: Synthetic coding sequence

SEQ ID NO: 80199 - DNA, 882 bp, Artificial Sequence; identical to SEQ ID NO: 80184
  Description of Artificial Sequence: Synthetic coding sequence

SEQ ID NO: 80200 - DNA, 882 bp, Artificial Sequence; identical to SEQ ID NO: 80184
  Description of Artificial Sequence: Synthetic coding sequence

SEQ ID NO: 80201 - DNA, 777 bp, Artificial Sequence; identical to SEQ ID NO: 80187
  Description of Artificial Sequence: Synthetic coding sequence

SEQ ID NO: 80202 - DNA, 882 bp, Artificial Sequence; identical to SEQ ID NO: 80184
  Description of Artificial Sequence: Synthetic coding sequence

SEQ ID NO: 80203 - DNA, 1281 bp, Artificial Sequence
  Description of Artificial Sequence: Synthetic coding sequence
atggccaacgacagcggcggccccggcggccccagccccagcgagagagacagacagtactgcgagctgtgcggcaagatggagaacctgctgagatgcagcagatgcagaagcagcttctactgctgcaaggagcaccagagacaggactggaagaagcacaagctggtgtgccagggcagcgagggcgccctgggccacggcgtgggcccccaccagcacagcggccccgccccccccgccgccgtgcccccccccagagccggcgccagagagcccagaaaggccgccgccagaagagacaacgccagcggcgacgccgccaagggcaaggtgaaggccaagccccccgccgaccccgccgccgccgccagcccctgcagagccgccgccggcggccagggcagcgccgtggccgccgaggccgagcccggcaaggaggagccccccgccagaagcagcctgttccaggagaaggccaacctgtacccccccagcaacacccccggcgacgccctgagccccggcggcggcctgagacccaacggccagaccaagcccctgcccgccctgaagctggccctggagtacatcgtgccctgcatgaacaagcacggcatctgcgtggtggacgacttcctgggcaaggagaccggccagcagatcggcgacgaggtgagagccctgcacgacaccggcaagttcaccgacggccagctggtgagccagaagagcgacagcagcaaggacatcagaggcgacaagatcacctggatcgagggcaaggagcccggctgcgagaccatcggcctgctgatgagcagcatggacgacctgatcagacactgcaacggcaagctgggcagctacaagatcaacggcagaaccaaggccatggtggcctgctaccccggcaacggcaccggctacgtgagacacgtggacaaccccaacggcgacggcagatgcgtgacctgcatctactacctgaacaaggactgggacgccaaggtgagcggcggcatcctgagaatcttccccgagggcaaggcccagttcgccgacatcgagcccaagttcgacagactgctgttcttctggagcgacagaagaaacccccacgaggtgcagcccgcctacgccaccagatacgccatcaccgtgtggtacttcgacgccgacgagagagccagagccaaggtgaagtacctgaccggcgagaagggcgtgagagtggagctgaacaagcccagcgacagcgtgggcaaggacgtgttctag

SEQ ID NO: 80204 - DNA, 216 bp, Artificial Sequence
  Description of Artificial Sequence: Synthetic coding sequence
atgaacaagcacggcatctgcgtggtggacgacttcctgggcaaggagaccggccagcagatcggcgacgaggtgagagccctgcacgacaccggcaagttcaccgacggcagctggagcgccagaagagtgaccagacccagaaccagcgaggccatcagaagccccggcagcagagccagaagccccgccgccaagcccctgggctgcagctag

SEQ ID NO: 80205 - DNA, 1224 bp, Artificial Sequence
  Description of Artificial Sequence: Synthetic coding sequence
atggacagcccctgccagccccagcccctgagccaggccctgccccagctgcccggcagcagcagcgagcccctggagcccgagcccggcagagccagaatgggcgtggagagctacctgccctgccccctgctgcccagctaccactgccccggcgtgcccagcgaggccagcgccggcagcggcacccccagagccaccgccaccagcaccaccgccagccccctgagagacggcttcggcggccaggacggcggcgagctgagacccctgcagagcgagggcgccgccgccctggtgaccaagggctgccagagactggccgcccagggcgccagacccgaggcccccaagagaaagtgggccgaggacggcggcgacgcccccagccccagcaagagaccctgggccagacaggagaaccaggaggccgagagagagggcggcatgagctgcagctgcagcagcggcagcggcgaggccagcgccggcctgatggaggaggccctgcccagcgcccccgagagactggccctggactacatcgtgccctgcatgagatactacggcatctgcgtgaaggacagcttcctgggcgccgccctgggcggcagagtgctggccgaggtggaggccctgaagagaggcggcagactgagagacggccagctggtgagccagagagccatcccccccagaagcatcagaggcgaccagatcgcctgggtggagggccacgagcccggctgcagaagcatcggcgccctgatggcccacgtggacgccgtgatcagacactgcgccggcagactgggcagctacgtgatcaacggcagaaccaaggccatggtggcctgctaccccggcaacggcctgggctacgtgagacacgtggacaacccccacggcgacggcagatgcatcacctgcatctactacctgaaccagaactgggacgtgaaggtgcacggcggcctgctgcagatcttccccgagggcagacccgtggtggccaacatcgagcccctgttcgacagactgctgatcttctggagcgacagaagaaacccccacgaggtgaagcccgcctacgccaccagatacgccatcaccgtgtggtacttcgacgccaaggagagagccgccgccaaggacaagtaccagctggccagcggccagaagggcgtgcaggtgcccgtgagccagccccccacccccacctag

SEQ ID NO: 80206 - DNA, 1224 bp, Artificial Sequence; identical to SEQ ID NO: 80205
  Description of Artificial Sequence: Synthetic coding sequence

SEQ ID NO: 80207 - DNA, 720 bp, Artificial Sequence
  Description of Artificial Sequence: Synthetic coding sequence
atgcccctgggccacatcatgagactggacctggagaagatcgccctggagtacatcgtgccctgcctgcacgaggtgggcttctgctacctggacaacttcctgggcgaggtggtgggcgactgcgtgctggagagagtgaagcagctgcactgcaccggcgccctgagagacggccagctggccggccccagagccggcgtgagcaagagacacctgagaggcgaccagatcacctggatcggcggcaacgaggagggctgcgaggccatcagcttcctgctgagcctgatcgacagactggtgctgtactgcggcagcagactgggcaagtactacgtgaaggagagaagcaaggccatggtggcctgctaccccggcaacggcaccggctacgtgagacacgtggacaaccccaacggcgacggcagatgcatcacctgcatctactacctgaacaagaactgggacgccaagctgcacggcggcatcctgagaatcttccccgagggcaagagcttcatcgccgacgtggagcccatcttcgacagactgctgttcttctggagcgacagaagaaacccccacgaggtgcagcccagctacgccaccagatacgccatgaccgtgtggtacttcgacgccgaggagagagccgaggccaagaagaagttcagaaacctgaccagaaagaccgagagcgccctgaccgaggactag

SEQ ID NO: 80208 - DNA, 720 bp, Artificial Sequence; identical to SEQ ID NO: 80207
  Description of Artificial Sequence: Synthetic coding sequence

SEQ ID NO: 80209 - DNA, 1605 bp, Artificial Sequence
  Description of Artificial Sequence: Synthetic coding sequence
atgttcagctgggtgagcaaggacgccagaagaaagaaggagcccgagctgttccagaccgtggccgagggcctgagacagctgtacgcccagaagctgctgcccctggaggagcactacagattccacgagttccacagccccgccctggaggacgccgacttcgacaacaagcccatggtgctgctggtgggccagtacagcaccggcaagaccaccttcatcagacacctgatcgagcaggacttccccggcatgagaatcggccccgagcccaccaccgacagcttcatcgccgtgatgcacggccccaccgagggcgtggtgcccggcaacgccctggtggtggaccccagaagacccttcagaaagctgaacgccttcggcaacgccttcctgaacagattcatgtgcgcccagctgcccaaccccgtgctggacagcatcagcatcatcgacacccccggcatcctgagcggcgagaagcagagaatcagcagaggctacgacttcgccgccgtgctggagtggttcgccgagagagtggacagaatcatcctgctgttcgacgcccacaagctggacatcagcgacgagttcagcgaggtgatcaaggccctgaagaaccacgaggacaagatcagagtggtgctgaacaaggccgaccagatcgagacccagcagctgatgagagtgtacggcgccctgatgtggagcctgggcaagatcatcaacacccccgaggtggtgagagtgtacatcggcagcttctggagccaccccctgctgatccccgacaacagaaagctgttcgaggccgaggagcaggacctgttcaaggacatccagagcctgcccagaaacgccgccctgagaaagctgaacgacctgatcaagagagccagactggccaaggtgcacgcctacatcatcagcagcctgaagaaggagatgcccaacgtgttcggcaaggagagcaagaagaaggagctggtgaacaacctgggcgagatctaccagaagatcgagagagagcaccagatcagccccggcgacttccccagcctgagaaagatgcaggagctgctgcagacccaggacttcagcaagttccaggccctgaagcccaagctgctggacaccgtggacgacatgctggccaacgacatcgccagactgatggtgatggtgagacaggaggagagcctgatgcccagccaggtggtgaagggcggcgccttcgacggcaccatgaacggccccttcggccacggctacggcgagggcgccggcgagggcatcgacgacgtggagtgggtggtgggcaaggacaagcccacctacgacgagatcttctacaccctgagccccgtgaacggcaagatcaccggcgccaacgccaagaaggagatggtgaagagcaagctgcccaacaccgtgctgggcaagatctggaagctggccgacgtggacaaggacggcctgctggacgacgaggagttcgccctggccaaccacctgatcaaggtgaagctggagggccacgagctgcccgccgacctgcccccccacctggtgccccccagcaagagaagacacgagtag

SEQ ID NO: 80210 - DNA, 1605 bp, Artificial Sequence; identical to SEQ ID NO: 80209
  Description of Artificial Sequence: Synthetic coding sequence

SEQ ID NO: 80211 - DNA, 438 bp, Artificial Sequence
  Description of Artificial Sequence: Synthetic coding sequence
atgttcagctgggtgagcaaggacgccagaagaaagaaggagcccgagctgttccagaccgtggccgagggcctgagacagctgtacgcccagaagctgctgcccctggaggagcactacagattccacgagttccacagccccgccctggaggacgccgacttcgacaacaagcccatggtgctgctggtgggccagtacagcaccggcaagaccaccttcatcagacacctgatcgagcaggacttccccggcatgagaatcggccccgagcccaccaccgacagcttcatcgccgtgatgcacggccccaccgagggcgtggtgcccggcaacgccctggtggtggaccccagaagacccttcagaaagctgaacgccttcggcaacgccttcctgaacagattcatgtgcgcccagctgcccaaccccgtgtag

SEQ ID NO: 80212 - DNA, 1296 bp, Artificial Sequence
  Description of Artificial Sequence: Synthetic coding sequence
atggagcagcccggcaccgccgccagccccgtgagcggcagcatgttcagctgggtgagcaaggacgccagaagaaagaaggagcccgagctgttccagaccgtggccgagggcctgagacagctgtacgcccagaagctgctgcccctggaggagcactacagattccacgagttccacagccccgccctggaggacgccgacttcgacaacaagcccatggtgctgctggtgggccagtacagcaccggcaagaccaccttcatcagacacctgatcgagcaggacttccccggcatgagaatcggccccgagcccaccaccgacagcttcatcgccgtgatgcacggccccaccgagggcgtggtgcccggcaacgccctggtggtggaccccagaagacccttcagaaagctgaacgccttcggcaacgccttcctgaacagattcatgtgcgcccagctgcccaaccccgtgctggacagcatcagcatcatcgacacccccggcatcctgagcggcgagaagcagagaatcagcagaggctacgacttcgccgccgtgctggagtggttcgccgagagagtggacagaatcatcctgctgttcgacgcccacaagctggacatcagcgacgagttcagcgaggtgatcaaggccctgaagaaccacgaggacaagatcagagtggtgctgaacaaggccgaccagatcgagacccagcagctgatgagagtgtacggcgccctgatgtggagcctgggcaagatcatcaacacccccgaggtggtgagagtgtacatcggcagcttctggagccaccccctgctgatccccgacaacagaaagctgttcgaggccgaggagcaggacctgttcaaggacatccagagcctgcccagaaacgccgccctgagaaagctgaacgacctgatcaagagagccagactggccaaggtgcacgcctacatcatcagcagcctgaagaaggagatgcccaacgtgttcggcaaggagagcaagaagaaggagctggtgaacaacctgggcgagatctaccagaagatcgagagagagcaccagatcagccccggcgacttccccagcctgagaaagatgcaggagctgctgcagacccaggacttcagcaagttccaggccctgaagcccaagctgctggacgacgaggagttcgccctggccaaccacctgatcaaggtgaagctggagggccacgagctgcccgccgacctgcccccccacctggtgccccccagcaagagaagacacgagtag

SEQ ID NO: 80213 - DNA, 447 bp, Artificial Sequence
  Description of Artificial Sequence: Synthetic coding sequence
atgttcagctgggtgagcaaggacgccagaagaaagaaggagcccgagctgttccagaccgtggccgagggcctgagacagctgtacgcccagaagctgctgcccctggaggagcactacagattccacgagttccacagccccgccctggaggacgccgacttcgacaacaagcccatggtgctgctggtgggccagtacagcaccggcaagaccaccttcatcagacacctgatcgagcaggacttccccggcatgagaatcggccccgagcccaccaccgacagcttcatcgccgtgatgcacggccccaccgagggcgtggtgcccggcaacgccctggtggtggaccccagaagacccttcagaaagctgaacgccttcggcaacgccttcctgaacagattcatgtgcgcccagctgcccaaccccgtgctggacagctag

SEQ ID NO: 80214 - DNA, 1533 bp, Artificial Sequence
  Description of Artificial Sequence: Synthetic coding sequence
atgttcagctgggtgagcaaggacgccagaagaaagaaggagcactacagattccacgagttccacagccccgccctggaggacgccgacttcgacaacaagcccatggtgctgctggtgggccagtacagcaccggcaagaccaccttcatcagacacctgatcgagcaggacttccccggcatgagaatcggccccgagcccaccaccgacagcttcatcgccgtgatgcacggccccaccgagggcgtggtgcccggcaacgccctggtggtggaccccagaagacccttcagaaagctgaacgccttcggcaacgccttcctgaacagattcatgtgcgcccagctgcccaaccccgtgctggacagcatcagcatcatcgacacccccggcatcctgagcggcgagaagcagagaatcagcagaggctacgacttcgccgccgtgctggagtggttcgccgagagagtggacagaatcatcctgctgttcgacgcccacaagctggacatcagcgacgagttcagcgaggtgatcaaggccctgaagaaccacgaggacaagatcagagtggtgctgaacaaggccgaccagatcgagacccagcagctgatgagagtgtacggcgccctgatgtggagcctgggcaagatcatcaacacccccgaggtggtgagagtgtacatcggcagcttctggagccaccccctgctgatccccgacaacagaaagctgttcgaggccgaggagcaggacctgttcaaggacatccagagcctgcccagaaacgccgccctgagaaagctgaacgacctgatcaagagagccagactggccaaggtgcacgcctacatcatcagcagcctgaagaaggagatgcccaacgtgttcggcaaggagagcaagaagaaggagctggtgaacaacctgggcgagatctaccagaagatcgagagagagcaccagatcagccccggcgacttccccagcctgagaaagatgcaggagctgctgcagacccaggacttcagcaagttccaggccctgaagcccaagctgctggacaccgtggacgacatgctggccaacgacatcgccagactgatggtgatggtgagacaggaggagagcctgatgcccagccaggtggtgaagggcggcgccttcgacggcaccatgaacggccccttcggccacggctacggcgagggcgccggcgagggcatcgacgacgtggagtgggtggtgggcaaggacaagcccacctacgacgagatcttctacaccctgagccccgtgaacggcaagatcaccggcgccaacgccaagaaggagatggtgaagagcaagctgcccaacaccgtgctgggcaagatctggaagctggccgacgtggacaaggacggcctgctggacgacgaggagttcgccctggccaaccacctgatcaaggtgaagctggagggccacgagctgcccgccgacctgcccccccacctggtgccccccagcaagagaagacacgagtag

SEQ ID NO: 80215 - DNA, 1632 bp, Artificial Sequence
  Description of Artificial Sequence: Synthetic coding sequence
atgttcagctggctgaagagaggcggcgccagaggccagcagcccgaggccatcagaaccgtgaccagcgccctgaaggagctgtacagaaccaagctgctgcccctggaggagcactacagattcggcgccttccacagccccgccctggaggacgccgacttcgacggcaagcccatggtgctggtggccggccagtacagcaccggcaagaccagcttcatccagtacctgctggagcaggaggtgcccggcagcagagtgggccccgagcccaccaccgactgcttcgtggccgtgatgcacggcgacaccgagggcaccgtgcccggcaacgccctggtggtggaccccgacaagcccttcagaaagctgaaccccttcggcaacaccttcctgaacagattcatgtgcgcccagctgcccaaccaggtgctggagagcatcagcatcatcgacacccccggcatcctgagcggcgccaagcagagagtgagcagaggctacgacttccccgccgtgctgagatggttcgccgagagagtggacctgatcatcctgctgttcgacgcccacaagctggagatcagcgacgagttcagcgaggccatcggcgccctgagaggccacgaggacaagatcagagtggtgctgaacaaggccgacatggtggagacccagcagctgatgagagtgtacggcgccctgatgtgggccctgggcaaggtggtgggcacccccgaggtgctgagagtgtacatcggcagcttctggagccagcccctgctggtgcccgacaacagaagactgttcgagctggaggagcaggacctgttcagagacatccagggcctgcccagacacgccgccctgagaaagctgaacgacctggtgaagagagccagactggtgagagtgcacgcctacatcatcagctacctgaagaaggagatgcccagcgtgttcggcaaggagaacaagaagaagcagctgatcctgaagctgcccgtgatcttcgccaagatccagctggagcaccacatcagccccggcgacttccccgactgccagaagatgcaggagctgctgatggcccacgacttcaccaagttccacagcctgaagcccaagctgctggaggccctggacgagatgctgacccacgacatcgccaagctgatgcccctgctgagacaggaggagctggagagcaccgaggtgggcgtgcagggcggcgccttcgagggcacccacatgggccccttcgtggagagaggccccgacgaggccatggaggacggcgaggagggcagcgacgacgaggccgagtgggtggtgaccaaggacaagagcaagtacgacgagatcttctacaacctggcccccgccgacggcaagctgagcggcagcaaggccaagacctggatggtgggcaccaagctgcccaacagcgtgctgggcagaatctggaagctgagcgacgtggacagagacggcatgctggacgacgaggagttcgccctggccagccacctgatcgaggccaagctggagggccacggcctgcccgccaacctgcccagaagactggtgccccccagcaagagaagacacaagggcagcgccgagtag

SEQ ID NO: 80216 - DNA, 516 bp, Artificial Sequence
  Description of Artificial Sequence: Synthetic coding sequence
atgcccagcgtgttcggcaaggagaacaagaagaagcagctgatcctgaagctgcccgtgatcttcgccaagatccagctggagcaccacatcagccccggcgacttccccgactgccagaagatgcaggagctgctgatggcccacgacttcaccaagttccacagcctgaagcccaagctgctggaggccctggacgagatgctgacccacgacatcgccaagctgatgcccctgctgagacaggaggagctggagagcaccgaggtgggcgtgcagggcggcgccttcgagggcacccacatgggccccttcgtggagagaggccccgacgaggccatggaggaccagggccaggtgcagatcagaagagacctgctgcagcccggcgcctgcagaagacaggccgagagactgcagggccaggacctggacggcggcgaccaggccccccagctgagcgccggcgcccacctggaggcccagagatgcggccccagaagacacgccggctag

SEQ ID NO: 80217 - DNA, 1224 bp, Artificial Sequence
  Description of Artificial Sequence: Synthetic coding sequence
atgtgcgcccagctgcccaaccaggtgctggagagcatcagcatcatcgacacccccggcatcctgagcggcgccaagcagagagtgagcagaggctacgacttccccgccgtgctgagatggttcgccgagagagtggacctgatcatcctgctgttcgacgcccacaagctggagatcagcgacgagttcagcgaggccatcggcgccctgagaggccacgaggacaagatcagagtggtgctgaacaaggccgacatggtggagacccagcagctgatgagagtgtacggcgccctgatgtgggccctgggcaaggtggtgggcacccccgaggtgctgagagtgtacatcggcagcttctggagccagcccctgctggtgcccgacaacagaagactgttcgagctggaggagcaggacctgttcagagacatccagggcctgcccagacacgccgccctgagaaagctgaacgacctggtgaagagagccagactggtgagagtgcacgcctacatcatcagctacctgaagaaggagatgcccagcgtgttcggcaaggagaacaagaagaagcagctgatcctgaagctgcccgtgatcttcgccaagatccagctggagcaccacatcagccccggcgacttccccgactgccagaagatgcaggagctgctgatggcccacgacttcaccaagttccacagcctgaagcccaagctgctggaggccctggacgagatgctgacccacgacatcgccaagctgatgcccctgctgagacaggaggagctggagagcaccgaggtgggcgtgcagggcggcgccttcgagggcacccacatgggccccttcgtggagagaggccccgacgaggccatggaggacggcgaggagggcagcgacgacgaggccgagtgggtggtgaccaaggacaagagcaagtacgacgagatcttctacaacctggcccccgccgacggcaagctgagcggcagcaaggccaagacctggatggtgggcaccaagctgcccaacagcgtgctgggcagaatctggaagctgagcgacgtggacagagacggcatgctggacgacgaggagttcgccctggccagccacctgatcgaggccaagctggagggccacggcctgcccgccaacctgcccagaagactggtgccccccagcaagagaagacacaagggcagcgccgagtag

SEQ ID NO: 80218 - DNA, 1242 bp, Artificial Sequence
  Description of Artificial Sequence: Synthetic coding sequence
atgttcagctggctgaagagaggcggcgccagaggccagcagcccgaggccatcagaaccgtgaccagcgccctgaaggagctgtacagaaccaagctgctgcccctggaggagcactacagattcggcgccttccacagccccgccctggaggacgccgacttcgacggcaagcccatggtgctggtggccggccagtacagcaccggcaagaccagcttcatccagtacctgctggagcaggaggtgcccggcagcagagtgggccccgagcccaccaccgactgcttcgtggccgtgatgcacggcgacaccgagggcaccgtgcccggcaacgccctggtggtggaccccgacaagcccttcagaaagctgaaccccttcggcaacaccttcctgaacagattcatgtgcgcccagctgcccaaccaggtgctggagagcatcagcatcatcgacacccccggcatcctgagcggcgccaagcagagagtgagcagaggctacgacttccccgccgtgctgagatggttcgccgagagagtggacctgatcatcctgctgttcgacgcccacaagctggagatcagcgacgagttcagcgaggccatcggcgccctgagaggccacgaggacaagatcagagtggtgctgaacaaggccgacatggtggagacccagcagctgatgagagtgtacggcgccctgatgtgggccctgggcaaggtggtgggcacccccgaggtgctgagagtgtacatcggcagcttctggagccagcccctgctggtgcccgacaacagaagactgttcgagctggaggagcaggacctgttcagagacatccagggcctgcccagacacgccgccctgagaaagctgaacgacctggtgaagagagccagactggtgagagtgcacgcctacatcatcagctacctgaagaaggagatgcccagcgtgttcggcaaggagaacaagaagaagcagctgatcctgaagctgcccgtgatcttcgccaagatccagctggagcaccacatcagccccggcgacttccccgactgccagaagatgcaggagctgctgatggcccacgacttcaccaagttccacagcctgaagcccaagctgctggaggccctggacgagatgctgacccacgacatcgccaagctgatgcccctgctgagacaggaggagctggagagcagccccgtggccgagatgaccagcagatag

SEQ ID NO: 80219 - DNA, 1602 bp, Artificial Sequence
  Description of Artificial Sequence: Synthetic coding sequence
atgttcagctggctgaagagaggcggcgccagaggccagcagcccgaggccatcagaaccgtgaccagcgccctgaaggagctgtacagaaccaagctgctgcccctggaggagcactacagattcggcgccttccacagccccgccctggaggacgccgacttcgacggcaagcccatggtgctggtggccggccagtacagcaccggcaagaccagcttcatccagtacctgctggagcaggaggtgcccggcagcagagtggccgtgatgcacggcgacaccgagggcaccgtgcccggcaacgccctggtggtggaccccgacaagcccttcagaaagctgaaccccttcggcaacaccttcctgaacagattcatgtgcgcccagctgcccaaccaggtgctggagagcatcagcatcatcgacacccccggcatcctgagcggcgccaagcagagagtgagcagaggctacgacttccccgccgtgctgagatggttcgccgagagagtggacctgatcatcctgctgttcgacgcccacaagctggagatcagcgacgagttcagcgaggccatcggcgccctgagaggccacgaggacaagatcagagtggtgctgaacaaggccgacatggtggagacccagcagctgatgagagtgtacggcgccctgatgtgggccctgggcaaggtggtgggcacccccgaggtgctgagagtgtacatcggcagcttctggagccagcccctgctggtgcccgacaacagaagactgttcgagctggaggagcaggacctgttcagagacatccagggcctgcccagacacgccgccctgagaaagctgaacgacctggtgaagagagccagactggtgagagtgcacgcctacatcatcagctacctgaagaaggagatgcccagcgtgttcggcaaggagaacaagaagaagcagctgatcctgaagctgcccgtgatcttcgccaagatccagctggagcaccacatcagccccggcgacttccccgactgccagaagatgcaggagctgctgatggcccacgacttcaccaagttccacagcctgaagcccaagctgctggaggccctggacgagatgctgacccacgacatcgccaagctgatgcccctgctgagacaggaggagctggagagcaccgaggtgggcgtgcagggcggcgccttcgagggcacccacatgggccccttcgtggagagaggccccgacgaggccatggaggacggcgaggagggcagcgacgacgaggccgagtgggtggtgaccaaggacaagagcaagtacgacgagatcttctacaacctggcccccgccgacggcaagctgagcggcagcaaggccaagacctggatggtgggcaccaagctgcccaacagcgtgctgggcagaatctggaagctgagcgacgtggacagagacggcatgctggacgacgaggagttcgccctggccagccacctgatcgaggccaagctggagggccacggcctgcccgccaacctgcccagaagactggtgccccccagcaagagaagacacaagggcagcgccgagtag

SEQ ID NO: 80220 - DNA, 681 bp, Artificial Sequence
  Description of Artificial Sequence: Synthetic coding sequence
atgcccagcgtgttcggcaaggagaacaagaagaagcagctgatcctgaagctgcccgtgatcttcgccaagatccagctggagcaccacatcagccccggcgacttccccgactgccagaagatgcaggagctgctgatggcccacgacttcaccaagttccacagcctgaagcccaagctgctggaggccctggacgagatgctgacccacgacatcgccaagctgatgcccctgctgagacaggaggagctggagagcaccgaggtgggcgtgcagggcggcgccttcgagggcacccacatgggccccttcgtggagagaggccccgacgaggccatggaggacggcgaggagggcagcgacgacgaggccgagtgggtggtgaccaaggacaagagcaagtacgacgagatcttctacaacctggcccccgccgacggcaagctgagcggcagcaaggccaagacctggatggtgggcaccaagctgcccaacagcgtgctgggcagaatctggaagctgagcgacgtggacagagacggcatgctggacgacgaggagttcgccctggccagccacctgatcgaggccaagctggagggccacggcctgcccgccaacctgcccagaagactggtgccccccagcaagagaagacacaagggcagcgccgagtag

SEQ ID NO: 80221 - DNA, 1608 bp, Artificial Sequence
  Description of Artificial Sequence: Synthetic coding sequence
atgttcagctggctgggcaccgacgacagaagaagaaaggaccccgaggtgttccagaccgtgagcgagggcctgaagaagctgtacaagagcaagctgctgcccctggaggagcactacagattccacgagttccacagccccgccctggaggacgccgacttcgacaacaagcccatggtgctgctggtgggccagtacagcaccggcaagaccaccttcatcagatacctgctggagcaggacttccccggcatgagaatcggccccgagcccaccaccgacagcttcatcgccgtgatgcagggcgacatggagggcatcatccccggcaacgccctggtggtggaccccaagaagcccttcagaaagctgaacgccttcggcaacgccttcctgaacagattcgtgtgcgcccagctgcccaaccccgtgctggagagcatcagcgtgatcgacacccccggcatcctgagcggcgagaagcagagaatcagcagaggctacgacttcgccgccgtgctggagtggttcgccgagagagtggacagaatcatcctgctgttcgacgcccacaagctggacatcagcgacgagttcagcgaggtgatcaaggccctgaagaaccacgaggacaagatgagagtggtgctgaacaaggccgaccagatcgagacccagcagctgatgagagtgtacggcgccctgatgtggagcctgggcaagatcgtgaacacccccgaggtgatcagagtgtacatcggcagcttctggagccaccccctgctgatccccgacaacagaaagctgttcgaggccgaggagcaggacctgttcagagacatccagagcctgcccagaaacgccgccctgagaaagctgaacgacctgatcaagagagccagactggccaaggtgcacgcctacatcatcagcagcctgaagaaggagatgcccagcgtgttcggcaaggacaacaagaagaaggagctggtgaacaacctggccgagatctacggcagaatcgagagagagcaccagatcagccccggcgacttccccaacctgaagagaatgcaggaccagctgcaggcccaggacttcagcaagttccagcccctgaagagcaagctgctggaggtggtggacgacatgctggcccacgacatcgcccagctgatggtgctggtgagacaggaggagagccagagacccatccagatggtgaagggcggcgccttcgagggcaccctgcacggccccttcggccacggctacggcgagggcgccggcgagggcatcgacgacgccgagtgggtggtggccagagacaagcccatgtacgacgagatcttctacaccctgagccccgtggacggcaagatcaccggcgccaacgccaagaaggagatggtgagaagcaagctgcccaacagcgtgctgggcaagatctggaagctggccgacatcgacaaggacggcatgctggacgacgacgagttcgccctggccaaccacctgatcaaggtgaagctggagggccacgagctgcccaacgagctgcccgcccacctgctgccccccagcaagagaaaggtggccgagtag

SEQ ID NO: 80222 - DNA, 528 bp, Artificial Sequence
  Description of Artificial Sequence: Synthetic coding sequence
atgttcagctggctgggcaccgacgacagaagaagaaaggaccccgaggtgttccagaccgtgagcgagggcctgaagaagctgtacaagagcaagctgctgcccctggaggagcactacagattccacgagttccacagccccgccctggaggacgccgacttcgacaacaagcccatggtgctgctggtgggccagtacagcaccggcaagaccaccttcatcagatacctgctggagcaggacttccccggcatgagaatcggccccgagcccaccaccgacagcttcatcgccgtgatgcagggcgacatggagggcatcatccccggcaacgccctggtggtggaccccaagaagcccttcagaaagctgaacgccttcggcaacgccttcctgaacagattcgtgtgcgcccagctgcccaaccccgtgctggagagcatcagcgtgatcgacacccccggcatcctgagcggcgagaagcagagaatcagcagaggccccgccgccggccccggcctgtag

SEQ ID NO: 80223 - DNA, 4086 bp, Artificial Sequence
  Description of Artificial Sequence: Synthetic coding sequence
atgggcgccgccggcagacaggacttcctgttcaaggccatgctgaccatcagctggctgaccctgacctgcttccccggcgccaccagcaccgtggccgccggctgccccgaccagagccccgagctgcagccctggaaccccggccacgaccaggaccaccacgtgcacatcggccagggcaagaccctgctgctgaccagcagcgccaccgtgtacagcatccacatcagcgagggcggcaagctggtgatcaaggaccacgacgagcccatcgtgctgagaaccagacacatcctgatcgacaacggcggcgagctgcacgccggcagcgccctgtgccccttccagggcaacttcaccatcatcctgtacggcagagccgacgagggcatccagcccgacccctactacggcctgaagtacatcggcgtgggcaagggcggcgccctggagctgcacggccagaagaagctgagctggaccttcctgaacaagaccctgcaccccggcggcatggccgagggcggctacttcttcgagagaagctggggccacagaggcgtgatcgtgcacgtgatcgaccccaagagcggcaccgtgatccacagcgacagattcgacacctacagaagcaagaaggagagcgagagactggtgcagtacctgaacgccgtgcccgacggcagaatcctgagcgtggccgtgaacgacgagggcagcagaaacctggacgacatggccagaaaggccatgaccaagctgggcagcaagcacttcctgcacctgggcttcagacacccctggagcttcctgaccgtgaagggcaaccccagcagcagcgtggaggaccacatcgagtaccacggccacagaggcagcgccgccgccagagtgttcaagctgttccagaccgagcacggcgagtacttcaacgtgagcctgagcagcgagtgggtgcaggacgtggagtggaccgagtggttcgaccacgacaaggtgagccagaccaagggcggcgagaagatcagcgacctgtggaaggcccaccccggcaagatctgcaacagacccatcgacatccaggccaccaccatggacggcgtgaacctgagcaccgaggtggtgtacaagaagggccaggactacagattcgcctgctacgacagaggcagagcctgcagaagctacagagtgagattcctgtgcggcaagcccgtgagacccaagctgaccgtgaccatcgacaccaacgtgaacagcaccatcctgaacctggaggacaacgtgcagagctggaagcccggcgacaccctggtgatcgccagcaccgactacagcatgtaccaggccgaggagttccaggtgctgccctgcagaagctgcgcccccaaccaggtgaaggtggccggcaagcccatgtacctgcacatcggcgaggagatcgacggcgtggacatgagagccgaggtgggcctgctgagcagaaacatcatcgtgatgggcgagatggaggacaagtgctacccctacagaaaccacatctgcaacttcttcgacttcgacaccttcggcggccacatcaagttcgccctgggcttcaaggccgcccacctggagggcaccgagctgaagcacatgggccagcagctggtgggccagtaccccatccacttccacctggccggcgacgtggacgagagaggcggctacgacccccccacctacatcagagacctgagcatccaccacaccttcagcagatgcgtgaccgtgcacggcagcaacggcctgctgatcaaggacgtggtgggctacaacagcctgggccactgcttcttcaccgaggacggccccgaggagagaaacaccttcgaccactgcctgggcctgctggtgaagagcggcaccctgctgcccagcgacagagacagcaagatgtgcaagatgatcaccgaggacagctaccccggctacatccccaagcccagacaggactgcaacgccgtgagcaccttctggatggccaaccccaacaacaacctgatcaactgcgccgccgccggcagcgaggagaccggcttctggttcatcttccaccacgtgcccaccggccccagcgtgggcatgtacagccccggctacagcgagcacatccccctgggcaagttctacaacaacagagcccacagcaactacagagccggcatgatcatcgacaacggcgtgaagaccaccgaggccagcgccaaggacaagagacccttcctgagcatcatcagcgccagatacagcccccaccaggacgccgaccccctgaagcccagagagcccgccatcatcagacacttcatcgcctacaagaaccaggaccacggcgcctggctgagaggcggcgacgtgtggctggacagctgcagattcgccgacaacggcatcggcctgaccctggccagcggcggcaccttcccctacgacgacggcagcaagcaggagatcaagaacagcctgttcgtgggcgagagcggcaacgtgggcaccgagatgatggacaacagaatctggggccccggcggcctggaccacagcggcagaaccctgcccatcggccagaacttccccatcagaggcatccagctgtacgacggccccatcaacatccagaactgcaccttcagaaagttcgtggccctggagggcagacacaccagcgccctggccttcagactgaacaacgcctggcagagctgcccccacaacaacgtgaccggcatcgccttcgaggacgtgcccatcaccagcagagtgttcttcggcgagcccggcccctggttcaaccagctggacatggacggcgacaagaccagcgtgttccacgacgtggacggcagcgtgagcgagtaccccggcagctacctgaccaagaacgacaactggctggtgagacaccccgactgcatcaacgtgcccgactggagaggcgccatctgcagcggctgctacgcccagatgtacatccaggcctacaagaccagcaacctgagaatgaagatcatcaagaacgacttccccagccaccccctgtacctggagggcgccctgaccagaagcacccactaccagcagtaccagcccgtggtgaccctgcagaagggctacaccatccactgggaccagaccgcccccgccgagctggccatctggctgatcaacttcaacaagggcgactggatcagagtgggcctgtgctaccccagaggcaccaccttcagcatcctgagcgacgtgcacaacagactgctgaagcagaccagcaagaccggcgtgttcgtgagaaccctgcagatggacaaggtggagcagagctaccccggcagaagccactactactgggacgaggacagcggcctgctgttcctgaagctgaaggcccagaacgagagagagaagttcgccttctgcagcatgaagggctgcgagagaatcaagatcaaggccctgatccccaagaacgccggcgtgagcgactgcaccgccaccgcctaccccaagttcaccgagagagccgtggtggacgtgcccatgcccaagaagctgttcggcagccagctgaagaccaaggaccacttcctggaggtgaagatggagagcagcaagcagcacttcttccacctgtggaacgacttcgcctacatcgaggtggacggcaagaagtaccccagcagcgaggacggcatccaggtggtggtgatcgacggcaaccagggcagagtggtgagccacaccagcttcagaaacagcatcctgcagggcatcccctggcagctgttcaactacgtggccaccatccccgacaacagcatcgtgctgatggccagcaagggcagatacgtgagcagaggcccctggaccagagtgctggagaagctgggcgccgacagaggcctgaagctgaaggagcagatggccttcgtgggcttcaagggcagcttcagacccatctgggtgaccctggacaccgaggaccacaaggccaagatcttccaggtggtgcccatccccgtggtgaagaagaagaagctgtag

SEQ ID NO: 80224 - DNA, 1092 bp, Artificial Sequence
  Description of Artificial Sequence: Synthetic coding sequence
atgagcatggacgtgaccttcctgggcaccggcgccgcctaccccagccccaccagaggcgccagcgccgtggtgctgagatgcgagggcgagtgctggctgttcgactgcggcgagggcacccagacccagctgatgaagagccagctgaaggccggcagaatcaccaagatcttcatcacccacctgcacggcgaccacttcttcggcctgcccggcctgctgtgcaccatcagcctgcagagcggcagcatggtgagcaagcagcccatcgagatctacggccccgtgggcctgagagacttcatctggagaaccatggagctgagccacaccgagctggtgttccactacgtggtgcacgagctggtgcccaccgccgaccagtgccccgccgaggagctgaaggagttcgcccacgtgaacagagccgacagcccccccaaggaggagcagggcagaaccatcctgctggacagcgaggagaacagctacctgctgttcgacgacgagcagttcgtggtgaaggccttcagactgttccacagaatccccagcttcggcttcagcgtggtggagaagaagagacccggcaagctgaacgcccagaagctgaaggacctgggcgtgccccccggccccgcctacggcaagctgaagaacggcatcagcgtggtgctggagaacggcgtgaccatcagcccccaggacgtgctgaagaagcccatcgtgggcagaaagatctgcatcctgggcgactgcagcggcgtggtgggcgacggcggcgtgaagctgtgcttcgaggccgacctgctgatccacgaggccaccctggacgacgcccagatggacaaggccaaggagcacggccacagcaccccccagatggccgccaccttcgccaagctgtgcagagccaagagactggtgctgacccacttcagccagagatacaagcccgtggccctggccagagagggcgagaccgacggcatcgccgagctgaagaagcaggccgagagcgtgctggacctgcaggaggtgaccctggccgaggacttcatggtgatcagcatccccatcaagaagtag

SEQ ID NO: 80225 - DNA, 2481 bp, Artificial Sequence
  Description of Artificial Sequence: Synthetic coding sequence
atgtgggccctgtgcagcctgctgagaagcgccgccggcagaaccatgagccagggcagaaccatcagccaggcccccgccagaagagagagacccagaaaggaccccctgagacacctgagaaccagagagaagagaggccccagcggctgcagcggcggccccaacaccgtgtacctgcaggtggtggccgccggcagcagagacagcggcgccgccctgtacgtgttcagcgagttcaacagatacctgttcaactgcggcgagggcgtgcagagactgatgcaggagcacaagctgaaggtggccagactggacaacatcttcctgaccagaatgcactggagcaacgtgggcggcctgagcggcatgatcctgaccctgaaggagaccggcctgcccaagtgcgtgctgagcggccccccccagctggagaagtacctggaggccatcaagatcttcagcggccccctgaagggcatcgagctggccgtgagaccccacagcgcccccgagtacgaggacgagaccatgaccgtgtaccagatccccatccacagcgagcagagaagaggcaagcaccagccctggcagagccccgagagacccctgagcagactgagccccgagagaagcagcgacagcgagagcaacgagaacgagccccacctgccccacggcgtgagccagagaagaggcgtgagagacagcagcctggtggtggccttcatctgcaagctgcacctgaagagaggcaacttcctggtgctgaaggccaaggagatgggcctgcccgtgggcaccgccgccatcgcccccatcatcgccgccgtgaaggacggcaagagcatcacccacgagggcagagagatcctggccgaggagctgtgcaccccccccgaccccggcgccgccttcgtggtggtggagtgccccgacgagagcttcatccagcccatctgcgagaacgccaccttccagagataccagggcaaggccgacgcccccgtggccctggtggtgcacatggcccccgccagcgtgctggtggacagcagataccagcagtggatggagagattcggccccgacacccagcacctggtgctgaacgagaactgcgccagcgtgcacaacctgagaagccacaagatccagacccagctgaacctgatccaccccgacatcttccccctgctgaccagcttcagatgcaagaaggagggccccaccctgagcgtgcccatggtgcagggcgagtgcctgctgaagtaccagctgagacccagaagagagtggcagagagacgccatcatcacctgcaaccccgaggagttcatcgtggaggccctgcagctgcccaacttccagcagagcgtgcaggagtacagaagaagcgcccaggacggccccgcccccgccgagaagagaagccagtaccccgagatcatcttcctgggcaccggcagcgccatccccatgaagatcagaaacgtgagcgccaccctggtgaacatcagccccgacaccagcctgctgctggactgcggcgagggcaccttcggccagctgtgcagacactacggcgaccaggtggacagagtgctgggcaccctggccgccgtgttcgtgagccacctgcacgccgaccaccacaccggcctgcccagcatcctgctgcagagagagagagccctggccagcctgggcaagcccctgcaccccctgctggtggtggcccccaaccagctgaaggcctggctgcagcagtaccacaaccagtgccaggaggtgctgcaccacatcagcatgatccccgccaagtgcctgcaggagggcgccgagatcagcagccccgccgtggagagactgatcagcagcctgctgagaacctgcgacctggaggagttccagacctgcctggtgagacactgcaagcacgccttcggctgcgccctggtgcacaccagcggctggaaggtggtgtacagcggcgacaccatgccctgcgaggccctggtgagaatgggcaaggacgccaccctgctgatccacgaggccaccctggaggacggcctggaggaggaggccgtggagaagacccacagcaccaccagccaggccatcagcgtgggcatgagaatgaacgccgagttcatcatgctgaaccacttcagccagagatacgccaaggtgcccctgttcagccccaacttcagcgagaaggtgggcgtggccttcgaccacatgaaggtgtgcttcggcgacttccccaccatgcccaagctgatcccccccctgaaggccctgttcgccggcgacatcgaggagatggaggagagaagagagaagagagagctgagacaggtgagagccgccctgctgagcagagagctggccggcggcctggaggacggcgagccccagcagaagagagcccacaccgaggagccccaggccaagaaggtgagagcccagtag

SEQ ID NO: 80226 - DNA, 2424 bp, Artificial Sequence
  Description of Artificial Sequence: Synthetic coding sequence
atgtgggccctgtgcagcctgctgagaagcgccgccggcagaaccatgagccagggcagaaccatcagccaggcccccgccagaagagagagacccagaaaggaccccctgagacacctgagaaccagagagaagagaggccccagcggctgcagcggcggccccaacaccgtgtacctgcaggtggtggccgccggcagcagagacagcggcgtgcagagactgatgcaggagcacaagctgaaggtggccagactggacaacatcttcctgaccagaatgcactggagcaacgtgggcggcctgagcggcatgatcctgaccctgaaggagaccggcctgcccaagtgcgtgctgagcggccccccccagctggagaagtacctggaggccatcaagatcttcagcggccccctgaagggcatcgagctggccgtgagaccccacagcgcccccgagtacgaggacgagaccatgaccgtgtaccagatccccatccacagcgagcagagaagaggcaagcaccagccctggcagagccccgagagacccctgagcagactgagccccgagagaagcagcgacagcgagagcaacgagaacgagccccacctgccccacggcgtgagccagagaagaggcgtgagagacagcagcctggtggtggccttcatctgcaagctgcacctgaagagaggcaacttcctggtgctgaaggccaaggagatgggcctgcccgtgggcaccgccgccatcgcccccatcatcgccgccgtgaaggacggcaagagcatcacccacgagggcagagagatcctggccgaggagctgtgcaccccccccgaccccggcgccgccttcgtggtggtggagtgccccgacgagagcttcatccagcccatctgcgagaacgccaccttccagagataccagggcaaggccgacgcccccgtggccctggtggtgcacatggcccccgccagcgtgctggtggacagcagataccagcagtggatggagagattcggccccgacacccagcacctggtgctgaacgagaactgcgccagcgtgcacaacctgagaagccacaagatccagacccagctgaacctgatccaccccgacatcttccccctgctgaccagcttcagatgcaagaaggagggccccaccctgagcgtgcccatggtgcagggcgagtgcctgctgaagtaccagctgagacccagaagagagtggcagagagacgccatcatcacctgcaaccccgaggagttcatcgtggaggccctgcagctgcccaacttccagcagagcgtgcaggagtacagaagaagcgcccaggacggccccgcccccgccgagaagagaagccagtaccccgagatcatcttcctgggcaccggcagcgccatccccatgaagatcagaaacgtgagcgccaccctggtgaacatcagccccgacaccagcctgctgctggactgcggcgagggcaccttcggccagctgtgcagacactacggcgaccaggtggacagagtgctgggcaccctggccgccgtgttcgtgagccacctgcacgccgaccaccacaccggcctgcccagcatcctgctgcagagagagagagccctggccagcctgggcaagcccctgcaccccctgctggtggtggcccccaaccagctgaaggcctggctgcagcagtaccacaaccagtgccaggaggtgctgcaccacatcagcatgatccccgccaagtgcctgcaggagggcgccgagatcagcagccccgccgtggagagactgatcagcagcctgctgagaacctgcgacctggaggagttccagacctgcctggtgagacactgcaagcacgccttcggctgcgccctggtgcacaccagcggctggaaggtggtgtacagcggcgacaccatgccctgcgaggccctggtgagaatgggcaaggacgccaccctgctgatccacgaggccaccctggaggacggcctggaggaggaggccgtggagaagacccacagcaccaccagccaggccatcagcgtgggcatgagaatgaacgccgagttcatcatgctgaaccacttcagccagagatacgccaaggtgcccctgttcagccccaacttcagcgagaaggtgggcgtggccttcgaccacatgaaggtgtgcttcggcgacttccccaccatgcccaagctgatcccccccctgaaggccctgttcgccggcgacatcgaggagatggaggagagaagagagaagagagagctgagacaggtgagagccgccctgctgagcagagagctggccggcggcctggaggacggcgagccccagcagaagagagcccacaccgaggagccccaggccaagaaggtgagagcccagtag

SEQ ID NO: 80227 - DNA, 2361 bp, Artificial Sequence
  Description of Artificial Sequence: Synthetic coding sequence
atgtgggccctgtgcagcctgctgagaagcgccgccggcagaaccatgagccagggcagaaccatcagccaggcccccgccagaagagagagacccagaaaggaccccctgagacacctgagaaccagagagaagagaggccccagcggctgcagcggcggccccaacaccgtgtacctgcaggtggtggccgccggcagcagagacagcggcgccgccctgtacgtgttcagcgagttcaacagatacctgttcaactgcggcgagggcgtgcagagactgatgcaggagcacaagctgaaggtggccagactggacaacatcttcctgaccagaatgcactggagcaacgtgggcggcctgagcggcatgatcctgaccctgaaggagaccggcctgcccaagtgcgtgctgagcggccccccccagctggagaagtacctggaggccatcaagatcttcagcggccccctgaagggcatcgagctggccgtgagaccccacagcgcccccgagtacgaggacgagaccatgaccgtgtaccagatccccatccacagcgtgagccagagaagaggcgtgagagacagcagcctggtggtggccttcatctgcaagctgcacctgaagagaggcaacttcctggtgctgaaggccaaggagatgggcctgcccgtgggcaccgccgccatcgcccccatcatcgccgccgtgaaggacggcaagagcatcacccacgagggcagagagatcctggccgaggagctgtgcaccccccccgaccccggcgccgccttcgtggtggtggagtgccccgacgagagcttcatccagcccatctgcgagaacgccaccttccagagataccagggcaaggccgacgcccccgtggccctggtggtgcacatggcccccgccagcgtgctggtggacagcagataccagcagtggatggagagattcggccccgacacccagcacctggtgctgaacgagaactgcgccagcgtgcacaacctgagaagccacaagatccagacccagctgaacctgatccaccccgacatcttccccctgctgaccagcttcagatgcaagaaggagggccccaccctgagcgtgcccatggtgcagggcgagtgcctgctgaagtaccagctgagacccagaagagagtggcagagagacgccatcatcacctgcaaccccgaggagttcatcgtggaggccctgcagctgcccaacttccagcagagcgtgcaggagtacagaagaagcgcccaggacggccccgcccccgccgagaagagaagccagtaccccgagatcatcttcctgggcaccggcagcgccatccccatgaagatcagaaacgtgagcgccaccctggtgaacatcagccccgacaccagcctgctgctggactgcggcgagggcaccttcggccagctgtgcagacactacggcgaccaggtggacagagtgctgggcaccctggccgccgtgttcgtgagccacctgcacgccgaccaccacaccggcctgcccagcatcctgctgcagagagagagagccctggccagcctgggcaagcccctgcaccccctgctggtggtggcccccaaccagctgaaggcctggctgcagcagtaccacaaccagtgccaggaggtgctgcaccacatcagcatgatccccgccaagtgcctgcaggagggcgccgagatcagcagccccgccgtggagagactgatcagcagcctgctgagaacctgcgacctggaggagttccagacctgcctggtgagacactgcaagcacgccttcggctgcgccctggtgcacaccagcggctggaaggtggtgtacagcggcgacaccatgccctgcgaggccctggtgagaatgggcaaggacgccaccctgctgatccacgaggccaccctggaggacggcctggaggaggaggccgtggagaagacccacagcaccaccagccaggccatcagcgtgggcatgagaatgaacgccgagttcatcatgctgaaccacttcagccagagatacgccaaggtgcccctgttcagccccaacttcagcgagaaggtgggcgtggccttcgaccacatgaaggtgtgcttcggcgacttccccaccatgcccaagctgatcccccccctgaaggccctgttcgccggcgacatcgaggagatggaggagagaagagagaagagagagctgagacaggtgagagccgccctgctgagcagagagctggccggcggcctggaggacggcgagccccagcagaagagagcccacaccgaggagccccaggccaagaaggtgagagcccagtag

SEQ ID NO: 80228 - DNA, 861 bp, Artificial Sequence
  Description of Artificial Sequence: Synthetic coding sequence
tgaccccacggcgtgagccagagaagaggcgtgagagacagcagcctggtggtggccttcatctgcaagctgcacctgaagagaggcaacttcctggtgctgaaggccaaggagatgggcctgcccgtgggcaccgccgccatcgcccccatcatcgccgccgtgaaggacggcaagagcatcacccacgagggcagagaggtgctgcagatcctggccgaggagctgtgcaccccccccgaccccggcgccgccttcgtggtggtggagtgccccgacgagagcttcatccagcccatctgcgagaacgccaccttccagagataccagggcaaggccgacgcccccgtggccctggtggtgcacatggcccccgccagcgtgctggtggacagcagataccagcagtggatggagagattcggccccgacacccagcacctggtgctgaacgagaactgcgccagcgtgcacaacctgagaagccacaagatccagacccagctgaacctgatccaccccgacatcttccccctgctgaccagcttcagatgcaagaaggagggccccaccctgagcgtgcccatggtgcagggcgagtgcctgctgaagtaccagctgagacccagaagagagtggcagagagacgccatcatcacctgcaaccccgaggagttcatcgtggaggccctgcagctgcccaacttccagcagagcgtgcaggagtacagaagaagcgcccaggacggccccgcccccgccgagaagagaagccagtaccccgagatcatcttcctgggcaccggcagcgccatccccatgaagatcagaaacgtgagcgccaccctggtgaacatctag

SEQ ID NO: 80229 - DNA, 837 bp, Artificial Sequence
  Description of Artificial Sequence: Synthetic coding sequence
atcctggccgaggagctgtgcaccccccccgaccccggcgccgccttcgtggtggtggagtgccccgacgagagcttcatccagcccatctgcgagaacgccaccttccagagattcggccccgacacccagcacctggtgctgaacgagaactgcgccagcgtgcacaacctgagaagccacaagatccagacccagctgaacctgatccaccccgacatcttccccctgctgaccagcttcagatgcaagaaggagggccccaccctgagcgtgcccatggtgcagggcgagtgcctgctgaagtaccagctgagacccagaagagagtggcagagagacgccatcatcacctgcaaccccgaggagttcatcgtggaggccctgcagctgcccaacttccagcagagcgtgcaggagtacagaagaagcgcccaggacggccccgcccccgccgagaagagaagccagtaccccgagatcatcttcctgggcaccggcagcgccatccccatgaagatcagaaacgtgagcgccaccctggtgaacatcagccccgacaccagcctgctgctggactgcggcgagggcaccttcggccagctgtgcagacactacggcgaccaggtggacagagtgctgggcaccctggccgccgtgttcgtgagccacctgcacgccgaccaccacaccggcctgcccagcatcctgctgcagagagagagagccctggccagcctgggcaagcccctgcaccccctgctggtggtggcccccaaccagctgaaggcctggctgcagcagtaccacaaccagtgccaggaggtgctgcactag

SEQ ID NO: 80230 - DNA, 804 bp, Artificial Sequence
  Description of Artificial Sequence: Synthetic coding sequence
atgaccctgggcagaagactggcctgcctgttcctggcctgcgtgctgcccgccctgctgctgggcggcaccgccctggccagcgagatcgtgggcggcagaagagccagaccccacgcctggcccttcatggtgagcctgcagctgagaggcggccacttctgcggcgccaccctgatcgcccccaacttcgtgatgagcgccgcccactgcgtggccaacgtgaacgtgagagccgtgagagtggtgctgggcgcccacaacctgagcagaagagagcccaccagacaggtgttcgccgtgcagagaatcttcgagaacggctacgaccccgtgaacctgctgaacgacatcgtgatcctgcagctgaacggcagcgccaccatcaacgccaacgtgcaggtggcccagctgcccgcccagggcagaagactgggcaacggcgtgcagtgcctggccatgggctggggcctgctgggcagaaacagaggcatcgccagcgtgctgcaggagctgaacgtgaccgtggtgaccagcctgtgcagaagaagcaacgtgtgcaccctggtgagaggcagacaggccggcgtgtgcttcggcgacagcggcagccccctggtgtgcaacggcctgatccacggcatcgccagcttcgtgagaggcggctgcgccagcggcctgtaccccgacgccttcgcccccgtggcccagttcgtgaactggatcgacagcatcatccagagaagcgaggacaacccctgcccccaccccagagaccccgaccccgccagcagaacccactag

SEQ ID NO: 80231 - DNA, 804 bp, Artificial Sequence; identical to SEQ ID NO: 80230
  Description of Artificial Sequence: Synthetic coding sequence

SEQ ID NO: 80232 - DNA, 3051 bp, Artificial Sequence
  Description of Artificial Sequence: Synthetic coding sequence
atggcccccagaaccctgtggagctgctacctgtgctgcctgctgaccgccgccgccggcgccgccagctacccccccagaggcttcagcctgtacaccggcagcagcggcgccctgagccccggcggcccccaggcccagatcgcccccagacccgccagcagacacagaaactggtgcgcctacgtggtgaccagaaccgtgagctgcgtgctggaggacggcgtggagacctacgtgaagtaccagccctgcgcctggggccagccccagtgcccccagagcatcatgtacagaagattcctgagacccagatacagagtggcctacaagaccgtgaccgacatggagtggagatgctgccagggctacggcggcgacgactgcgccgagagccccgcccccgccctgggccccgccagcagcacccccagacccctggcccagcccgccagacccaacctgagcggcagcagcgccggcagccccctgagcggcctgggcggcgagggccccggcgagagcgagaaggtgcagcagctggaggagcaggtgcagagcctgaccaaggagctgcagggcctgagaggcgtgctgcagggcctgagcggcagactggccgaggacgtgcagagagccgtggagaccgccttcaacggcagacagcagcccgccgacgccgccgccagacccggcgtgcacgagaccctgaacgagatccagcaccagctgcagctgctggacaccagagtgagcacccacgaccaggagctgggccacctgaacaaccaccacggcggcagcagcagcagcggcggcagcagagcccccgcccccgccagcgccccccccggccccagcgaggagctgctgagacagctggagcagagactgcaggagagctgcagcgtgtgcctggccggcctggacggcttcagaagacagcagcaggaggacagagagagactgagagccatggagaagctgctggccagcgtggaggagagacagagacacctggccggcctggccgtgggcagaagacccccccaggagtgctgcagccccgagctgggcagaagactggccgagctggagagaagactggacgtggtggccggcagcgtgaccgtgctgagcggcagaagaggcaccgagctgggcggcgccgccggccagggcggccacccccccggctacaccagcctggccagcagactgagcagactggaggacagattcaacagcaccctgggccccagcgaggagcaggaggagagctggcccggcgcccccggcggcctgagccactggctgcccgccgccagaggcagactggagcagctgggcggcctgctggccaacgtgagcggcgagctgggcggcagactggacctgctggaggagcaggtggccggcgccatgcaggcctgcggccagctgtgcagcggcgcccccggcgagcaggacagccaggtgagcgagatcctgagcgccctggagagaagagtgctggacagcgagggccagctgagactggtgggcagcggcctgcacaccgtggaggccgccggcgaggccagacaggccaccctggagggcctgcaggaggtggtgggcagactgcaggacagagtggacgcccaggacgagaccgccgccgagttcaccctgagactgaacctgaccgccgccagactgggccagctggagggcctgctgcaggcccacggcgacgagggctgcggcgcctgcggcggcgtgcaggaggagctgggcagactgagagacggcgtggagagatgcagctgccccctgctgccccccagaggccccggcgccggccccggcgtgggcggccccagcagaggccccctggacggcttcagcgtgttcggcggcagcagcggcagcgccctgcaggccctgcagggcgagctgagcgaggtgatcctgagcttcagcagcctgaacgacagcctgaacgagctgcagaccaccgtggagggccagggcgccgacctggccgacctgggcgccaccaaggacagaatcatcagcgagatcaacagactgcagcaggaggccaccgagcacgccaccgagagcgaggagagattcagaggcctggaggagggccaggcccaggccggccagtgccccagcctggagggcagactgggcagactggagggcgtgtgcgagagactggacaccgtggccggcggcctgcagggcctgagagagggcctgagcagacacgtggccggcctgtgggccggcctgagagagaccaacaccaccagccagatgcaggccgccctgctggagaagctggtgggcggccaggccggcctgggcagaagactgggcgccctgaacagcagcctgcagctgctggaggacagactgcaccagctgagcctgaaggacctgaccggccccgccggcgaggccggcccccccggcccccccggcctgcagggcccccccggccccgccggcccccccggcagccccggcaaggacggccaggagggccccatcggcccccccggcccccagggcgagcagggcgtggagggcgcccccgccgcccccgtgccccaggtggccttcagcgccgccctgagcctgcccagaagcgagcccggcaccgtgcccttcgacagagtgctgctgaacgacggcggctactacgaccccgagaccggcgtgttcaccgcccccctggccggcagatacctgctgagcgccgtgctgaccggccacagacacgagaaggtggaggccgtgctgagcagaagcaaccagggcgtggccagagtggacagcggcggctacgagcccgagggcctggagaacaagcccgtggccgagagccagcccagccccggcaccctgggcgtgttcagcctgatcctgcccctgcaggccggcgacaccgtgtgcgtggacctggtgatgggccagctggcccacagcgaggagcccctgaccatcttcagcggcgccctgctgtacggcgaccccgagctggagcacgcctag

SEQ ID NO: 80233 - DNA, 1044 bp, Artificial Sequence
  Description of Artificial Sequence: Synthetic coding sequence
atggccgacctgggcgccaccaaggacagaatcatcagcgagatcaacagactgcagcaggaggccaccgagcacgccaccgagagcgaggagagattcagaggcctggaggagggccaggcccaggccggccagtgccccagcctggagggcagactgggcagactggagggcgtgtgcgagagactggacaccgtggccggcggcctgcagggcctgagagagggcctgagcagacacgtggccggcctgtgggccggcctgagagagaccaacaccaccagccagatgcaggccgccctgctggagaagctggtgggcggccaggccggcctgggcagaagactgggcgccctgaacagcagcctgcagctgctggaggacagactgcaccagctgagcctgaaggacctgaccggcgagggcaccaagggccccgccggcgaggccggcccccccggcccccccggcctgcagggcccccccggccccgccggcccccccggcagccccggcaaggacggccaggagggccccatcggcccccccggcccccagggcgagcagggcgtggagggcgcccccgccgcccccgtgccccaggtggccttcagcgccgccctgagcctgcccagaagcgagcccggcaccgtgcccttcgacagagtgctgctgaacgacggcggctactacgaccccgagaccggcgtgttcaccgcccccctggccggcagatacctgctgagcgccgtgctgaccggccacagacacgagaaggtggaggccgtgctgagcagaagcaaccagggcgtggccagagtggacagcggcggctacgagcccgagggcctggagaacaagcccgtggccgagagccagcccagccccggcaccctgggcgtgttcagcctgatcctgcccctgcaggccggcgacaccgtgtgcgtggacctggtgatgggccagctggcccacagcgaggagcccctgaccatcttcagcggcgccctgctgtacggcgaccccgagctggagcacgcctag

SEQ ID NO: 80234 - DNA, 1062 bp, Artificial Sequence
  Description of Artificial Sequence: Synthetic coding sequence
atgggcagcggcggcagaagcgcccaggtgagcaccggccagagagcctggctgctgccctgcagattcctgaagaacaccatgagcaacggctacgaggaccacatggccgaggactgcagaggcgacatcggcagaaccaacctgatcgtgaactacctgccccagaacatgacccaggacgagctgagaagcctgttcagcagcatcggcgaggtggagagcgccaagctgatcagagacaaggtggccggccacagcctgggctacggcttcgtgaactacgtgaccgccaaggacgccgagagagccatcaacaccctgaacggcctgagactgcagagcaagaccatcaaggtgagctacgccagacccagcagcgaggtgatcaaggacgccaacctgtacatcagcggcctgcccagaaccatgacccagaaggacgtggaggacatgttcagcagattcggcagaatcatcaacagcagagtgctggtggaccagaccaccggcctgagcagaggcgtggccttcatcagattcgacaagagaagcgaggccgaggaggccatcaccagcttcaacggccacaagccccccggcagcagcgagcccatcaccgtgaagttcgccgccaaccccaaccagaacaagaacgtggccctgctgagccagctgtaccacagccccgccagaagattcggcggccccgtgcaccaccaggcccagagattcagattcagccccatgggcgtggaccacatgagcggcctgagcggcgtgaacgtgcccggcaacgccagcagcggctggtgcatcttcatctacaacctgggccaggacgccgacgagggcatcctgtggcagatgttcggccccttcggcgccgtgaccaacgtgaaggtgatcagagacttcaacaccaacaagtgcaagggcttcggcttcgtgaccatgaccaactacgaggaggccgccatggccatcgccagcctgaacggctacagactgggcgacaagatcctgcaggtgagcttcaagaccaacaagagccacaagtag

SEQ ID NO: 80235 - DNA, 981 bp, Artificial Sequence
  Description of Artificial Sequence: Synthetic coding sequence
atgagcaacggctacgaggaccacatggccgaggactgcagaggcgacatcggcagaaccaacctgatcgtgaactacctgccccagaacatgacccaggacgagctgagaagcctgttcagcagcatcggcgaggtggagagcgccaagctgatcagagacaaggtggccggccacagcctgggctacggcttcgtgaactacgtgaccgccaaggacgccgagagagccatcaacaccctgaacggcctgagactgcagagcaagaccatcaaggtgagctacgccagacccagcagcgaggtgatcaaggacgccaacctgtacatcagcggcctgcccagaaccatgacccagaaggacgtggaggacatgttcagcagattcggcagaatcatcaacagcagagtgctggtggaccagaccaccggcctgagcagaggcgtggccttcatcagattcgacaagagaagcgaggccgaggaggccatcaccagcttcaacggccacaagccccccggcagcagcgagcccatcaccgtgaagttcgccgccaaccccaaccagaacaagaacgtggccctgctgagccagctgtaccacagccccgccagaagattcggcggccccgtgcaccaccaggcccagagattcagattcagccccatgggcgtggaccacatgagcggcctgagcggcgtgaacgtgcccggcaacgccagcagcggctggtgcatcttcatctacaacctgggccaggacgccgacgagggcatcctgtggcagatgttcggccccttcggcgccgtgaccaacgtgaaggtgatcagagacttcaacaccaacaagtgcaagggcttcggcttcgtgaccatgaccaactacgaggaggccgccatggccatcgccagcctgaacggctacagactgggcgacaagatcctgcaggtgagcttcaagaccaacaagagccacaagtag

SEQ ID NO: 80236 - DNA, 828 bp, Artificial Sequence
  Description of Artificial Sequence: Synthetic coding sequence
atgagcagcctgcacaagagcagaatcgccgacttccaggacgtgctgaaggagcccagcatcgccctggagaagctgagagagctgagcttcagcggcatcccctgcgagggcggcctgagatgcctgtgctggaagatcctgctgaactacctgcccctggagagagccagctggaccagcatcctggccaagcagagagagctgtacgcccagttcctgagagagatgatcatccagcccggcatcgccaaggccaacatgggcgtgagcagagaggacgtgaccttcgaggaccaccccctgaaccccaaccccgacagcagatggaacacctacttcaaggacaacgaggtgctgctgcagatcgacaaggacgtgagaagactgtgccccgacatcagcttcttccagagagccaccgactacccctgcctgctgatcctggacccccagaacgagttcgagaccctgagaaagagagtggagcagaccaccctgaagagccagaccgtggccagaaacagaagcggcgtgaccaaccaggagcagaacatcaagccccagttcttcgccttcagatggctgaccctgctgctgagccaggagttcctgctgcccgacgtgatcagaatctgggacagcctgttcgccgacgacaacagattcgacttcctgctgctggtgtgctgcgccatgctgatgctgatcagagagcagctgctggagggcgacttcaccgtgaacatgagactgctgcaggactaccccatcaccgacgtgtgccagatcctgcagaaggccaaggagctgcaggacagcaagtag

SEQ ID NO: 80237 - DNA, 1164 bp, Artificial Sequence
  Description of Artificial Sequence: Synthetic coding sequence
atggccgtgagactgtgcgacgtggccagcctgctgagaagcggcagctgggccgccgagccctggaccggcgtgatcgccgccatggagacccagctgagcaacggccccacctgcaacaacaccgccaacggccccaccaccatcaacaacaactgcagcagccccgtggacagcggcaacaccgaggacagcaagaccaacctgatcgtgaactacctgccccagaacatgacccaggaggagctgaagagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcatcagcagaggcgtgggcttcatcagattcgacaagagaatcgaggccgaggaggccatcaagggcctgaacggccagaagccccccggcgccaccgagcccatcaccgtgaagttcgccaacaaccccagccagaagaccaaccaggccatcctgagccagctgtaccagagccccaacagaagataccccggccccctggcccagcaggcccagagattcagactggacaacctgctgaacatggcctacggcgtgaagagattcagccccatgaccatcgacggcatgaccagcctggccggcatcaacatccccggccaccccggcaccggctggtgcatcttcgtgtacaacctggcccccgacgccgacgagagcatcctgtggcagatgttcggccccttcggcgccgtgaccaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaagacccacaaggcctag

SEQ ID NO: 80238 - DNA, 1041 bp, Artificial Sequence
  Description of Artificial Sequence: Synthetic coding sequence
atggagacccagctgagcaacggccccacctgcaacaacaccgccaacggccccaccaccatcaacaacaactgcagcagccccgtggacagcggcaacaccgaggacagcaagaccaacctgatcgtgaactacctgccccagaacatgacccaggaggagctgaagagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcatcagcagaggcgtgggcttcatcagattcgacaagagaatcgaggccgaggaggccatcaagggcctgaacggccagaagccccccggcgccaccgagcccatcaccgtgaagttcgccaacaaccccagccagaagaccaaccaggccatcctgagccagctgtaccagagccccaacagaagataccccggccccctggcccagcaggcccagagattcagattcagccccatgaccatcgacggcatgaccagcctggccggcatcaacatccccggccaccccggcaccggctggtgcatcttcgtgtacaacctggcccccgacgccgacgagagcatcctgtggcagatgttcggccccttcggcgccgtgaccaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaagacccacaaggcctag

SEQ ID NO: 80239 - DNA, 1080 bp, Artificial Sequence
  Description of Artificial Sequence: Synthetic coding sequence
atggagacccagctgagcaacggccccacctgcaacaacaccgccaacggccccaccaccatcaacaacaactgcagcagccccgtggacagcggcaacaccgaggacagcaagaccaacctgatcgtgaactacctgccccagaacatgacccaggaggagctgaagagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcatcagcagaggcgtgggcttcatcagattcgacaagagaatcgaggccgaggaggccatcaagggcctgaacggccagaagccccccggcgccaccgagcccatcaccgtgaagttcgccaacaaccccagccagaagaccaaccaggccatcctgagccagctgtaccagagccccaacagaagataccccggccccctggcccagcaggcccagagattcagactggacaacctgctgaacatggcctacggcgtgaagagattcagccccatgaccatcgacggcatgaccagcctggccggcatcaacatccccggccaccccggcaccggctggtgcatcttcgtgtacaacctggcccccgacgccgacgagagcatcctgtggcagatgttcggccccttcggcgccgtgaccaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaagacccacaaggcctag

SEQ ID NO: 80240 - DNA, 1080 bp, Artificial Sequence; identical to SEQ ID NO: 80239
  Description of Artificial Sequence: Synthetic coding sequence

SEQ ID NO: 80241 - DNA, 273 bp, Artificial Sequence
  Description of Artificial Sequence: Synthetic coding sequence
atgacccagaaggagctggagcagctgttcagccagtacggcagaatcatcaccagcagaatcctggtggaccaggtgaccggcatcagcagaggcgtgggcttcatcagattcgacaagagaatcgaggccgaggaggccatcaagggcctgaacggccagaagccccccggcgccaccgagcccatcaccgtgaagttcgccaacaaccccagccagaagaccaaccaggccatcctgagccagctgtaccagagccccaacagaagatag

SEQ ID NO: 80242 - DNA, 570 bp, Artificial Sequence
  Description of Artificial Sequence: Synthetic coding sequence
atggagacccagctgagcaacggccccacctgcaacaacaccgccaacggccccaccaccatcaacaacaactgcagcagccccgtggacagcggcaacaccgaggacagcaagaccaacctgatcgtgaactacctgccccagaacatgacccaggaggagctgaagagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcatcagcagaggcgtgggcttcatcagattcgacaagagaatcgaggccgaggaggccatcaagggcctgaacggccagtag

SEQ ID NO: 80243 - DNA, 1080 bp, Artificial Sequence; identical to SEQ ID NO: 80239
  Description of Artificial Sequence: Synthetic coding sequence

SEQ ID NO: 80244 - DNA, 1104 bp, Artificial Sequence
  Description of Artificial Sequence: Synthetic coding sequence
atggtgacccagatcctgggcgccatggagagccaggtgggcggcggccccgccggccccgccctgcccaacggccccctgctgggcaccaacggcgccaccgacgacagcaagaccaacctgatcgtgaactacctgccccagaacatgacccaggacgagttcaagagcctgttcggcagcatcggcgacatcgagagctgcaagctggtgagagacaagatcaccggccagagcctgggctacggcttcgtgaactacagcgaccccaacgacgccgacaaggccatcaacaccctgaacggcctgaagctgcagaccaagaccatcaaggtgagctacgccagacccagcagcgccagcatcagagacgccaacctgtacgtgagcggcctgcccaagaccatgagccagaaggagatggagcagctgttcagccagtacggcagaatcatcaccagcagaatcctggtggaccaggtgaccggcgtgagcagaggcgtgggcttcatcagattcgacaagagaatcgaggccgaggaggccatcaagggcctgaacggccagaagcccctgggcgccgccgagcccatcaccgtgaagttcgccaacaaccccagccagaagaccggccaggccctgctgacccacctgtaccagagcagcgccagaagatacgccggccccctgcaccaccagacccagagattcagactggacaacctgctgaacatggcctacggcgtgaagagccccctgagcctgatcgccagattcagccccatcgccatcgacggcatgagcggcctggccggcgtgggcctgagcggcggcgccgccggcgccggctggtgcatcttcgtgtacaacctgagccccgaggccgacgagagcgtgctgtggcagctgttcggccccttcggcgccgtgaccaacgtgaaggtgatcagagacttcaccaccaacaagtgcaagggcttcggcttcgtgaccatgaccaactacgacgaggccgccatggccatcgccagcctgaacggctacagactgggcgagagagtgctgcaggtgagcttcaagaccagcaagcagcacaaggcctag

SEQ ID NO: 80245 - DNA, 1083 bp, Artificial Sequence
  Description of Artificial Sequence: Synthetic coding sequence
atggtgacccagatcctgggcgccatggagagccaggtgggcggcggccccgccggccccgccctgcccaacggccccctgctgggcaccaacggcgccaccgacgacagcaagaccaacctgatcgtgaactacctgccccagaacatgacccaggacgagttcaagagcctgttcggcagcatcggcgacatcgagagctgcaagctggtgagagacaagatcaccggccagagcctgggctacggcttcgtgaactacagcgaccccaacgacgccgacaaggccatcaacaccctgaacggcctgaagctgcagaccaagaccatcaaggtgagctacgccagacccagcagcgccagcatcagagacgccaacctgtacgtgagcggcctgcccaagaccatgagccagaaggagatggagcagctgttcagccagtacggcagaatcatcaccagcagaatcctggtggaccaggtgaccggcgtgagcagaggcgtgggcttcatcagattcgacaagagaatcgaggccgaggaggccatcaagggcctgaacggccagaagcccctgggcgccgccgagcccatcaccgtgaagttcgccaacaaccccagccagaagaccggccaggccctgctgacccacctgtaccagagcagcgccagaagatacgccggccccctgcaccaccagacccagagattcagactggacaacctgctgaacatggcctacggcgtgaagagattcagccccatcgccatcgacggcatgagcggcctggccggcgtgggcctgagcggcggcgccgccggcgccggctggtgcatcttcgtgtacaacctgagccccgaggccgacgagagcgtgctgtggcagctgttcggccccttcggcgccgtgaccaacgtgaaggtgatcagagacttcaccaccaacaagtgcaagggcttcggcttcgtgaccatgaccaactacgacgaggccgccatggccatcgccagcctgaacggctacagactgggcgagagagtgctgcaggtgagcttcaagaccagcaagcagcacaaggcctag

SEQ ID NO: 80246 - DNA, 1152 bp, Artificial Sequence
  Description of Artificial Sequence: Synthetic coding sequence
atgagactgctgctgctgagagagatcgtgatcaacgagagcagaaactgcagcttcatgatcatcagcaccatggagccccaggtgagcaacggccccaccagcaacaccagcaacggccccagcagcaacaacagaaactgccccagccccatgcagaccggcgccaccaccgacgacagcaagaccaacctgatcgtgaactacctgccccagaacatgacccaggaggagttcagaagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcgtgagcagaggcgtgggcttcatcagattcgacaagagaatcgaggccgaggaggccatcaagggcctgaacggccagaagcccagcggcgccaccgagcccatcaccgtgaagttcgccaacaaccccagccagaagagcagccaggccctgctgagccagctgtaccagagccccaacagaagataccccggccccctgcaccaccaggcccagagattcagactggacaacctgctgaacatggcctacggcgtgaagagattcagccccatcaccatcgacggcatgaccagcctggtgggcatgaacatccccggccacaccggcaccggctggtgcatcttcgtgtacaacctgagccccgacagcgacgagagcgtgctgtggcagctgttcggccccttcggcgccgtgaacaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaaggcccacaagagctag

SEQ ID NO: 80247 - DNA, 1116 bp, Artificial Sequence
  Description of Artificial Sequence: Synthetic coding sequence
atggagtggaacggcctgaagatgatcatcagcaccatggagccccaggtgagcaacggccccaccagcaacaccagcaacggccccagcagcaacaacagaaactgccccagccccatgcagaccggcgccaccaccgacgacagcaagaccaacctgatcgtgaactacctgccccagaacatgacccaggaggagttcagaagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcgtgagcagaggcgtgggcttcatcagattcgacaagagaatcgaggccgaggaggccatcaagggcctgaacggccagaagcccagcggcgccaccgagcccatcaccgtgaagttcgccaacaaccccagccagaagagcagccaggccctgctgagccagctgtaccagagccccaacagaagataccccggccccctgcaccaccaggcccagagattcagactggacaacctgctgaacatggcctacggcgtgaagagattcagccccatcaccatcgacggcatgaccagcctggtgggcatgaacatccccggccacaccggcaccggctggtgcatcttcgtgtacaacctgagccccgacagcgacgagagcgtgctgtggcagctgttcggccccttcggcgccgtgaacaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaaggcccacaagagctag

SEQ ID NO: 80248 - DNA, 1158 bp, Artificial Sequence
  Description of Artificial Sequence: Synthetic coding sequence
atggagtggaacggcctgaagatgatcatcagcaccatggagccccaggtgagcaacggccccaccagcaacaccagcaacggccccagcagcaacaacagaaactgccccagccccatgcagaccggcgccaccaccgacgacagcaagaccaacctgatcgtgaactacctgccccagaacatgacccaggaggagttcagaagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcgtgagcagaggcgtgggcttcatcagattcgacaagagaatcgaggccgaggaggccatcaagggcctgaacggccagaagcccagcggcgccaccgagcccatcaccgtgaagttcgccaacaaccccagccagaagagcagccaggccctgctgagccagctgtaccagagccccaacagaagataccccggccccctgcaccaccaggcccagagattcagactggacaacctgctgaacatggcctacggcgtgaagagactgatgagcggccccgtgccccccagcgcctgcccccccagattcagccccatcaccatcgacggcatgaccagcctggtgggcatgaacatccccggccacaccggcaccggctggtgcatcttcgtgtacaacctgagccccgacagcgacgagagcgtgctgtggcagctgttcggccccttcggcgccgtgaacaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaaggcccacaagagctag

SEQ ID NO: 80249 - DNA, 1143 bp, Artificial Sequence
  Description of Artificial Sequence: Synthetic coding sequence
atggtgatgatcatcagcaccatggagccccaggtgagcaacggccccaccagcaacaccagcaacggccccagcagcaacaacagaaactgccccagccccatgcagaccggcgccaccaccgacgacagcaagaccaacctgatcgtgaactacctgccccagaacatgacccaggaggagttcagaagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcgtgagcagaggcgtgggcttcatcagattcgacaagagaatcgaggccgaggaggccatcaagggcctgaacggccagaagcccagcggcgccaccgagcccatcaccgtgaagttcgccaacaaccccagccagaagagcagccaggccctgctgagccagctgtaccagagccccaacagaagataccccggccccctgcaccaccaggcccagagattcagactggacaacctgctgaacatggcctacggcgtgaagagactgatgagcggccccgtgccccccagcgcctgcccccccagattcagccccatcaccatcgacggcatgaccagcctggtgggcatgaacatccccggccacaccggcaccggctggtgcatcttcgtgtacaacctgagccccgacagcgacgagagcgtgctgtggcagctgttcggccccttcggcgccgtgaacaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaaggcccacaagagctag

SEQ ID NO: 80250 - DNA, 1101 bp, Artificial Sequence
  Description of Artificial Sequence: Synthetic coding sequence
atggtgatgatcatcagcaccatggagccccaggtgagcaacggccccaccagcaacaccagcaacggccccagcagcaacaacagaaactgccccagccccatgcagaccggcgccaccaccgacgacagcaagaccaacctgatcgtgaactacctgccccagaacatgacccaggaggagttcagaagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcgtgagcagaggcgtgggcttcatcagattcgacaagagaatcgaggccgaggaggccatcaagggcctgaacggccagaagcccagcggcgccaccgagcccatcaccgtgaagttcgccaacaaccccagccagaagagcagccaggccctgctgagccagctgtaccagagccccaacagaagataccccggccccctgcaccaccaggcccagagattcagactggacaacctgctgaacatggcctacggcgtgaagagattcagccccatcaccatcgacggcatgaccagcctggtgggcatgaacatccccggccacaccggcaccggctggtgcatcttcgtgtacaacctgagccccgacagcgacgagagcgtgctgtggcagctgttcggccccttcggcgccgtgaacaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaaggcccacaagagctag

SEQ ID NO: 80251 - DNA, 1101 bp, Artificial Sequence
  Description of Artificial Sequence: Synthetic coding sequence
atggagcagatcatcagcaccatggagccccaggtgagcaacggccccaccagcaacaccagcaacggccccagcagcaacaacagaaactgccccagccccatgcagaccggcgccaccaccgacgacagcaagaccaacctgatcgtgaactacctgccccagaacatgacccaggaggagttcagaagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcgtgagcagaggcgtgggcttcatcagattcgacaagagaatcgaggccgaggaggccatcaagggcctgaacggccagaagcccagcggcgccaccgagcccatcaccgtgaagttcgccaacaaccccagccagaagagcagccaggccctgctgagccagctgtaccagagccccaacagaagataccccggccccctgcaccaccaggcccagagattcagactggacaacctgctgaacatggcctacggcgtgaagagattcagccccatcaccatcgacggcatgaccagcctggtgggcatgaacatccccggccacaccggcaccggctggtgcatcttcgtgtacaacctgagccccgacagcgacgagagcgtgctgtggcagctgttcggccccttcggcgccgtgaacaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaaggcccacaagagctag

SEQ ID NO: 80252 - DNA, 1110 bp, Artificial Sequence
  Description of Artificial Sequence: Synthetic coding sequence
atgagactgaagaaccagatcatcagcaccatggagccccaggtgagcaacggccccaccagcaacaccagcaacggccccagcagcaacaacagaaactgccccagccccatgcagaccggcgccaccaccgacgacagcaagaccaacctgatcgtgaactacctgccccagaacatgacccaggaggagttcagaagcctgttcggcagcatcggcgagatcgagagctgcaagctggtgagagacaagatcaccggccagagcctgggctacggcttcgtgaactacatcgaccccaaggacgccgagaaggccatcaacaccctgaacggcctgagactgcagaccaagaccatcaaggtgagctacgccagacccagcagcgccagcatcagagacgccaacctgtacgtgagcggcctgcccaagaccatgacccagaaggagctggagcagctgttcagccagtacggcagaatcatcaccagcagaatcctggtggaccaggtgaccggcgtgagcagaggcgtgggcttcatcagattcgacaagagaatcgaggccgaggaggccatcaagggcctgaacggccagaagcccagcggcgccaccgagcccatcaccgtgaagttcgccaacaaccccagccagaagagcagccaggccctgctgagccagctgtaccagagccccaacagaagataccccggccccctgcaccaccaggcccagagattcagactggacaacctgctgaacatggcctacggcgtgaagagattcagccccatcaccatcgacggcatgaccagcctggtgggcatgaacatccccggccacaccggcaccggctggtgcatcttcgtgtacaacctgagccccgacagcgacgagagcgtgctgtggcagctgttcggccccttcggcgccgtgaacaacgtgaaggtgatcagagacttcaacaccaacaagtgcaagggcttcggcttcgtgaccatgaccaactacgacgaggccgccatggccatcgccagcctgaacggctacagactgggcgacagagtgctgcaggtgagcttcaagaccaacaaggcccacaagagctag

SEQ ID NO: 80253 - DNA, 855 bp, Artificial Sequence
  Description of Artificial Sequence: Synthetic coding sequence
atgttcagagccgccgcccccggccagctgagaagagccgtggcccaggacctgtgcaaggtggccggcatcgccaaggtgctggtggcccagcacgacgtgtacaagggcctgctgcccgaggagctgacccccctgatcctggccacccagaagcagttcaactacacccacatctgcgccggcgccagcgccttcggcaagaacctgctgcccagagtggccgccaagctggaggtggcccccatcagcgacatcatcgccatcaagagccccgacaccttcgtgagaaccatctacgccggcaacgccctgtgcaccgtgaagtgcgacgagaaggtgaaggtgttcagcgtgagaggcaccagcttcgacgccgccgccaccagcggcggcagcgccagcagcgagaaggccagcagcaccagccccgtggagatcagcgagtggctggaccagaagctgaccaagagcgacagacccgagctgaccggcgccaaggtggtggtgagcggcggcagaggcctgaagagcggcgagaacttcaagctgctgtacgacctggccgaccagctgcacgccgccgtgggcgccagcagagccgccgtggacgccggcttcgtgcccaacgacatgcaggtgggccagaccggcaagatcgtggcccccgagctgtacatcgccgtgggcatcagcggcgccatccagcacctggccggcatgaaggacagcaagaccatcgtggccatcaacaaggaccccgaggcccccatcttccaggtggccgactacggcatcgtggccgacctgttcaaggtggtgcccgagatgaccgagatcctgaagaagaagtag

SEQ ID NO: 80254 - DNA, 1002 bp, Artificial Sequence
  Description of Artificial Sequence: Synthetic coding sequence
atgttcagagccgccgcccccggccagctgagaagagccgccagcctgctgagattccagagcaccctggtgatcgccgagcacgccaacgacagcctggcccccatcaccctgaacaccatcaccgccgccaccagactgggcggcgaggtgagctgcctggtggccggcaccaagtgcgacaaggtggcccaggacctgtgcaaggtggccggcatcgccaaggtgctggtggcccagcacgacgtgtacaagggcctgctgcccgaggagctgacccccctgatcctggccacccagaagcagttcaactacacccacatctgcgccggcgccagcgccttcggcaagaacctgctgcccagagtggccgccaagctggaggtggcccccatcagcgacatcatcgccatcaagagccccgacaccttcgtgagaaccatctacgccggcaacgccctgtgcaccgtgaagtgcgacgagaaggtgaaggtgttcagcgtgagaggcaccagcttcgacgccgccgccaccagcggcggcagcgccagcagcgagaaggccagcagcaccagccccgtggagatcagcgagtggctggaccagaagctgaccaagagcgacagacccgagctgaccggcgccaaggtggtggtgagcggcggcagaggcctgaagagcggcgagaacttcaagctgctgtacgacctggccgaccagctgcacgccgccgtgggcgccagcagagccgccgtggacgccggcttcgtgcccaacgacatgcaggtgggccagaccggcaagatcgtggcccccgagctgtacatcgccgtgggcatcagcggcgccatccagcacctggccggcatgaaggacagcaagaccatcgtggccatcaacaaggaccccgaggcccccatcttccaggtggccgactacggcatcgtggccgacctgttcaaggtggtgcccgagatgaccgagatcctgaagaagaagtag

SEQ ID NO: 80255 - DNA, 768 bp, Artificial Sequence
  Description of Artificial Sequence: Synthetic coding sequence
atggccgagctgagagtgctggtggccgtgaagagagtgatcgactacgccgtgaagatcagagtgaagcccgacagaaccggcgtggtgaccgacggcgtgaagcacagcatgaaccccttctgcgagatcgccgtggaggaggccgtgagactgaaggagaagaagctggtgaaggaggtgatcgccgtgagctgcggccccgcccagtgccaggagaccatcagaaccgccctggccatgggcgccgacagaggcatccacgtggaggtgccccccgccgaggccgagagactgggccccctgcaggtggccagagtgctggccaagctggccgagaaggagaaggtggacctggtgctgctgggcaagcaggccatcgacgacgactgcaaccagaccggccagatgaccgccggcttcctggactggccccagggcaccttcgccagccaggtgaccctggagggcgacaagctgaaggtggagagagagatcgacggcggcctggagaccctgagactgaagctgcccgccgtggtgaccgccgacctgagactgaacgagcccagatacgccaccctgcccaacatcatgaaggccaagaagaagaagatcgaggtgatcaagcccggcgacctgggcgtggacctgaccagcaagctgagcgtgatcagcgtggaggaccccccccagagaaccgccggcgtgaaggtggagaccaccgaggacctggtggccaagctgaaggagatcggcagaatctag

SEQ ID NO: 80256 - DNA, 1041 bp, Artificial Sequence
  Description of Artificial Sequence: Synthetic coding sequence
atgtacctgagcctgtgggtgaccatcaacaccgtgaacctgagaaacaccctgagcggcctgagaggcgccgtgaccaccgtgggcatgatcaagagcgacgtgcccggcacccaggagtggctggacgagagaagaagacagggcgacctgcccctgcccaccaacagcaaccccgtgctgagcctggagctgtgcgaccccggccagggccccgcccccttccaggccgtggtggtgctgatccagcccggcagaggcctggccctgagacccccccccagctgcctgttcccccccgaccccacccccagcccccccgccggccagatcagagtgaagcccgacagaaccggcgtggtgaccgacggcgtgaagcacagcatgaaccccttctgcgagatcgccgtggaggaggccgtgagactgaaggagaagaagctggtgaaggaggtgatcgccgtgagctgcggccccgcccagtgccaggagaccatcagaaccgccctggccatgggcgccgacagaggcatccacgtggaggtgccccccgccgaggccgagagactgggccccctgcaggtggccagagtgctggccaagctggccgagaaggagaaggtggacctggtgctgctgggcaagcaggccatcgacgacgactgcaaccagaccggccagatgaccgccggcttcctggactggccccagggcaccttcgccagccaggtgaccctggagggcgacaagctgaaggtggagagagagatcgacggcggcctggagaccctgagactgaagctgcccgccgtggtgaccgccgacctgagactgaacgagcccagatacgccaccctgcccaacatcatgaaggccaagaagaagaagatcgaggtgatcaagcccggcgacctgggcgtggacctgaccagcaagctgagcgtgatcagcgtggaggaccccccccagagaaccgccggcgtgaaggtggagaccaccgaggacctggtggccaagctgaaggagatcggcagaatctag

SEQ ID NO: 80257 - DNA, 1713 bp, Artificial Sequence
  Description of Artificial Sequence: Synthetic coding sequence
atgctggtgcccctggccaagctgagctgcctgggcgtgaacatggagagattcgccgaggaggccgacgtggtgatcgtgggcgccggccccgccggcctgagcgccgccgtgagactgaagcagctggccgtggcccacgagaaggacatcagagtgtgcctggtggagaaggccgcccagatcggcgcccacaccctgagcggcgcctgcctggaccccggcgccttcaaggagctgttccccgactggaaggagaagggcgcccccctgaacacccccgtgaccgaggacagattcggcatcctgaccgagaagtacagaatccccgtgcccatcctgcccggcctgcccatgaacaaccacggcaactacatcgtgagactgggccacctggtgagctggatgggcgagcaggccgaggccctgggcgtggaggtgtaccccggctacgccgccgccgaggtgctgttccacgacgacggcagcgtgaagggcatcgccaccaacgacgtgggcatccagaaggacggcgcccccaaggccaccttcgagagaggcctggagctgcacgccaaggtgaccatcttcgccgagggctgccacggccacctggccaagcagctgtacaagaagttcgacctgagagccaactgcgagccccagacctacggcatcggcctgaaggagctgtgggtgatcgacgagaagaactggaagcccggcagagtggaccacaccgtgggctggcccctggacagacacacctacggcggcagcttcctgtaccacctgaacgagggcgagcccctggtggccctgggcctggtggtgggcctggactaccagaacccctacctgagccccttcagagagttccagagatggaagcaccaccccagcatcagacccaccctggagggcggcaagagaatcgcctacggcgccagagccctgaacgagggcggcttccagagcatccccaagctgaccttccccggcggcctgctgatcggctgcagccccggcttcatgaacgtgcccaagatcaagggcacccacaccgccatgaagagcggcatcctggccgccgagagcatcttcaaccagctgaccagcgagaacctgcagagcaagaccatcggcctgcacgtgaccgagtacgaggacaacctgaagaacagctgggtgtggaaggagctgtacagcgtgagaaacatcagacccagctgccacggcgtgctgggcgtgtacggcggcatgatctacaccggcatcttctactggatcctgagaggcatggagccctggaccctgaagcacaagggcagcgacttcgagagactgaagcccgccaaggactgcacccccatcgagtaccccaagcccgacggccagatcagcttcgacctgctgagcagcgtggccctgagcggcaccaaccacgagcacgaccagcccgcccacctgaccctgagagacgacagcatccccgtgaacagaaacctgagcatctacgacggccccgagcagagattctgccccgccggcgtgtacgagttcgtgcccgtggagcagggcgacggcttcagactgcagatcaacgcccagaactgcgtgcactgcaagacctgcgacatcaaggaccccagccagaacatcaactgggtggtgcccgagggcggcggcggccccgcctacaacggcatgtag

SEQ ID NO: 80258 - DNA, 1854 bp, Artificial Sequence
  Description of Artificial Sequence: Synthetic coding sequence
atgctggtgcccctggccaagctgagctgcctggcctaccagtgcttccacgccctgaagatcaagaagaactacctgcccctgtgcgccaccagatggagcagcaccagcaccgtgcccagaatcaccacccactacaccatctaccccagagacaaggacaagagatgggagggcgtgaacatggagagattcgccgaggaggccgacgtggtgatcgtgggcgccggccccgccggcctgagcgccgccgtgagactgaagcagctggccgtggcccacgagaaggacatcagagtgtgcctggtggagaaggccgcccagatcggcgcccacaccctgagcggcgcctgcctggaccccggcgccttcaaggagctgttccccgactggaaggagaagggcgcccccctgaacacccccgtgaccgaggacagattcggcatcctgaccgagaagtacagaatccccgtgcccatcctgcccggcctgcccatgaacaaccacggcaactacatcgtgagactgggccacctggtgagctggatgggcgagcaggccgaggccctgggcgtggaggtgtaccccggctacgccgccgccgaggtgctgttccacgacgacggcagcgtgaagggcatcgccaccaacgacgtgggcatccagaaggacggcgcccccaaggccaccttcgagagaggcctggagctgcacgccaaggtgaccatcttcgccgagggctgccacggccacctggccaagcagctgtacaagaagttcgacctgagagccaactgcgagccccagacctacggcatcggcctgaaggagctgtgggtgatcgacgagaagaactggaagcccggcagagtggaccacaccgtgggctggcccctggacagacacacctacggcggcagcttcctgtaccacctgaacgagggcgagcccctggtggccctgggcctggtggtgggcctggactaccagaacccctacctgagccccttcagagagttccagagatggaagcaccaccccagcatcagacccaccctggagggcggcaagagaatcgcctacggcgccagagccctgaacgagggcggcttccagagcatccccaagctgaccttccccggcggcctgctgatcggctgcagccccggcttcatgaacgtgcccaagatcaagggcacccacaccgccatgaagagcggcatcctggccgccgagagcatcttcaaccagctgaccagcgagaacctgcagagcaagaccatcggcctgcacgtgaccgagtacgaggacaacctgaagaacagctgggtgtggaaggagctgtacagcgtgagaaacatcagacccagctgccacggcgtgctgggcgtgtacggcggcatgatctacaccggcatcttctactggatcctgagaggcatggagccctggaccctgaagcacaagggcagcgacttcgagagactgaagcccgccaaggactgcacccccatcgagtaccccaagcccgacggccagatcagcttcgacctgctgagcagcgtggccctgagcggcaccaaccacgagcacgaccagcccgcccacctgaccctgagagacgacagcatccccgtgaacagaaacctgagcatctacgacggccccgagcagagattctgccccgccggcgtgtacgagttcgtgcccgtggagcagggcgacggcttcagactgcagatcaacgcccagaactgcgtgcactgcaagacctgcgacatcaaggaccccagccagaacatcaactgggtggtgcccgagggcggcggcggccccgcctacaacggcatgtag

SEQ ID NO: 80259 - DNA, 1287 bp, Artificial Sequence
  Description of Artificial Sequence: Synthetic coding sequence
atggaccccagcgtgaccctgtggcagttcctgctgcagctgctgagagagcagggcaacggccacatcatcagctggaccagcagagacggcggcgagttcaagctggtggacgccgaggaggtggccagactgtggggcctgagaaagaacaagaccaacatgaactacgacaagctgagcagagccctgagatactactacgacaagaacatcatcagaaaggtgagcggccagaagttcgtgtacaagttcgtgagctaccccgaggtggccggctgcagcaccgaggactgccccccccagcccgaggtgagcgtgaccagcaccatgcccaacgtggcccccgccgccatccacgccgcccccggcgacaccgtgagcggcaagcccggcacccccaagggcgccggcatggccggccccggcggcctggccagaagcagcagaaacgagtacatgagaagcggcctgtacagcaccttcaccatccagagcctgcagccccagccccccccccaccccagacccgccgtggtgctgcccagcgccgcccccgccggcgccgccgccccccccagcggcagcagaagcaccagccccagccccctggaggcctgcctggaggccgaggaggccggcctgcccctgcaggtgatcctgaccccccccgaggcccccaacctgaagagcgaggagctgaacgtggagcccggcctgggcagagccctgccccccgaggtgaaggtggagggccccaaggaggagctggaggtggccggcgagagaggcttcgtgcccgagaccaccaaggccgagcccgaggtgcccccccaggagggcgtgcccgccagactgcccgccgtggtgatggacaccgccggccaggccggcggccacgccgccagcagccccgagatcagccagccccagaagggcagaaagcccagagacctggagctgcccctgagccccagcctgctgggcggccccggccccgagagaacccccggcagcggcagcggcagcggcctgcaggcccccggccccgccctgacccccagcctgctgcccacccacaccctgacccccgtgctgctgacccccagcagcctgccccccagcatccacttctggagcaccctgagccccatcgcccccagaagccccgccaagctgagcttccagttccccagcagcggcagcgcccaggtgcacatccccagcatcagcgtggacggcctgagcacccccgtggtgctgagccccggcccccagaagccctag

SEQ ID NO: 80260 - DNA, 1836 bp, Artificial Sequence
  Description of Artificial Sequence: Synthetic coding sequence
atgcccgagatcgtggacacctgcagcctggccagccccgccagcgtgtgcagaaccaagcacctgcacctgagatgcagcgtggacttcaccagaagaaccctgaccggcaccgccgccctgaccgtgcagagccaggaggacaacctgagaagcctggtgctggacaccaaggacctgaccatcgagaaggtggtgatcaacggccaggaggtgaagtacgccctgggcgagagacagagctacaagggcagccccatggagatcagcctgcccatcgccctgagcaagaaccaggagatcgtgatcgagatcagcttcgagaccagccccaagagcagcgccctgcagtggctgacccccgagcagaccagcggcaaggagcacccctacctgttcagccagtgccaggccatccactgcagagccatcctgccctgccaggacacccccagcgtgaagctgacctacaccgccgaggtgagcgtgcccaaggagctggtggccctgatgagcgccatcagagacggcgagacccccgaccccgaggaccccagcagaaagatctacaagttcatccagaaggtgcccatcccctgctacctgatcgccctggtggtgggcgccctggagagcagacagatcggccccagaaccctggtgtggagcgagaaggagcaggtggagaagagcgcctacgagttcagcgagaccgagagcatgctgaagatcgccgaggacctgggcggcccctacgtgtggggccagtacgacctgctggtgctgccccccagcttcccctacggcggcatggagaacccctgcctgaccttcgtgacccccaccctgctggccggcgacaagagcctgagcaacgtgatcgcccacgagatcagccacagctggaccggcaacctggtgaccaacaagacctgggaccacttctggctgaacgagggccacaccgtgtacctggagagacacatctgcggcagactgttcggcgagaagttcagacacttcaacgccctgggcggctggggcgagctgcagaacagcgtgaagaccttcggcgagacccaccccttcaccaagctggtggtggacctgaccgacatcgaccccgacgtggcctacagcagcgtgccctacgagaagggcttcgccctgctgttctacctggagcagctgctgggcggccccgagatcttcctgggcttcctgaaggcctacgtggagaagttcagctacaagagcatcaccaccgacgactggaaggacttcctgtacagctacttcaaggacaaggtggacgtgctgaaccaggtggactggaacgcctggctgtacagccccggcctgccccccatcaagcccaactacgacatgaccctgaccaacgcctgcatcgccctgagccagagatggatcaccgccaaggaggacgacctgaacagcttcaacgccaccgacctgaaggacctgagcagccaccagctgaacgagttcctggcccagaccctgcagagagcccccctgcccctgggccacatcaagagaatgcaggaggtgtacaacttcaacgccatcaacaacagcgagatcagattcagatggctgagactgtgcatccagagcaagtgggaggacgccatccccctggccctgaagatggccaccgagcagggcagaatgaagttcaccagacccctgttcaaggacctggccgccttcgacaagagccacgaccaggccgtgagaacctaccaggagcacaaggccagcatgcaccccgtgaccgccatgctggtgggcaaggacctgaaggtggactag

SEQ ID NO: 80261 - DNA, 117 bp, Artificial Sequence
  Description of Artificial Sequence: Synthetic coding sequence
atggagagcgccatcaccctgtggcagttcctgctgcagctgctgctggaccagaagcacgagcacctgatctgctggaccagcaacgacggcgagttcaagctgctgaaggcctag

SEQ ID NO: 80262 - DNA, 483 bp, Artificial Sequence
  Description of Artificial Sequence: Synthetic coding sequence
atggagagcgccatcaccctgtggcagttcctgctgcagctgctgctggaccagaagcacgagcacctgatctgctggaccagcaacgacggcgagttcaagctgctgaaggccgaggaggtggccaagctgtggggcctgagaaagaacaagaccaacatgaactacgacaagctgagcagagccctgagatactactacgacaagaacatcatcaagaaggtgatcggccagaagttcgtgtacaagttcgtgagcttccccgagatcctgaagatggacccccacgccgtggagatcagcagagagagcctgctgctgcaggacagcgactgcaaggccagccccgagggcagagaggcccacaagcacggcctggccgccctgagaagcaccagcagaaacgagtacatccacagcggcctgtacagcagcttcaccatcaacagcctgcagaacccccccgacgccttcaaggcctag

SEQ ID NO: 80263 - DNA, 1218 bp, Artificial Sequence
  Description of Artificial Sequence: Synthetic coding sequence
atggacagcgccatcaccctgtggcagttcctgctgcagctgctgcagaagccccagaacaagcacatgatctgctggaccagcaacgacggccagttcaagctgctgcaggccgaggaggtggccagactgtggggcatcagaaagaacaagcccaacatgaactacgacaagctgagcagagccctgagatactactacgtgaagaacatcatcaagaaggtgaacggccagaagttcgtgtacaagttcgtgagctaccccgagatcctgaacatggaccccatgaccgtgggcagaatcgagggcgactgcgagagcctgaacttcagcgaggtgagcagcagcagcaaggacgtggagaacggcggcaaggacaagcccccccagcccggcgccaagaccagcagcagaaacgactacatccacagcggcctgtacagcagcttcaccctgaacagcctgaacagcagcaacgtgaagctgttcaagctgatcaagaccgagaaccccgccgagaagctggccgagaagaagagcccccaggagcccacccccagcgtgatcaagttcgtgaccacccccagcaagaagccccccgtggagcccgtggccgccaccatcagcatcggccccagcatcagccccagcagcgaggagaccatccaggccctggagaccctggtgagccccaagctgcccagcctggaggcccccaccagcgccagcaacgtgatgaccgccttcgccaccaccccccccatcagcagcatcccccccctgcaggagccccccagaacccccagcccccccctgagcagccaccccgacatcgacaccgacatcgacagcgtggccagccagcccatggagctgcccgagaacctgagcctggagcccaaggaccaggacagcgtgctgctggagaaggacaaggtgaacaacagcagcagaagcaagaagcccaagggcctggagctggcccccaccctggtgatcaccagcagcgaccccagccccctgggcatcctgagccccagcctgcccaccgccagcctgacccccgccttcttcagccaggtggcctgcagcctgttcatggtgagccccctgctgagcttcatctgccccttcaagcagatccagaacctgtacacccaggtgtgcttcctgctgctgagattcgtgctggagagactgtgcgtgaccgtgatgtag

SEQ ID NO: 80264 - DNA, 1296 bp, Artificial Sequence
  Description of Artificial Sequence: Synthetic coding sequence
atggacagcgccatcaccctgtggcagttcctgctgcagctgctgcagaagccccagaacaagcacatgatctgctggaccagcaacgacggccagttcaagctgctgcaggccgaggaggtggccagactgtggggcatcagaaagaacaagcccaacatgaactacgacaagctgagcagagccctgagatactactacgtgaagaacatcatcaagaaggtgaacggccagaagttcgtgtacaagttcgtgagctaccccgagatcctgaacatggaccccatgaccgtgggcagaatcgagggcgactgcgagagcctgaacttcagcgaggtgagcagcagcagcaaggacgtggagaacggcggcaaggacaagcccccccagcccggcgccaagaccagcagcagaaacgactacatccacagcggcctgtacagcagcttcaccctgaacagcctgaacagcagcaacgtgaagctgttcaagctgatcaagaccgagaaccccgccgagaagctggccgagaagaagagcccccaggagcccacccccagcgtgatcaagttcgtgaccacccccagcaagaagccccccgtggagcccgtggccgccaccatcagcatcggccccagcatcagccccagcagcgaggagaccatccaggccctggagaccctggtgagccccaagctgcccagcctggaggcccccaccagcgccagcaacgtgatgaccgccttcgccaccaccccccccatcagcagcatcccccccctgcaggagccccccagaacccccagcccccccctgagcagccaccccgacatcgacaccgacatcgacagcgtggccagccagcccatggagctgcccgagaacctgagcctggagcccaaggaccaggacagcgtgctgctggagaaggacaaggtgaacaacagcagcagaagcaagaagcccaagggcctggagctggcccccaccctggtgatcaccagcagcgaccccagccccctgggcatcctgagccccagcctgcccaccgccagcctgacccccgccttcttcagccagacccccatcatcctgacccccagccccctgctgagcagcatccacttctggagcaccctgagccccgtggcccccctgagccccgccagactgcagggcgccaacaccctgttccagttccccagcgtgctgaacagccacggccccttcaccctgagcggcctggacggccccagcacccccggccccttcagccccgacctgcagaagacctag

SEQ ID NO: 80265 - DNA, 1566 bp, Artificial Sequence
  Description of Artificial Sequence: Synthetic coding sequence
agaccccaggaccccagaagaagatgcagagtgagaggcagaggcggcagaggcgccagaagcagaggcggcggcagatgcggcagactgagagcccccggcggcctgggcctggccgccgccgccttctacggcagcgccgccggcgtggccgccgccgccgcccccagcagcagcttccagagagaggaggaggccgagggcggcgaggcccacagagtgagaggcggcgacagaggcggcgcccccagagccgccagcctgatcgccatggacagcgccatcaccctgtggcagttcctgctgcagctgctgcagaagccccagaacaagcacatgatctgctggaccagcaacgacggccagttcaagctgctgcaggccgaggaggtggccagactgtggggcatcagaaagaacaagcccaacatgaactacgacaagctgagcagagccctgagatactactacgtgaagaacatcatcaagaaggtgaacggccagaagttcgtgtacaagttcgtgagctaccccgagatcctgaacatggaccccatgaccgtgggcagaatcgagggcgactgcgagagcctgaacttcagcgaggtgagcagcagcagcaaggacgtggagaacggcggcaaggacaagcccccccagcccggcgccaagaccagcagcagaaacgactacatccacagcggcctgtacagcagcttcaccctgaacagcctgaacagcagcaacgtgaagctgttcaagctgatcaagaccgagaaccccgccgagaagctggccgagaagaagagcccccaggagcccacccccagcgtgatcaagttcgtgaccacccccagcaagaagccccccgtggagcccgtggccgccaccatcagcatcggccccagcatcagccccagcagcgaggagaccatccaggccctggagaccctggtgagccccaagctgcccagcctggaggcccccaccagcgccagcaacgtgatgaccgccttcgccaccaccccccccatcagcagcatcccccccctgcaggagccccccagaacccccagcccccccctgagcagccaccccgacatcgacaccgacatcgacagcgtggccagccagcccatggagctgcccgagaacctgagcctggagcccaaggaccaggacagcgtgctgctggagaaggacaaggtgaacaacagcagcagaagcaagaagcccaagggcctggagctggcccccaccctggtgatcaccagcagcgaccccagccccctgggcatcctgagccccagcctgcccaccgccagcctgacccccgccttcttcagccagacccccatcatcctgacccccagccccctgctgagcagcatccacttctggagcaccctgagccccgtggcccccctgagccccgccagactgcagggcgccaacaccctgttccagttccccagcgtgctgaacagccacggccccttcaccctgagcggcctggacggccccagcacccccggccccttcagccccgacctgcagaagacctag

SEQ ID NO: 80266 - DNA, 807 bp, Artificial Sequence
  Description of Artificial Sequence: Synthetic coding sequence
atgaacggcaccgccaaccccctgctggacagagaggagcactgcctgagactgggcgagagcttcgagaagagacccagagccagcttccacaccatcagatacgacttcaagcccgccagcatcgacaccagctgcgagggcgagctgcaggtgggcaagggcgacgaggtgaccatcaccctgccccacatccccggcagcaccccccccatgaccgtgttcaagggcaacaagagaccctaccagaaggactgcgtgctgatcatcaaccacgacaccggcgagtacgtgctggagaagctgagcagcagcatccaggtgaagaagaccagagccgagggcagcagcaagatccaggccagaatggagcagcagcccaccagacccccccagaccagccagcccccccccccccccccccccatgcccttcagagcccccaccaagccccccgtgggccccaagaccagccccctgaaggacaaccccagccccgagccccagctggacgacatcaagagagagctgagagccgaggtggacatcatcgagcagatgagcagcagcagcggcagcagcagcagcgacagcgagagcagcagcggcagcgacgacgacagcagcagcagcggcggcgaggacaacggccccgccagccccccccagcccagccaccagcagccctacaacagcagacccgccgtggccaacggcaccagcagaccccagggcagcaaccagctgatgaacaccctgagaaacgacctgcagctgagcgagagcggcagcgacagcgacgactag

SEQ ID NO: 80267 - DNA, 504 bp, Artificial Sequence
  Description of Artificial Sequence: Synthetic coding sequence
atgaagagccagctgcactgccacatcagcctggccgagggcagcagcaagatccaggccagaatggagcagcagcccaccagacccccccagaccagccagcccccccccccccccccccccatgcccttcagagcccccaccaagccccccgtgggccccaagaccagccccctgaaggacaaccccagccccgagccccagctggacgacatcaagagagagctgagagccgaggtggacatcatcgagcagatgagcagcagcagcggcagcagcagcagcgacagcgagagcagcagcggcagcgacgacgacagcagcagcagcggcggcgaggacaacggccccgccagccccccccagcccagccaccagcagccctacaacagcagacccgccgtggccaacggcaccagcagaccccagggcagcaaccagctgatgaacaccctgagaaacgacctgcagctgagcgagagcggcagcgacagcgacgactag

SEQ ID NO: 80268 - DNA, 2979 bp, Artificial Sequence
  Description of Artificial Sequence: Synthetic coding sequence
atggccagaggcggcgccgcctgcaagagcgacgccagactgctgctgggcagagacgccctgagacccgcccccgccctgctggcccccgccgtgctgctgggcgccgccctgggcctgggcctgggcctgtggctgggctgcagagccggcagacagagaaccagacaccagaaggacgacacccagaacctgctgaagaacctggagagcaacgcccagacccccagcgagaccggcagccccagcagaagaagaaagagagaggtgcagatgagcaaggacaaggaggccgtggacgagtgcgagccccccagcaacagcaacatcaccgccttcgccctgaaggccaaggtgatctaccccatcaaccagaagttcagacccctggccgacggcagcagcaaccccagcctgcacgagaacctgaagcaggccgtgctgccccaccagcccgtggaggccagccccagcagcagcctgggcagcctgagccagggcgagaaggacgactgcagcagcagcagcagcgtgcacagcgccaccagcgacgacagattcctgagcagaaccttcctgagagtgaacgccttccccgaggtgctggcctgcgagagcgtggacgtggacctgtgcatctacagcctgcacctgaaggacctgctgcacctggacaccgccctgagacaggagaagcacatgatgttcatccagatcttcaagatgtgcctgctggacctgctgcccaagaagaagagcgacgacgagctgtaccagaagatcctgagcaagcaggagaaggacctggaggagctggagaagggcctgcaggtgaagctgagcaacaccgagatgagcggcgccggcgacagcgagtacatcaccctggccgacgtggagaagaaggagagagagtacagcgagcagctgatcgacaacatggaggccttctggaagcagatggccaacatccagcacttcctggtggaccagttcaagtgcagcagcagcaaggccagacagctgatgatgaccctgaccgagagaatgatcgccgccgagggcctgctgtgcgacagccaggagctgcaggccctggacgccctggagagaaccatgggcagagcccacatggccaaggtgatcgagttcctgaagctgcaggtgcaggaggagaccagatgcagactggccgccatcagccacggcctggagctgctggccggcgagggcaagctgagcggcagacagaaggaggagctgctgacccagcagcacaaggccttctggcaggaggccgagagattcagcagagagttcgtgcagagaggcaaggacctggtgaccgccagcctggcccaccaggtggagggcaccgccaagctgaccctggcccaggaggaggagcagagaagcttcctggccgaggcccagcccaccgccgaccccgagaagttcctggaggccttccacgaggtgctggagagacagagactgatgcagtgcgacctggaggaggaggagaacgtgagagccaccgaggccgtggtggccctgtgccaggagctgtacttcagcaccgtggacaccttccagaagttcgtggacgccctgttcctgcagaccctgcccggcatgaccggcctgccccccgaggagtgcgactacctgagacaggaggtgcaggagaacgccgcctggcagctgggcaagagcaacagattcagaagacagcagtggaagctgttccaggagctgctggagcaggaccagcaggtgtggatggaggagtgcgccctgagcagcgtgctgcagacccacctgagagaggaccacgagggcaccatcagaggcgtgctgggcagactgggcggcctgaccgaggagagcaccagatgcgtgctgcagggccacgacctgctgctgagaagcgccctgagaagactggccctgagaggcaacgccctggccaccctgacccagatgagactgagcggcaagaagcacctgctgcaggagctgagagagcagagagccctggagcagggcagcagccagtgcctggacgagcaccagtggcagctgctgagagccctggaggccagagtgctggaggaggccagcagactggaggaggaggcccagcagaccagactgcagctgcagcagagactgctggccgaggcccaggaggtgggccagctgctgcagcagcacatggagtgcgccatcggccaggccctgctggtgcacgccagaaacgccgccaccaagagcagagccaaggacagagacgacttcaagagaaccctgatggaggccgccgtggagagcgtgtacgtgaccagcgccggcgtgagcagactggtgcaggcctactaccagcagatcggcagaatcatggaggaccacgaggagagaaagctgcagcacctgaagaccctgcagggcgagagaatggagaactacaagctgagaaagaagcaggagctgagcaaccccagcagcggcagcagaaccgccggcggcgcccacgagaccagccaggccgtgcaccagagaatgctgagccagcagaagagattcctggcccagttccccgtgcaccagcagatgagactgcacgcccagcagcagcaggccggcgtgatggacctgctggaggcccagctggagacccagctgcaggaggccgagcagaacttcatcagcgagctggccgccctggccagagtgcccctggccgagagcaagctgctgcccgccaagagaggcctgctggagaagcccctgagaaccaagagaaagaagcccctgccccaggagagaggcgacctgggcgtgcccaacaacgaggacctggccagcggcgaccagaccagcggcagcctgagcagcaagagactgagccagcaggagagcgaggccggcgacagcggcaacagcaagaagatgctgaagagaagaagcaacctgtag

SEQ ID NO: 80269 - DNA, 2979 bp, Artificial Sequence; identical to SEQ ID NO: 80268
  Description of Artificial Sequence: Synthetic coding sequence

SEQ ID NO: 80270 - DNA, 3687 bp, Artificial Sequence
  Description of Artificial Sequence: Synthetic coding sequence
atgatctggcccaaggtggagtgctgccacttcaagaccgccgtggaggcccccctgggcatgaagctggacaagaagatggaggtgttcatccccctgagcaccagcgccgccagcagcggcccctgggcccacagcctgttcgccttcatccccagctggcccaagaagaacctgttcaagagagagagccccatcacccacagactgtacggcgacatcagcagagaggtgcagggcaccagcgagaacggcgtgatcttccagaagtgcgccctggtgagcggcagcagcgaggcccagaccgccagaatctggctgctggtgaacaacaccaagaccaccagcagcgccaacctgagcgagctgctgctgctggacagcatcgccggcctgaccatctgggacagcgtgggcaacagaaccagcgagggcttccaggccttcagcaagaagttcctgcaggtgggcgacgccttcgccgtgagctacgccgccaccctgcaggccggcgacctgggcaacggcgagagcctgaagctgcccgcccagctgaccttccagagcagcagcagaaacagaacccagctgaaggtgctgttcagcatcaccgccgaggagaacgtgaccgtgctgccccaccacggcctgcacgccgccggcttcttcatcgccttcctgctgagcctggtgctgacctgggccgccctgttcctgatggtgagataccagtgcctgaagggcaacatgctgaccagacacagagtgtggcagtacgagagcaagctggagcccctgcccttcaccagcgccgacggcgtgaacgaggacctgagcctgaacgaccagatgatcgacatcctgagcagcgaggaccccggcagcatgctgcaggccctggaggagctggagatcgccaccctgaacagagccgacgccgacctggaggcctgcagaacccagatcagcaaggacatcatcgccctgctgctgaagaacctgaccagcagcggccacctgagcccccaggtggagagaaagatgagcgccgtgttcaagaagcagttcctgctgctggagaacgagatccaggaggagtacgacagaaagatggtggccctgaccgccgagtgcgacctggagaccagaaagaagatggagaaccagtaccagagagagatgatggccatggaggaggccgaggagctgctgaagagagccggcgagagaagcgccgtggagtgcagcaacctgctgagaaccctgcacggcctggagcaggagcacctgagaaagagcctggccctgcagcaggaggaggacttcgccaaggcccacagacagctggccgtgttccagagaaacgagctgcacagcatcttcttcacccagatcaagagcgccatcttcaagggcgagctgaagcccgaggccgccaagatgctgctgcagaactacagcaagatccaggagaacgtggaggagctgatggacttcttccaggccagcaagagataccacctgagcaagagattcggccacagagagtacctggtgcagaacctgcagagcagcgagaccagagtgcagggcctgctgagcaccgccgccgcccagctgacccacctgatccagaagcacgagagagccggctacctggacgaggaccagatggagatgctgctggagagagcccagaccgaggtgttcagcatcaagcagaagctggacaacgacctgaagcaggagaagaagaagctgcaccagaagctgatcaccaagagaagaagagagctgctgcagaagcacagagagcagagaagagagcaggccagcgtgggcgaggccttcagaaccgtggaggacgccggccagtacctgcaccagaagagaagcctgatggaggagcacggcgccaccctggaggagctgcaggagagactggaccaggccgccctggacgacctgagaaccctgaccctgagcctgttcgagaaggccaccgacgagctgagaagactgcagaacagcgccatgacccaggagctgctgaagagaggcgtgccctggctgttcctgcagcagatcctggaggagcacggcaaggagatggccgccagagccgagcagctggagggcgaggagagagacagagaccaggagggcgtgcagagcgtgagacagagactgaaggacgacgcccccgaggccgtgaccgaggagcaggccgagctgagaagatgggagcacctgatcttcatgaagctgtgcagcagcgtgttcagcctgagcgaggaggagctgctgagaatgagacaggaggtgcacggctgcttcgcccagatggacagaagcctggccctgcccaagatcagagccagagtgctgctgcagcagttccagaccgcctggagagaggccgagttcgtgaagctggaccaggccgtggccgcccccgagctgcagcagcagagcaaggtgagaaagagcagaagcaagagcaagagcaagggcgagctgctgaagaagtgcatcgaggacaagatccacctgtgcgaggagcaggccagcgaggacctggtggagaaggtgagaggcgagctgctgagagagagagtgcagagaatggaggcccaggagggcggcttcgcccagagcctggtggccctgcagttccagaaggccagcagagtgaccgagaccctgagcgcctacaccgccctgctgagcatccaggacctgctgctggaggagctgagcgccagcgagatgctgaccaagagcgcctgcacccagatcctggagagccacagcagagagctgcaggagctggagagaaagctggaggaccagctggtgcagcaggaggccgcccagcagcagcaggccctggccagctggcagcagtgggtggccgacggccccggcatcctgaacgagcccggcgaggtggacagcgagagacaggtgagcaccgtgctgcaccaggccctgagcaagagccagaccctgctggagcagcaccagcagtgcctgagagaggagcagcagaacagcgtggtgctggaggacctgctggagaacatggaggccgacaccttcgccaccctgtgcagccaggagctgagactggccagctacctggccagaatggccatggtgcccggcgccaccctgagaagactgctgagcgtggtgctgcccaccgccagccagccccagctgctggccctgctggacagcgccaccgagagacacgtggaccacgccgccgagagcgacggcggcgccgagcaggccgacgtgggcagaagaagaaagcaccagagctggtggcaggccctggacggcaagctgagaggcgacctgatcagcagaggcctggagaagatgctgtgggccagaaagagaaagcagagcatcctgaagaagacctgcctgcccctgagagagagaatgatcttcagcggcaagggcagctggccccacctgagcctggagcccatcggcgagctggcccccgtgcccatcgtgggcgccgagaccatcgacctgctgaacaccggcgagaagctgttcatcttcagaaaccccaaggagcccgagatcagcctgcacgtgccccccagaaagaagaagaacttcctgaacgccaagaaggccatgagagccctgggcatggactag

SEQ ID NO: 80271 - DNA, 3927 bp, Artificial Sequence
  Description of Artificial Sequence: Synthetic coding sequence
atggaccccagcggcagcagaggcagacccacctgggtgctggccggcggcctgctggccgtggccctggccctgggcggcagaggctgcctgggcgccagcagcagacccagatggagacccctgggcgcccagccccccagagacccccaggtggcccccagaagcggccccggcctgagaatcccccccggcagaagcggcgccggccccgagagcagcacccaggacctgccctgcatgatctggcccaaggtggagtgctgccacttcaagaccgccgtggaggcccccctgggcatgaagctggacaagaagatggaggtgttcatccccctgagcaccagcgccgccagcagcggcccctgggcccacagcctgttcgccttcatccccagctggcccaagaagaacctgttcaagagagagagccccatcacccacagactgtacggcgacatcagcagagaggtgcagggcaccagcgagaacggcgtgatcttccagaagtgcgccctggtgagcggcagcagcgaggcccagaccgccagaatctggctgctggtgaacaacaccaagaccaccagcagcgccaacctgagcgagctgctgctgctggacagcatcgccggcctgaccatctgggacagcgtgggcaacagaaccagcgagggcttccaggccttcagcaagaagttcctgcaggtgggcgacgccttcgccgtgagctacgccgccaccctgcaggccggcgacctgggcaacggcgagagcctgaagctgcccgcccagctgaccttccagagcagcagcagaaacagaacccagctgaaggtgctgttcagcatcaccgccgaggagaacgtgaccgtgctgccccaccacggcctgcacgccgccggcttcttcatcgccttcctgctgagcctggtgctgacctgggccgccctgttcctgatggtgagataccagtgcctgaagggcaacatgctgaccagacacagagtgtggcagtacgagagcaagctggagcccctgcccttcaccagcgccgacggcgtgaacgaggacctgagcctgaacgaccagatgatcgacatcctgagcagcgaggaccccggcagcatgctgcaggccctggaggagctggagatcgccaccctgaacagagccgacgccgacctggaggcctgcagaacccagatcagcaaggacatcatcgccctgctgctgaagaacctgaccagcagcggccacctgagcccccaggtggagagaaagatgagcgccgtgttcaagaagcagttcctgctgctggagaacgagatccaggaggagtacgacagaaagatggtggccctgaccgccgagtgcgacctggagaccagaaagaagatggagaaccagtaccagagagagatgatggccatggaggaggccgaggagctgctgaagagagccggcgagagaagcgccgtggagtgcagcaacctgctgagaaccctgcacggcctggagcaggagcacctgagaaagagcctggccctgcagcaggaggaggacttcgccaaggcccacagacagctggccgtgttccagagaaacgagctgcacagcatcttcttcacccagatcaagagcgccatcttcaagggcgagctgaagcccgaggccgccaagatgctgctgcagaactacagcaagatccaggagaacgtggaggagctgatggacttcttccaggccagcaagagataccacctgagcaagagattcggccacagagagtacctggtgcagaacctgcagagcagcgagaccagagtgcagggcctgctgagcaccgccgccgcccagctgacccacctgatccagaagcacgagagagccggctacctggacgaggaccagatggagatgctgctggagagagcccagaccgaggtgttcagcatcaagcagaagctggacaacgacctgaagcaggagaagaagaagctgcaccagaagctgatcaccaagagaagaagagagctgctgcagaagcacagagagcagagaagagagcaggccagcgtgggcgaggccttcagaaccgtggaggacgccggccagtacctgcaccagaagagaagcctgatggaggagcacggcgccaccctggaggagctgcaggagagactggaccaggccgccctggacgacctgagaaccctgaccctgagcctgttcgagaaggccaccgacgagctgagaagactgcagaacagcgccatgacccaggagctgctgaagagaggcgtgccctggctgttcctgcagcagatcctggaggagcacggcaaggagatggccgccagagccgagcagctggagggcgaggagagagacagagaccaggagggcgtgcagagcgtgagacagagactgaaggacgacgcccccgaggccgtgaccgaggagcaggccgagctgagaagatgggagcacctgatcttcatgaagctgtgcagcagcgtgttcagcctgagcgaggaggagctgctgagaatgagacaggaggtgcacggctgcttcgcccagatggacagaagcctggccctgcccaagatcagagccagagtgctgctgcagcagttccagaccgcctggagagaggccgagttcgtgaagctggaccaggccgtggccgcccccgagctgcagcagcagagcaaggtgagaaagagcagaagcaagagcaagagcaagggcgagctgctgaagaagtgcatcgaggacaagatccacctgtgcgaggagcaggccagcgaggacctggtggagaaggtgagaggcgagctgctgagagagagagtgcagagaatggaggcccaggagggcggcttcgcccagagcctggtggccctgcagttccagaaggccagcagagtgaccgagaccctgagcgcctacaccgccctgctgagcatccaggacctgctgctggaggagctgagcgccagcgagatgctgaccaagagcgcctgcacccagatcctggagagccacagcagagagctgcaggagctggagagaaagctggaggaccagctggtgcagcaggaggccgcccagcagcagcaggccctggccagctggcagcagtgggtggccgacggccccggcatcctgaacgagcccggcgaggtggacagcgagagacaggtgagcaccgtgctgcaccaggccctgagcaagagccagaccctgctggagcagcaccagcagtgcctgagagaggagcagcagaacagcgtggtgctggaggacctgctggagaacatggaggccgacaccttcgccaccctgtgcagccaggagctgagactggccagctacctggccagaatggccatggtgcccggcgccaccctgagaagactgctgagcgtggtgctgcccaccgccagccagccccagctgctggccctgctggacagcgccaccgagagacacgtggaccacgccgccgagagcgacggcggcgccgagcaggccgacgtgggcagaagaagaaagcaccagagctggtggcaggccctggacggcaagctgagaggcgacctgatcagcagaggcctggagaagatgctgtgggccagaaagagaaagcagagcatcctgaagaagacctgcctgcccctgagagagagaatgatcttcagcggcaagggcagctggccccacctgagcctggagcccatcggcgagctggcccccgtgcccatcgtgggcgccgagaccatcgacctgctgaacaccggcgagaagctgttcatcttcagaaaccccaaggagcccgagatcagcctgcacgtgccccccagaaagaagaagaacttcctgaacgccaagaaggccatgagagccctgggcatggactag

SEQ ID NO: 80272 - DNA, 3741 bp, Artificial Sequence
  Description of Artificial Sequence: Synthetic coding sequence
atggaccccagcggcagcagaggcagacccacctgggtgctggccggcggcctgctggccgtggccctggccctgggcggcagaggctgcctgggcgccagcagcagacccagatggagacccctgggcgcccagccccccagagacccccaggtggcccccagaagcggccccggcctgagaatcccccccggcagaagcggcgccggccccgagagcagcacccaggacctgccctgcatgatctggcccaaggtggagtgctgccacttcaagaccgccgtggaggcccccctgggcatgaagctggacaagaagatggaggtgttcatccccctgagcaccagcgccgccagcagcggcccctgggcccacagcctgttcgccttcatccccagctggcccaagaagaacctgttcaagagagagagccccatcacccacagactgtacggcgacatcagcagagaggtgcagggcaccagcgagaacggcgtgatcttccagaagtgcgccctggtgagcggcagcagcgaggcccagaccgccagaatctggctgctggtgaacaacaccaagaccaccagcagcgccaacctgagcgagctgctgctgctggacagcatcgccggcctgaccatctgggacagcgtgggcaacagaaccagcgagggcttccaggccttcagcaagaagttcctgcaggtgggcgacgccttcgccgtgagctacgccgccaccctgcaggccggcgacctgggcaacggcgagagcctgaagctgcccgcccagctgaccttccagagcagcagcagaaacagaacccagctgaaggtgctgttcagcatcaccgccgaggagaacgtgaccgtgctgccccaccacggcctgcacgccgccggcttcttcatcgccttcctgctgagcctggtgctgacctgggccgccctgttcctgatggtgagataccagtgcctgaagggcaacatgctgaccagacacagagtgtggcagtacgagagcaagctggagcccctgcccttcaccagcgccgacggcgtgaacgaggacctgagcctgaacgaccagatgatcgacatcctgagcagcgaggaccccggcagcatgctgcaggccctggaggagctggagatcgccaccctgaacagagccgacgccgacctggaggcctgcagaacccagatcagcaaggacatcatcgccctgctgctgaagaacctgaccagcagcggccacctgagcccccaggtggagagaaagatgagcgccgtgttcaagaagcagttcctgctgctggagaacgagatccaggaggagtacgacagaaagatggtggccctgaccgccgagtgcgacctggagaccagaaagaagatggagaaccagtaccagagagagatgatggccatggaggaggccgaggagctgctgaagagagccggcgagagaagcgccgtggagtgcagcaacctgctgagaaccctgcacggcctggagcaggagcacctgagaaagagcctggccctgcagcaggaggaggacttcgccaaggcccacagacagctggccgtgttccagagaaacgagctgcacagcatcttcttcacccagatcaagagcgccatcttcaagggcgagctgaagcccgaggccgccaagatgctgctgcagaactacagcaagatccaggagaacgtggaggagctgatggacttcttccaggccagcaagagataccacctgagcaagagattcggccacagagagtacctggtgcagaacctgcagagcagcgagaccagagtgcagggcctgctgagcaccgccgccgcccagctgacccacctgatccagaagcacgagagagccggctacctggacgaggaccagatggagatgctgctggagagagcccagaccgaggtgttcagcatcaagcagaagctggacaacgacctgaagcaggagaagaagaagctgcaccagaagctgatcaccaagagaagaagagagctgctgcagaagcacagagagcagagaagagagcaggccagcgtgggcgaggccttcagaaccgtggaggacgccggccagtacctgcaccagaagagaagcctgatggaggagcacggcgccaccctggaggagctgcaggagagactggaccaggccgccctggacgacctgagaaccctgaccctgagcctgttcgagaaggccaccgacgagctgagaagactgcagaacagcgccatgacccaggagctgctgaagagaggcgtgccctggctgttcctgcagcagatcctggaggagcacggcaaggagatggccgccagagccgagcagctggagggcgaggagagagacagagaccaggagggcgtgcagagcgtgagacagagactgaaggacgacgcccccgaggccgtgaccgaggagcaggccgagctgagaagatgggagcacctgatcttcatgaagctgtgcagcagcgtgttcagcctgagcgaggaggagctgctgagaatgagacaggaggtgcacggctgcttcgcccagatggacagaagcctggccctgcccaagatcagagccagagtgctgctgcagcagttccagaccgcctggagagaggccgagttcgtgaagctggaccaggccgtggccgcccccgagctgcagcagcagagcaaggtgagaaagagcagaagcaagagcaagagcaagggcgagctgctgaagaagtgcatcgaggacaagatccacctgtgcgaggagcaggccagcgaggacctggtggagaaggtgagaggcgagctgctgagagagagagtgcagagaatggaggcccaggagggcggcttcgcccagagcctggtggccctgcagttccagaaggccagcagagtgaccgagaccctgagcgcctacaccgccctgctgagcatccaggacctgctgctggaggagctgagcgccagcgagatgctgaccaagagcgcctgcacccagatcctggagagccacagcagagagctgcaggagctggagagaaagctggaggaccagctggtgcagcaggaggccgcccagcagcagcaggccctggccagctggcagcagtgggtggccgacggccccggcatcctgaacgagcccggcgaggtggacagcgagagacaggtgagcaccgtgctgcaccaggccctgagcaagagccagaccctgctggagcagcaccagcagtgcctgagagaggagcagcagaacagcgtggtgctggaggacctgctggagaacatggaggccgacaccttcgccaccctgtgcagccaggagctgagactggccagctacctggccagaatggccatggtgcccggcgccaccctgagaagactgctgagcgtggtgctgcccaccgccagccagccccagctgctggccctgctggacagcgccaccgagagacacgtggaccacgccgccgagagcgacggcggcgccgagcaggccgacgtgggcagaagaagaaagcaccagagctggtggcaggccctggacggcaagctgagaggcgacctgatcagcagaggcctggagaagatgctgtgggccagaaagagaaagcagagaagcggcaaccaggagagcttctggcagtacctggtgggcacccccgagatcggcctgatcgagtggatgagcgagaagtag

SEQ ID NO: 80273 - DNA, 882 bp, Artificial Sequence
  Description of Artificial Sequence: Synthetic coding sequence
atgttcatcagcctgtgggagttcttctacggccacttcttcagattctggatgaagtggctgctgagacagatgaccggcaagtgcgagctgcagagaatcttcgacacctacgtgggcgcccagagaacccacagaatcgagaacagcctgacctacagcaagaacaaggtgctgcagaaggccacccacgtggtgcagagcgaggtggacaagtacgtggacgacatcatgaaggagaagaacatcaaccccgagaaggacgccagcttcaagatctgcatgaagatgtgcctgctgcagatcaccggctacaagcagctgtacctggacgtggagagcgtgagaaagagaccctacgacagcgacaacctgcagcacgaggagctgctgatgaagctgtggaacctgctgatgcccaccaagaagctgaacgccagaatcagcaagcagtgggccgagatcggcttccagggcgacgaccccaagaccgacttcagaggcatgggcatcctgggcctgatcaacctggtgtacttcagcgagaactacaccagcgaggcccaccagatcctgagcagaagcaaccaccccaagctgggctacagctacgccatcgtgggcatcaacctgaccgagatggcctacagcctgctgaagagcgaggccctgaagttccacctgtacaacctggtgcccggcatccccaccatggagcacttccaccagttctactgctacctggtgtacgagttcgacaagttctggttcgaggaggagcccgagagcatcatgtacttcaacctgtacagagagaagttccacgagaagatcaagggcctgctgctggactgcaacgtggccctgaccctgaaggtgtag

SEQ ID NO: 80274 - DNA, 507 bp, Artificial Sequence
  Description of Artificial Sequence: Synthetic coding sequence
atgttcatcagcctgtgggagttcttctacggccacttcttcagattctggatgaagtggctgctgagacagatgaccggcaagtgcgagctgcagagaatcttcgacacctacgtgggcgcccagagaacccacagaatcgagaacagcctgacctacagcaagaacaaggtgctgcagaaggccacccacgtggtgcagagcgaggtggacaagtacgtggacgacatcatgaaggagaagaacatcaaccccgagaaggacgccagcttcaagatctgcatgaagatgtgcctgctgcagatcaccggctacaagcagctgtacctggacgtggagagcgtgagaaagagaccctacgacagcgacaacctgcagcacgaggagctgctgatgaagctgtggaacctgctgatgcccaccaagaagctgaacgccagaatcagcaagcagtgggccgagatcggcttccagggcgacgaccccaagaccgacttcagaggctag

SEQ ID NO: 80275 - DNA, 108 bp, Artificial Sequence
  Description of Artificial Sequence: Synthetic coding sequence
atgttcatcagcctgtgggagttcttctacggccacttcttcagattctggatgaagtggctgctgagacagatgaccggcaagtgcgagctgcagagaatcttctag

SEQ ID NO: 80276 - DNA, 1866 bp, Artificial Sequence
  Description of Artificial Sequence: Synthetic coding sequence
atggccgccctgaaggaggacagaagctacggcctgagctgcggcagagtgagcgacggcagcaaggtgagcgtgttccacgtgaagctgaccgacagcgccctgagagccttcgagagctacagagccagacaggacagcgtgagcctgagacccagcatcagattccagggcagccagggccacatcagcatcccccagcccgactgccccgccgaggccagaaccttcagcttctacctgagcaacatcggcagagacaacccccagggcagcttcgactgcatccagcagtacgtgagcagccacggcgaggtgcacctggactgcctgggcagcatccaggacaagatcaccgtgtgcgccaccgacgacagctaccagaaggccagacagagcatggcccaggccgaggaggagaccagaagcagaagcgccatcgtgatcaaggccggcggcagatacctgggcaagaaggtgcagttcagaaagcccgcccccggcgccaccgacgccgtgcccagcagaaagagagccacccccatcaacctggccagcgccatcagaaagagcggcgccagcgccgtgagcggcggcagcggcgtgagccagagacccttcagagacagagtgctgcacctgctggccctgagaccctacagaaaggccgagctgctgctgagactgcagaaggacggcctgacccaggccgacaaggacgccctggacggcctgctgcagcaggtggccaacatgagcgccaaggacggcacctgcaccctgcaggactgcatgtacaaggacgtgcagaaggactggcccggctacagcgagggcgaccagcagctgctgaagagagtgctggtgagaaagctgtgccagccccagagcaccggcagcctgctgggcgaccccgccgccagcagcccccccggcgagagaggcagaagcgccagccccccccagaagagactgcagccccccgacttcatcgaccccctggccaacaagaagcccagaatcagccacttcacccagagagcccagcccgccgtgaacggcaagctgggcgtgcccaacggcagagaggccctgctgcccacccccggcccccccgccagcaccgacaccctgagcagcagcacccacctgccccccagactggagccccccagagcccacgaccccctggccgacgtgagcaacgacctgggccacagcggcagagactgcgagcacggcgaggccgccgcccccgcccccaccgtgagactgggcctgcccctgctgaccgactgcgcccagcccagcagaccccacggcagccccagcagaagcaagcccaagaagaagagcaagaagcacaaggacaaggagagagccgccgaggacaagcccagagcccagctgcccgactgcgcccccgccacccacgccacccccggcgcccccgccgacacccccggcctgaacggcacctgcagcgtgagcagcgtgcccaccagcaccagcgagacccccgactacctgctgaagtacgccgccatcagcagcagcgagcagagacagagctacaagaacgacttcaacgccgagtacagcgagtacagagacctgcacgccagaatcgagagaatcaccagaagattcacccagctggacgcccagctgagacagctgagccagggcagcgaggagtacgagaccaccagaggccagatcctgcaggagtacagaaagatcaagaagaccaacaccaactacagccaggagaagcacagatgcgagtacctgcacagcaagctggcccacatcaagagactgatcgccgagtacgaccagagacagctgcaggcctggccctag

SEQ ID NO: 80277 - DNA, 90 bp, Artificial Sequence
  Description of Artificial Sequence: Synthetic coding sequence
atccacagactggtggtggccttccaggacagcgtgagcctgagacccagcatcagattccagggcagccagggcgagatgagcctgtag

SEQ ID NO: 80278 - DNA, 1194 bp, Artificial Sequence
  Description of Artificial Sequence: Synthetic coding sequence
atggaggagctgcaggagcccctgagaggccagctgagactgtgcttcacccaggccgccagaaccagcctgctgctgctgagactgaacgacgccgccctgagagccctgcaggagtgccagagacagcaggtgagacccgtgatcgccttccagggccacagaggctacctgagactgcccggccccggctggagctgcctgttcagcttcatcgtgagccagtgctgccaggagggcgccggcggcagcctggacctggtgtgccagagattcctgagaagcggccccaacagcctgcactgcctgggcagcctgagagagagactgatcatctgggccgccatggacagcatccccgcccccagcagcgtgcagggccacaacctgaccgaggacgccagacaccccgagagctggcagaacaccggcggctacagcgagggcgacgccgtgagccagccccagatggccctggaggaggtgagcgtgagcgaccccctggccagcaaccagggccagagcctgcccggcagcagcagagagcacatggcccagtgggaggtgagaagccagacccacgtgcccaacagagagcccgtgcaggccctgcccagcagcgccagcagaaagagactggacaagaagagaagcgtgcccgtggccaccgtggagctggaggagaagagattcagaaccctgcccctggtgcccagccccctgcagggcctgaccaaccaggacctgcaggagggcgaggactgggagcaggaggacgaggacatggaccccagactggagcacagcagcagcgtgcaggaggacagcgagagccccagccccgaggacatccccgactacctgctgcagtacagagccatccacagcgccgagcagcagcacgcctacgagcaggacttcgagaccgactacgccgagtacagaatcctgcacgccagagtgggcaccgccagccagagattcatcgagctgggcgccgagatcaagagagtgagaagaggcacccccgagtacaaggtgctggaggacaagatcatccaggagtacaagaagttcagaaagcagtaccccagctacagagaggagaagagaagatgcgagtacctgcaccagaagctgagccacatcaagggcctgatcctggagttcgaggagaagaacagaggcagctag

SEQ ID NO: 80279 - DNA, 2889 bp, Artificial Sequence
  Description of Artificial Sequence: Synthetic coding sequence
atggacaccgacctgtacgacgagttcggcaactacatcggccccgagctggacagcgacgaggacgacgacgagctgggcagagagaccaaggacctggacgagatggacgacgacgacgacgacgacgacgtgggcgaccacgacgacgaccaccccggcatggaggtggtgctgcacgaggtgtacggccccgaggtggagaccatcgtgcaggaggaggacacccagcccctgaccgagcccatcatcaagcccgtgaagaccaagaagttcaccctgatggagcagaccctgcccgtgaccgtgtacgagatggacttcctggccgacctgatggacaacagcgagctgatcagaaacgtgaccctgtgcggccacctgcaccacggcaagacctgcttcgtggactgcctgatcgagcagacccaccccgagatcagaaagagatacgaccaggacctgtgctacaccgacatcctgttcaccgagcaggagagaggcgtgggcatcaagagcacccccgtgaccgtggtgctgcccgacaccaagggcaagagctacctgttcaacatcatggacacccccggccacgtgaacttcagcgacgaggtgaccgccggcctgagaatcagcgacggcgtggtgctgttcatcgacgccgccgagggcgtgatgctgaacaccgagagactgatcaagcacgccgtgcaggagagactggccgtgaccgtgtgcatcaacaagatcgacagactgatcctggagctgaagctgccccccaccgacgcctactacaagctgagacacatcgtggacgaggtgaacggcctgatcagcatgtacagcaccgacgagaacctgatcctgagccccctgctgggcaacgtgtgcttcagcagcagccagtacagcatctgcttcaccctgggcagcttcgccaagatctacgccgacaccttcggcgacatcaactaccaggagttcgccaagagactgtggggcgacatctacttcaaccccaagaccagaaagttcaccaagaaggcccccaccagcagcagccagagaagcttcgtggagttcatcctggagcccctgtacaagatcctggcccaggtggtgggcgacgtggacaccagcctgcccagaaccctggacgagctgggcatccacctgaccaaggaggagctgaagctgaacatcagacccctgctgagactggtgtgcaagaagttcttcggcgagttcaccggcttcgtggacatgtgcgtgcagcacatccccagccccaaggtgggcgccaagcccaagatcgagcacacctacaccggcggcgtggacagcgacctgggcgaggccatgagcgactgcgaccccgacggccccctgatgtgccacaccaccaagatgtacagcaccgacgacggcgtgcagttccacgccttcggcagagtgctgagcggcaccatccacgccggccagcccgtgaaggtgctgggcgagaactacaccctggaggacgaggaggacagccagatctgcaccgtgggcagactgtggatcagcgtggccagataccacatcgaggtgaacagagtgcccgccggcaactgggtgctgatcgagggcgtggaccagcccatcgtgaagaccgccaccatcaccgagcccagaggcaacgaggaggcccagatcttcagacccctgaagttcaacaccaccagcgtgatcaagatcgccgtggagcccgtgaaccccagcgagctgcccaagatgctggacggcctgagaaaggtgaacaagagctaccccagcctgaccaccaaggtggaggagagcggcgagcacgtgatcctgggcaccggcgagctgtacctggactgcgtgatgcacgacctgagaaagatgtacagcgagatcgacatcaaggtggccgaccccgtggtgaccttctgcgagaccgtggtggagaccagcagcctgaagtgcttcgccgagacccccaacaagaagaacaagatcaccatgatcgccgagcccctggagaagggcctggccgaggacatcgagaacgaggtggtgcagatcacctggaacagaaagaagctgggcgagttcttccagaccaagtacgactgggacctgctggccgccagaagcatctgggccttcggccccgacgccaccggccccaacatcctggtggacgacaccctgcccagcgaggtggacaaggccctgctgggcagcgtgaaggacagcatcgtgcagggcttccagtggggcaccagagagggccccctgtgcgacgagctgatcagaaacgtgaagttcaagatcctggacgccgtggtggcccaggagcccctgcacagaggcggcggccagatcatccccaccgccagaagagtggtgtacagcgccttcctgatggccacccccagactgatggagccctactacttcgtggaggtgcaggcccccgccgactgcgtgagcgccgtgtacaccgtgctggccagaagaagaggccacgtgacccaggacgcccccatccccggcagccccctgtacaccatcaaggccttcatccccgccatcgacagcttcggcttcgagaccgacctgagaacccacacccagggccaggccttcagcctgagcgtgttccaccactggcagatcgtgcccggcgaccccctggacaagagcatcgtgatcagacccctggagccccagcccgccccccacctggccagagagttcatgatcaagaccagaagaagaaagggcctgagcgaggacgtgagcatcagcaagttcttcgacgaccccatgctgctggagctggccaagcaggacgtggtgctgaactaccccatgtag

SEQ ID NO: 80280 - DNA, 2814 bp, Artificial Sequence
  Description of Artificial Sequence: Synthetic coding sequence
atggacgacgacgacgacgacgacgacgtgggcgaccacgacgacgaccaccccggcatggaggtggtgctgcacgaggacaagaagtactaccccaccgccgaggaggtgtacggccccgaggtggagaccatcgtgcaggaggaggacacccagcccctgaccgagcccatcatcaagcccgtgaagaccaagaagttcaccctgatggagcagaccctgcccgtgaccgtgtacgagatggacttcctggccgacctgatggacaacagcgagctgatcagaaacgtgaccctgtgcggccacctgcaccacggcaagacctgcttcgtggactgcctgatcgagcagacccaccccgagatcagaaagagatacgaccaggacctgtgctacaccgacatcctgttcaccgagcaggagagaggcgtgggcatcaagagcacccccgtgaccgtggtgctgcccgacaccaagggcaagagctacctgttcaacatcatggacacccccggccacgtgaacttcagcgacgaggtgaccgccggcctgagaatcagcgacggcgtggtgctgttcatcgacgccgccgagggcgtgatgctgaacaccgagagactgatcaagcacgccgtgcaggagagactggccgtgaccgtgtgcatcaacaagatcgacagactgatcctggagctgaagctgccccccaccgacgcctactacaagctgagacacatcgtggacgaggtgaacggcctgatcagcatgtacagcaccgacgagaacctgatcctgagccccctgctgggcaacgtgtgcttcagcagcagccagtacagcatctgcttcaccctgggcagcttcgccaagatctacgccgacaccttcggcgacatcaactaccaggagttcgccaagagactgtggggcgacatctacttcaaccccaagaccagaaagttcaccaagaaggcccccaccagcagcagccagagaagcttcgtggagttcatcctggagcccctgtacaagatcctggcccaggtggtgggcgacgtggacaccagcctgcccagaaccctggacgagctgggcatccacctgaccaaggaggagctgaagctgaacatcagacccctgctgagactggtgtgcaagaagttcttcggcgagttcaccggcttcgtggacatgtgcgtgcagcacatccccagccccaaggtgggcgccaagcccaagatcgagcacacctacaccggcggcgtggacagcgacctgggcgaggccatgagcgactgcgaccccgacggccccctgatgtgccacaccaccaagatgtacagcaccgacgacggcgtgcagttccacgccttcggcagagtgctgagcggcaccatccacgccggccagcccgtgaaggtgctgggcgagaactacaccctggaggacgaggaggacagccagatctgcaccgtgggcagactgtggatcagcgtggccagataccacatcgaggtgaacagagtgcccgccggcaactgggtgctgatcgagggcgtggaccagcccatcgtgaagaccgccaccatcaccgagcccagaggcaacgaggaggcccagatcttcagacccctgaagttcaacaccaccagcgtgatcaagatcgccgtggagcccgtgaaccccagcgagctgcccaagatgctggacggcctgagaaaggtgaacaagagctaccccagcctgaccaccaaggtggaggagagcggcgagcacgtgatcctgggcaccggcgagctgtacctggactgcgtgatgcacgacctgagaaagatgtacagcgagatcgacatcaaggtggccgaccccgtggtgaccttctgcgagaccgtggtggagaccagcagcctgaagtgcttcgccgagacccccaacaagaagaacaagatcaccatgatcgccgagcccctggagaagggcctggccgaggacatcgagaacgaggtggtgcagatcacctggaacagaaagaagctgggcgagttcttccagaccaagtacgactgggacctgctggccgccagaagcatctgggccttcggccccgacgccaccggccccaacatcctggtggacgacaccctgcccagcgaggtggacaaggccctgctgggcagcgtgaaggacagcatcgtgcagggcttccagtggggcaccagagagggccccctgtgcgacgagctgatcagaaacgtgaagttcaagatcctggacgccgtggtggcccaggagcccctgcacagaggcggcggccagatcatccccaccgccagaagagtggtgtacagcgccttcctgatggccacccccagactgatggagccctactacttcgtggaggtgcaggcccccgccgactgcgtgagcgccgtgtacaccgtgctggccagaagaagaggccacgtgacccaggacgcccccatccccggcagccccctgtacaccatcaaggccttcatccccgccatcgacagcttcggcttcgagaccgacctgagaacccacacccagggccaggccttcagcctgagcgtgttccaccactggcagatcgtgcccggcgaccccctggacaagagcatcgtgatcagacccctggagccccagcccgccccccacctggccagagagttcatgatcaagaccagaagaagaaagggcctgagcgaggacgtgagcatcagcaagttcttcgacgaccccatgctgctggagctggccaagcaggacgtggtgctgaactaccccatgtag

SEQ ID NO: 80281 - DNA, 2919 bp, Artificial Sequence
  Description of Artificial Sequence: Synthetic coding sequence
atggacaccgacctgtacgacgagttcggcaactacatcggccccgagctggacagcgacgaggacgacgacgagctgggcagagagaccaaggacctggacgagatggacgacgacgacgacgacgacgacgtgggcgaccacgacgacgaccaccccggcatggaggtggtgctgcacgaggacaagaagtactaccccaccgccgaggaggtgtacggccccgaggtggagaccatcgtgcaggaggaggacacccagcccctgaccgagcccatcatcaagcccgtgaagaccaagaagttcaccctgatggagcagaccctgcccgtgaccgtgtacgagatggacttcctggccgacctgatggacaacagcgagctgatcagaaacgtgaccctgtgcggccacctgcaccacggcaagacctgcttcgtggactgcctgatcgagcagacccaccccgagatcagaaagagatacgaccaggacctgtgctacaccgacatcctgttcaccgagcaggagagaggcgtgggcatcaagagcacccccgtgaccgtggtgctgcccgacaccaagggcaagagctacctgttcaacatcatggacacccccggccacgtgaacttcagcgacgaggtgaccgccggcctgagaatcagcgacggcgtggtgctgttcatcgacgccgccgagggcgtgatgctgaacaccgagagactgatcaagcacgccgtgcaggagagactggccgtgaccgtgtgcatcaacaagatcgacagactgatcctggagctgaagctgccccccaccgacgcctactacaagctgagacacatcgtggacgaggtgaacggcctgatcagcatgtacagcaccgacgagaacctgatcctgagccccctgctgggcaacgtgtgcttcagcagcagccagtacagcatctgcttcaccctgggcagcttcgccaagatctacgccgacaccttcggcgacatcaactaccaggagttcgccaagagactgtggggcgacatctacttcaaccccaagaccagaaagttcaccaagaaggcccccaccagcagcagccagagaagcttcgtggagttcatcctggagcccctgtacaagatcctggcccaggtggtgggcgacgtggacaccagcctgcccagaaccctggacgagctgggcatccacctgaccaaggaggagctgaagctgaacatcagacccctgctgagactggtgtgcaagaagttcttcggcgagttcaccggcttcgtggacatgtgcgtgcagcacatccccagccccaaggtgggcgccaagcccaagatcgagcacacctacaccggcggcgtggacagcgacctgggcgaggccatgagcgactgcgaccccgacggccccctgatgtgccacaccaccaagatgtacagcaccgacgacggcgtgcagttccacgccttcggcagagtgctgagcggcaccatccacgccggccagcccgtgaaggtgctgggcgagaactacaccctggaggacgaggaggacagccagatctgcaccgtgggcagactgtggatcagcgtggccagataccacatcgaggtgaacagagtgcccgccggcaactgggtgctgatcgagggcgtggaccagcccatcgtgaagaccgccaccatcaccgagcccagaggcaacgaggaggcccagatcttcagacccctgaagttcaacaccaccagcgtgatcaagatcgccgtggagcccgtgaaccccagcgagctgcccaagatgctggacggcctgagaaaggtgaacaagagctaccccagcctgaccaccaaggtggaggagagcggcgagcacgtgatcctgggcaccggcgagctgtacctggactgcgtgatgcacgacctgagaaagatgtacagcgagatcgacatcaaggtggccgaccccgtggtgaccttctgcgagaccgtggtggagaccagcagcctgaagtgcttcgccgagacccccaacaagaagaacaagatcaccatgatcgccgagcccctggagaagggcctggccgaggacatcgagaacgaggtggtgcagatcacctggaacagaaagaagctgggcgagttcttccagaccaagtacgactgggacctgctggccgccagaagcatctgggccttcggccccgacgccaccggccccaacatcctggtggacgacaccctgcccagcgaggtggacaaggccctgctgggcagcgtgaaggacagcatcgtgcagggcttccagtggggcaccagagagggccccctgtgcgacgagctgatcagaaacgtgaagttcaagatcctggacgccgtggtggcccaggagcccctgcacagaggcggcggccagatcatccccaccgccagaagagtggtgtacagcgccttcctgatggccacccccagactgatggagccctactacttcgtggaggtgcaggcccccgccgactgcgtgagcgccgtgtacaccgtgctggccagaagaagaggccacgtgacccaggacgcccccatccccggcagccccctgtacaccatcaaggccttcatccccgccatcgacagcttcggcttcgagaccgacctgagaacccacacccagggccaggccttcagcctgagcgtgttccaccactggcagatcgtgcccggcgaccccctggacaagagcatcgtgatcagacccctggagccccagcccgccccccacctggccagagagttcatgatcaagaccagaagaagaaagggcctgagcgaggacgtgagcatcagcaagttcttcgacgaccccatgctgctggagctggccaagcaggacgtggtgctgaactaccccatgtag

SEQ ID NO: 80282 - DNA, 1923 bp, Artificial Sequence
  Description of Artificial Sequence: Synthetic coding sequence
atggccgccggcggcaccggcggcctgagagaggagcagagatacggcctgagctgcggcagactgggccaggacaacatcaccgtgctgcacgtgaagctgaccgagaccgccatcagagccctggagacctaccagagccacaagaacctgatccccttcagacccagcatccagttccagggcctgcacggcctggtgaagatccccaagaacgaccccctgaacgaggtgcacaacttcaacttctacctgagcaacgtgggcaaggacaacccccagggcagcttcgactgcatccagcagaccttcagcagcagcggcgccagccagctgaactgcctgggcttcatccaggacaagatcaccgtgtgcgccaccaacgacagctaccagatgaccagagagagaatgacccaggccgaggaggagagcagaaacagaagcaccaaggtgatcaagcccggcggcccctacgtgggcaagagagtgcagatcagaaaggccccccaggccgtgagcgacaccgtgcccgagagaaagagaagcacccccatgaaccccgccaacaccatcagaaagacccacagcagcagcaccatcagccagagaccctacagagacagagtgatccacctgctggccctgaaggcctacaagaagcccgagctgctggccagactgcagaaggacggcgtgaaccagaaggacaagaacagcctgggcgccatcctgcagcaggtggccaacctgaacagcaaggacctgagctacaccctgaaggactacgtgttcaaggagctgcagagagactggcccggctacagcgagatcgacagaagaagcctggagagcgtgctgagcagaaagctgaaccccagccagaacgccgccggcaccagcagaagcgagagccccgtgtgcagcagcagagacgccgtgagcagcccccagaagagactgctggacagcgagttcatcgaccccctgatgaacaagaaggccagaatcagccacctgaccaacagagtgccccccaccctgaacggccacctgaaccccaccagcgagaagagcgccgccggcctgcccctgccccccgccgccgccgccatccccacccccccccccctgcccagcacctacctgcccatcagccaccccccccagatcgtgaacagcaacagcaacagccccagcacccccgagggcagaggcacccaggacctgcccgtggacagcttcagccagaacgacagcatctacgaggaccagcaggacaagtacaccagcagaaccagcctggagaccctgccccccggcagcgtgctgctgaagtgccccaagcccatggaggagaaccacagcatgagccacaagaagagcaagaagaagagcaagaagcacaaggagaaggaccagatcaagaagcacgacatcgagaccatcgaggagaaggaggaggacctgaagagagaggaggagatcgccaagctgaacaacagcagccccaacagcagcggcggcgtgaaggaggactgcaccgccagcatggagcccagcgccatcgagctgcccgactacctgatcaagtacatcgccatcgtgagctacgagcagagacagaactacaaggacgacttcaacgccgagtacgacgagtacagagccctgcacgccagaatggagaccgtggccagaagattcatcaagctggacgcccagagaaagagactgagccccggcagcaaggagtaccagaacgtgcacgaggaggtgctgcaggagtaccagaagatcaagcagagcagccccaactaccacgaggagaagtacagatgcgagtacctgcacaacaagctggcccacatcaagagactgatcggcgagttcgaccagcagcaggccgagagctggagctag

SEQ ID NO: 80283 - DNA, 1173 bp, Artificial Sequence
  Description of Artificial Sequence: Synthetic coding sequence
atggccgccggcggcaccggcggcctgagagaggagcagagatacggcctgagctgcggcagactgggccaggacaacatcaccgtgctgcacgtgaagctgaccgagaccgccatcagagccctggagacctaccagagccacaagaacctgatccccttcagacccagcatccagttccagggcctgcacggcctggtgaagatccccaagaacgaccccctgaacgaggtgcacaacttcaacttctacctgagcaacgtgggcaaggacaacccccagggcagcttcgactgcatccagcagaccttcagcagcagcggcgccagccagctgaactgcctgggcttcatccaggacaagatcaccgtgtgcgccaccaacgacagctaccagatgaccagagagagaatgacccagatcgtgaacagcaacagcaacagccccagcacccccgagggcagaggcacccaggacctgcccgtggacagcttcagccagaacgacagcatctacgaggaccagcaggacaagtacaccagcagaaccagcctggagaccctgccccccggcagcgtgctgctgaagtgccccaagcccatggaggagaaccacagcatgagccacaagaagagcaagaagaagagcaagaagcacaaggagaaggaccagatcaagaagcacgacatcgagaccatcgaggagaaggaggaggacctgaagagagaggaggagatcgccaagctgaacaacagcagccccaacagcagcggcggcgtgaaggaggactgcaccgccagcatggagcccagcgccatcgagctgcccgactacctgatcaagtacatcgccatcgtgagctacgagcagagacagaactacaaggacgacttcaacgccgagtacgacgagtacagagccctgcacgccagaatggagaccgtggccagaagattcatcaagctggacgcccagagaaagagactgagccccggcagcaaggagtaccagaacgtgcacgaggaggtgctgcaggagtaccagaagatcaagcagagcagccccaactaccacgaggagaagtacagatgcgagtacctgcacaacaagctggcccacatcaagagactgatcggcgagttcgaccagcagcaggccgagagctggagctag

SEQ ID NO: 80284 - DNA, 1644 bp, Artificial Sequence
  Description of Artificial Sequence: Synthetic coding sequence
atgagacagaagagaaagggcgacctgagccccgccgagctgatgatgctgaccatcggcgacgtgatcaagcagctgatcgaggcccacgagcagggcaaggacatcgacctgaacaaggtgaagaccaagaccgccgccaagtacggcctgagcgcccagcccagactggtggacatcatcgccgccgtgcccccccagtacagaaaggtgctgatgcccaagctgaaggccaagcccatcagaaccgccagcggcatcgccgtggtggccgtgatgtgcaagccccacagatgcccccacatcagcttcaccggcaacatctgcgtgtactgccccggcggccccgacagcgacttcgagtacagcacccagagctacaccggctacgagcccaccagcatgagagccatcagagccagatacgaccccttcctgcagaccagacacagaatcgagcagctgaagcagctgggccacagcgtggacaaggtggagttcatcgtgatgggcggcaccttcatggccctgcccgaggagtacagagactacttcatcagaaacctgcacgacgccctgagcggccacaccagcaacaacatctacgaggccgtgaagtacagcgagagaagcctgaccaagtgcatcggcatcaccatcgagaccagacccgactactgcatgaagagacacctgagcgacatgctgacctacggctgcaccagactggagatcggcgtgcagagcgtgtacgaggacgtggccagagacaccaacagaggccacaccgtgaaggccgtgtgcgagagcttccacctggccaaggacagcggcttcaaggtggtggcccacatgatgcccgacctgcccaacgtgggcctggagagagacatcgagcagttcaccgagttcttcgagaaccccgccttcagacccgacggcctgaagctgtaccccaccctggtgatcagaggcaccggcctgtacgagctgtggaagagcggcagatacaagagctacagccccagcgacctggtggagctggtggccagaatcctggccctggtgcccccctggaccagagtgtacagagtgcagagagacatccccatgcccctggtgagcagcggcgtggagcacggcaacctgagagagctggccctggccagaatgaaggacctgggcatccagtgcagagacgtgagaaccagagaggtgggcatccaggagatccaccacaaggtgagaccctaccaggtggagctggtgagaagagactacgtggccaacggcggctgggagaccttcctgagctacgaggaccccgaccaggacatcctgatcggcctgctgagactgagaaagtgcagcgaggagaccttcagattcgagctgggcggcggcgtgagcatcgtgagagagctgcacgtgtacggcagcgtggtgcccgtgagcagcagagaccccaccaagttccagcaccagggcttcggcatgctgctgatggaggaggccgagagaatcgccagagaggagcacggcagcggcaagatcgccgtgatcagcggcgtgggcaccagaaactactacagaaagatcggctacagactgcagggcccctacatggtgaagatgctgaagtag

SEQ ID NO: 80285 - DNA, 1368 bp, Artificial Sequence
  Description of Artificial Sequence: Synthetic coding sequence
atgtgcaagccccacagatgcccccacatcagcttcaccggcaacatctgcgtgtactgccccggcggccccgacagcgacttcgagtacagcacccagagctacaccggctacgagcccaccagcatgagagccatcagagccagatacgaccccttcctgcagaccagacacagaatcgagcagctgaagcagctgggccacagcgtggacaaggtggagttcatcgtgatgggcggcaccttcatggccctgcccgaggagtacagagactacttcatcagaaacctgcacgacgccctgagcggccacaccagcaacaacatctacgaggccgtgaagtacagcgagagaagcctgaccaagtgcatcggcatcaccatcgagaccagacccgactactgcatgaagagacacctgagcgacatgctgacctacggctgcaccagactggagatcggcgtgcagagcgtgtacgaggacgtggccagagacaccaacagaggccacaccgtgaaggccgtgtgcgagagcttccacctggccaaggacagcggcttcaaggtggtggcccacatgatgcccgacctgcccaacgtgggcctggagagagacatcgagcagttcaccgagttcttcgagaaccccgccttcagacccgacggcctgaagctgtaccccaccctggtgatcagaggcaccggcctgtacgagctgtggaagagcggcagatacaagagctacagccccagcgacctggtggagctggtggccagaatcctggccctggtgcccccctggaccagagtgtacagagtgcagagagacatccccatgcccctggtgagcagcggcgtggagcacggcaacctgagagagctggccctggccagaatgaaggacctgggcatccagtgcagagacgtgagaaccagagaggtgggcatccaggagatccaccacaaggtgagaccctaccaggtggagctggtgagaagagactacgtggccaacggcggctgggagaccttcctgagctacgaggaccccgaccaggacatcctgatcggcctgctgagactgagaaagtgcagcgaggagaccttcagattcgagctgggcggcggcgtgagcatcgtgagagagctgcacgtgtacggcagcgtggtgcccgtgagcagcagagaccccaccaagttccagcaccagggcttcggcatgctgctgatggaggaggccgagagaatcgccagagaggagcacggcagcggcaagatcgccgtgatcagcggcgtgggcaccagaaactactacagaaagatcggctacagactgcagggcccctacatggtgaagatgctgaagtag

SEQ ID NO: 80286 - DNA, 342 bp, Artificial Sequence
  Description of Artificial Sequence: Synthetic coding sequence
atgatgctgaccatcggcgacgtgatcaagcagctgatcgaggcccacgagcagggcaaggacatcgacctgaacaaggtgaagaccaagaccgccgccaagtacggcctgagcgcccagcccagactggtggacatcatcgccgccgtgcccccccagtacagaaaggtgctgatgcccaagctgaaggccaagcccatcagaaccgccagcggcatcgccgtggtggccgtgatgtgcaagccccacagatgcccccacatcagcttcaccggcaacatctgcgtgtactgccccggcggccccgacagcgacttcgagtacagcacccagagctactag

SEQ ID NO: 80287 - DNA, 1602 bp, Artificial Sequence
  Description of Artificial Sequence: Synthetic coding sequence
atgatgctgaccatcggcgacgtgatcaagcagctgatcgaggcccacgagcagggcaaggacatcgacctgaacaaggtgaagaccaagaccgccgccaagtacggcctgagcgcccagcccagactggtggacatcatcgccgccgtgcccccccagtacagaaaggtgctgatgcccaagctgaaggccaagcccatcagaaccgccagcggcatcgccgtggtggccgtgatgtgcaagccccacagatgcccccacatcagcttcaccggcaacatctgcgtgtactgccccggcggccccgacagcgacttcgagtacagcacccagagctacaccggctacgagcccaccagcatgagagccatcagagccagatacgaccccttcctgcagaccagacacagaatcgagcagctgaagcagctgggccacagcgtggacaaggtggagttcatcgtgatgggcggcaccttcatggccctgcccgaggagtacagagactacttcatcagaaacctgcacgacgccctgagcggccacaccagcaacaacatctacgaggccgtgaagtacagcgagagaagcctgaccaagtgcatcggcatcaccatcgagaccagacccgactactgcatgaagagacacctgagcgacatgctgacctacggctgcaccagactggagatcggcgtgcagagcgtgtacgaggacgtggccagagacaccaacagaggccacaccgtgaaggccgtgtgcgagagcttccacctggccaaggacagcggcttcaaggtggtggcccacatgatgcccgacctgcccaacgtgggcctggagagagacatcgagcagttcaccgagttcttcgagaaccccgccttcagacccgacggcctgaagctgtaccccaccctggtgatcagaggcaccggcctgtacgagctgtggaagagcggcagatacaagagctacagccccagcgacctggtggagctggtggccagaatcctggccctggtgcccccctggaccagagtgtacagagtgcagagagacatccccatgcccctggtgagcagcggcgtggagcacggcaacctgagagagctggccctggccagaatgaaggacctgggcatccagtgcagagacgtgagaaccagagaggtgggcatccaggagatccaccacaaggtgagaccctaccaggtggagctggtgagaagagactacgtggccaacggcggctgggagaccttcctgagctacgaggaccccgaccaggacatcctgatcggcctgctgagactgagaaagtgcagcgaggagaccttcagattcgagctgggcggcggcgtgagcatcgtgagagagctgcacgtgtacggcagcgtggtgcccgtgagcagcagagaccccaccaagttccagcaccagggcttcggcatgctgctgatggaggaggccgagagaatcgccagagaggagcacggcagcggcaagatcgccgtgatcagcggcgtgggcaccagaaactactacagaaagatcggctacagactgcagggcccctacatggtgaagatgctgaagtag

SEQ ID NO: 80288 - DNA, 576 bp, Artificial Sequence
  Description of Artificial Sequence: Synthetic coding sequence
atgatgctgaccatcggcgacgtgatcaagcagctgatcgaggcccacgagcagggcaaggacatcgacctgaacaaggtgaagaccaagaccgccgccaagtacggcctgagcgcccagcccagactggtggacatcatcgccgccgtgcccccccagtacagaaaggtgctgatgcccaagctgaaggccaagcccatcagaaccgccagcggcatcgccgtggtggccgtgatgtgcaagccccacagatgcccccacatcagcttcaccggcaacatctgcgtgtactgccccggcggccccgacagcgacttcgagtacagcacccagagctacaccggctacgagcccaccagcatgagagccatcagagccagatacgaccccttcctgcagaccagacacagaatcgagcagctgaagcagctgggccacagcgtggacaaggtggagttcatcgtgatgggcggcaccttcatggccctgcccgaggagtacagagactacttcatcagaaacctgcacgacgccctgagcggccacaccagcaacaacatctacgaggccgtgtag

SEQ ID NO: 80289 - DNA, 1287 bp, Artificial Sequence
  Description of Artificial Sequence: Synthetic coding sequence
atgagcacccaccagttctacagaaagtacatgtgccccaccagcatgagagccatcagagccagatacgaccccttcctgcagaccagacacagaatcgagcagctgaagcagctgggccacagcgtggacaaggtggagttcatcgtgatgggcggcaccttcatggccctgcccgaggagtacagagactacttcatcagaaacctgcacgacgccctgagcggccacaccagcaacaacatctacgaggccgtgaagtacagcgagagaagcctgaccaagtgcatcggcatcaccatcgagaccagacccgactactgcatgaagagacacctgagcgacatgctgacctacggctgcaccagactggagatcggcgtgcagagcgtgtacgaggacgtggccagagacaccaacagaggccacaccgtgaaggccgtgtgcgagagcttccacctggccaaggacagcggcttcaaggtggtggcccacatgatgcccgacctgcccaacgtgggcctggagagagacatcgagcagttcaccgagttcttcgagaaccccgccttcagacccgacggcctgaagctgtaccccaccctggtgatcagaggcaccggcctgtacgagctgtggaagagcggcagatacaagagctacagccccagcgacctggtggagctggtggccagaatcctggccctggtgcccccctggaccagagtgtacagagtgcagagagacatccccatgcccctggtgagcagcggcgtggagcacggcaacctgagagagctggccctggccagaatgaaggacctgggcatccagtgcagagacgtgagaaccagagaggtgggcatccaggagatccaccacaaggtgagaccctaccaggtggagctggtgagaagagactacgtggccaacggcggctgggagaccttcctgagctacgaggaccccgaccaggacatcctgatcggcctgctgagactgagaaagtgcagcgaggagaccttcagattcgagctgggcggcggcgtgagcatcgtgagagagctgcacgtgtacggcagcgtggtgcccgtgagcagcagagaccccaccaagttccagcaccagggcttcggcatgctgctgatggaggaggccgagagaatcgccagagaggagcacggcagcggcaagatcgccgtgatcagcggcgtgggcaccagaaactactacagaaagatcggctacagactgcagggcccctacatggtgaagatgctgaagtag

SEQ ID NO: 80290 - DNA, 1257 bp, Artificial Sequence
  Description of Artificial Sequence: Synthetic coding sequence
atgtgccccaccagcatgagagccatcagagccagatacgaccccttcctgcagaccagacacagaatcgagcagctgaagcagctgggccacagcgtggacaaggtggagttcatcgtgatgggcggcaccttcatggccctgcccgaggagtacagagactacttcatcagaaacctgcacgacgccctgagcggccacaccagcaacaacatctacgaggccgtgaagtacagcgagagaagcctgaccaagtgcatcggcatcaccatcgagaccagacccgactactgcatgaagagacacctgagcgacatgctgacctacggctgcaccagactggagatcggcgtgcagagcgtgtacgaggacgtggccagagacaccaacagaggccacaccgtgaaggccgtgtgcgagagcttccacctggccaaggacagcggcttcaaggtggtggcccacatgatgcccgacctgcccaacgtgggcctggagagagacatcgagcagttcaccgagttcttcgagaaccccgccttcagacccgacggcctgaagctgtaccccaccctggtgatcagaggcaccggcctgtacgagctgtggaagagcggcagatacaagagctacagccccagcgacctggtggagctggtggccagaatcctggccctggtgcccccctggaccagagtgtacagagtgcagagagacatccccatgcccctggtgagcagcggcgtggagcacggcaacctgagagagctggccctggccagaatgaaggacctgggcatccagtgcagagacgtgagaaccagagaggtgggcatccaggagatccaccacaaggtgagaccctaccaggtggagctggtgagaagagactacgtggccaacggcggctgggagaccttcctgagctacgaggaccccgaccaggacatcctgatcggcctgctgagactgagaaagtgcagcgaggagaccttcagattcgagctgggcggcggcgtgagcatcgtgagagagctgcacgtgtacggcagcgtggtgcccgtgagcagcagagaccccaccaagttccagcaccagggcttcggcatgctgctgatggaggaggccgagagaatcgccagagaggagcacggcagcggcaagatcgccgtgatcagcggcgtgggcaccagaaactactacagaaagatcggctacagactgcagggcccctacatggtgaagatgctgaagtag

SEQ ID NO: 80291 - DNA, 1275 bp, Artificial Sequence
  Description of Artificial Sequence: Synthetic coding sequence
atggccgccgtggccacctgcggcagcgtggccgccagcaccggcagcgccgtggccaccgccagcaagagcaacgtgaccagcttccagagaagaggccccagagccagcgtgaccaacgacagcggccccagactggtgagcatcgccggcaccagacccagcgtgagaaacggccagctgctggtgagcaccggcctgcccgccctggaccagctgctgggcggcggcctggccgtgggcaccgtgctgctgatcgaggaggacaagtacaacatctacagccccctgctgttcaagtacttcctggccgagggcatcgtgaacggccacaccctgctggtggccagcgccaaggaggaccccgccaacatcctgcaggagctgcccgcccccctgctggacgacaagtgcaagaaggagttcgacgaggacgtgtacaaccacaagacccccgagagcaacatcaagatgaagatcgcctggagataccagctgctgcccaagatggagatcggccccgtgagcagcagcagattcggccactactacgacgccagcaagagaatgccccaggagctgatcgaggccagcaactggcacggcttcttcctgcccgagaagatcagcagcaccctgaaggtggagccctgcagcctgacccccggctacaccaagctgctgcagttcatccagaacatcatctacgaggagggcttcgacggcagcaacccccagaagaagcagagaaacatcctgagaatcggcatccagaacctgggcagccccctgtggggcgacgacatctgctgcgccgagaacggcggcaacagccacagcctgaccaagttcctgtacgtgctgagaggcctgctgagaaccagcctgagcgcctgcatcatcaccatgcccacccacctgatccagaacaaggccatcatcgccagagtgaccaccctgagcgacgtggtggtgggcctggagagcttcatcggcagcgagagagagaccaaccccctgtacaaggactaccacggcctgatccacatcagacagatccccagactgaacaacctgatctgcgacgagagcgacgtgaaggacctggccttcaagctgaagagaaagctgttcaccatcgagagactgcacctgccccccgacctgagcgacaccgtgagcagaagcagcaagatggacctggccgagagcgccaagagactgggccccggctgcggcatgatggccggcggcaagaagcacctggacttctag

SEQ ID NO: 80292 - DNA, 1431 bp, Artificial Sequence
  Description of Artificial Sequence: Synthetic coding sequence
atggccgccgtggccacctgcggcagcgtggccgccagcaccggcagcgccgtggccaccgccagcaagagcaacgtgaccagcttccagagaagaggccccagagccagcgtgaccaacgacagcggccccagactggtgagcatcgccggcaccagacccagcgtgagaaacggccagctgctggtgagcaccggcctgcccgccctggaccagctgctgggcggcggcctggccgtgggcaccgtgctgctgatcgaggaggacaagtacaacatctacagccccctgctgttcaagtacttcctggccgagggcatcgtgaacggccacaccctgctggtggccagcgccaaggaggaccccgccaacatcctgcaggagctgcccgcccccctgctggacgacaagtgcaagaaggagttcgacgaggacgtgtacaaccacaagacccccgagagcaacatcaagatgaagatcgcctggagataccagctgctgcccaagatggagcagatcggccccgtgagcagcagcagattcggccactactacgacgccagcaagagaatgccccaggagctgatcgaggccagcaactggcacggcttcttcctgcccgagaagatcagcagcaccctgaaggtggagccctgcagcctgacccccggctacaccaagctgctgcagttcatccagaacatcatctacgaggagggcttcgacggcagcaacccccagaagaagcagagaaacatcctgagaatcggcatccagaacctgggcagccccctgtggggcgacgacatctgctgcgccgagaacggcggcaacagccacagcctgaccaagttcctgtacgtgctgagaggcctgctgagaaccagcctgagcgcctgcatcatcaccatgcccacccacctgatccagaacaaggccatcatcgccagagtgaccaccctgagcgacgtggtggtgggcctggagagcttcatcggcagcgagagagagaccaaccccctgtacaaggactaccacggcctgatccacatcagacagatccccagactgaacaacctgatctgcgacgagagcgacgtgaaggacctggccttcaagctgaagagaaagctgttcaccatcgagtgggtgcaggacaactacctgagacaggagagaaacatctacccccccggcttcagctacctgctgaagcagaaggacagcgcctggggcgagggcagcctgcagcacagcaccttcctgatgagcttcctggccaaggccaccgccttcgccagcagactggtgagacacagcgagcccctgaagcagaacggcagcggcagaatcagacaggccgccggccccagactgtggcacgacggcagaagacaggaggcccccggcctgctgggcatccccccctag

SEQ ID NO: 80293 - DNA, 1608 bp, Artificial Sequence
  Description of Artificial Sequence: Synthetic coding sequence
atggccgccgtggccacctgcggcagcgtggccgccagcaccggcagcgccgtggccaccgccagcaagagcaacgtgaccagcttccagagaagaggccccagagccagcgtgaccaacgacagcggccccagactggtgagcatcgccggcaccagacccagcgtgagaaacggccagctgctggtgagcaccggcctgcccgccctggaccagctgctgggcggcggcctggccgtgggcaccgtgctgctgatcgaggaggacaagtacaacatctacagccccctgctgttcaagtacttcctggccgagggcatcgtgaacggccacaccctgctggtggccagcgccaaggaggaccccgccaacatcctgcaggagctgcccgcccccctgctggacgacaagtgcaagaaggagttcgacgaggacgtgtacaaccacaagacccccgagagcaacatcaagatgaagatcgcctggagataccagctgctgcccaagatggagatcggccccgtgagcagcagcagattcggccactactacgacgccagcaagagaatgccccaggagctgatcgaggccagcaactggcacggcttcttcctgcccgagaagatcagcagcaccctgaaggtggagccctgcagcctgacccccggctacaccaagctgctgcagttcatccagaacatcatctacgaggagggcttcgacggcagcaacccccagaagaagcagagaaacatcctgagaatcggcatccagaacctgggcagccccctgtggggcgacgacatctgctgcgccgagaacggcggcaacagccacagcctgaccaagttcctgtacgtgctgagaggcctgctgagaaccagcctgagcgcctgcatcatcaccatgcccacccacctgatccagaacaaggccatcatcgccagagtgaccaccctgagcgacgtggtggtgggcctggagagcttcatcggcagcgagagagagaccaaccccctgtacaaggactaccacggcctgatccacatcagacagatccccagactgaacaacctgatctgcgacgagagcgacgtgaaggacctggccttcaagctgaagagaaagctgttcaccatcgaggccggcgtgcagtggcacgacctgggcagcagacagcccagactgctgggcagcagcaacagccccgccagcgccagcctggtggccggcatcaccggcgcccaccaccacacccagctgatcttcgtgttcctggtggagatgggcttccaccacgtgggccaggccggcctggagctgctgaccagcggcgacagcagcgccagcgccagccagagcgccggcatcaccggcatgagctacagagccagacccagagccctgtacttcaaggagaacaagagcaaggtgggcgccagacagctgctggagaccagagaggagcacctgagcagcagactgctgatcctgacccaggccgagagactgtgcatgggcagaagattcttcaccgccttccacatcttcaacgagctgccctgcaagggcgactgcatctgcctgcagacctgccagacccagtag

SEQ ID NO: 80294 - DNA, 840 bp, Artificial Sequence
  Description of Artificial Sequence: Synthetic coding sequence
atggaggccgtggtgaacctgtaccaggaggtgatgaagcacgccgaccccagaatccagggctaccccctgatgggcagccccctgctgatgaccagcatcctgctgacctacgtgtacttcgtgctgagcctgggccccagaatcatggccaacagaaagcccttccagctgagaggcttcatgatcgtgtacaacttcagcctggtggccctgagcctgtacatcgtgtacgagttcctgatgagcggctggctgagcacctacacctggagatgcgaccccgtggactacagcaacagccccgaggccctgagaatggtgagagtggcctggctgttcctgttcagcaagttcatcgagctgatggacaccgtgatcttcatcctgagaaagaaggacggccaggtgaccttcctgcacgtgttccaccacagcgtgctgccctggagctggtggtggggcgtgaagatcgcccccggcggcatgggcagcttccacgccatgatcaacagcagcgtgcacgtgatcatgtacctgtactacggcctgagcgccttcggccccgtggcccagccctacctgtggtggaagaagcacatgaccgccatccagctgatccagttcgtgctggtgagcctgcacatcagccagtactacttcatgagcagctgcaactaccagtaccccgtgatcatccacctgatctggatgtacggcaccatcttcttcatgctgttcagcaacttctggtaccacagctacaccaagggcaagagactgcccagagccctgcagcagaacggcgcccccggcatcgccaaggtgaaggccaactag

SEQ ID NO: 80295 - DNA, 759 bp, Artificial Sequence
  Description of Artificial Sequence: Synthetic coding sequence
atggaggccgtggtgaacctgtaccaggaggtgatgaagcacgccgaccccagaatccagggctaccccctgatgggcagccccctgctgatgaccagcatcctgctgacctacgtgtacttcgtgctgagcctgggccccagaatcatggccaacagaaagcccttccagctgagaggcttcatgatcgtgtacaacttcagcctggtggccctgagcctgtacatcgtgtacgagatggtgagagtggcctggctgttcctgttcagcaagttcatcgagctgatggacaccgtgatcttcatcctgagaaagaaggacggccaggtgaccttcctgcacgtgttccaccacagcgtgctgccctggagctggtggtggggcgtgaagatcgcccccggcggcatgggcagcttccacgccatgatcaacagcagcgtgcacgtgatcatgtacctgtactacggcctgagcgccttcggccccgtggcccagccctacctgtggtggaagaagcacatgaccgccatccagctgatccagttcgtgctggtgagcctgcacatcagccagtactacttcatgagcagctgcaactaccagtaccccgtgatcatccacctgatctggatgtacggcaccatcttcttcatgctgttcagcaacttctggtaccacagctacaccaagggcaagagactgcccagagccctgcagcagaacggcgcccccggcatcgccaaggtgaaggccaactag

SEQ ID NO: 80296 - DNA, 891 bp, Artificial Sequence
  Description of Artificial Sequence: Synthetic coding sequence
atggagcacctgaaggccttcgacgacgagatcaacgccttcctggacaacatgttcggccccagagacagcagagtgagaggctggttcatgctggacagctacctgcccaccttcttcctgaccgtgatgtacctgctgagcatctggctgggcaacaagtacatgaagaacagacccgccctgagcctgagaggcatcctgaccctgtacaacctgggcatcaccctgctgagcgcctacatgctggccgagctgatcctgagcacctgggagggcggctacaacctgcagtgccaggacctgaccagcgccggcgaggccgacatcagagtggccaaggtgctgtggtggtactacttcagcaagagcgtggagttcctggacaccatcttcttcgtgctgagaaagaagaccagccagatcaccttcctgcacgtgtaccaccacgccagcatgttcaacatctggtggtgcgtgctgaactggatcccctgcggccagagcttcttcggccccaccctgaacagcttcatccacatcctgatgtacagctactacggcctgagcgtgttccccagcatgcacaagtacctgtggtggaagaagtacctgacccaggcccagctggtgcagttcgtgctgaccatcacccacaccatgagcgccgtggtgaagccctgcggcttccccttcggctgcctgatcttccagagcagctacatgctgaccctggtgatcctgttcctgaacttctacgtgcagacctacagaaagaagcccatgaagaaggacatgcaggagccccccgccggcaaggaggtgaagaacggcttcagcaaggcctacttcaccgccgccaacggcgtgatgaacaagaaggcccagtag

SEQ ID NO: 80297 - DNA, 813 bp, Artificial Sequence
  Description of Artificial Sequence: Synthetic coding sequence
atggtgaccgccatgaacgtgagccacgaggtgaaccagctgttccagccctacaacttcgagctgagcaaggacatgagacccttcttcgaggagtactgggccaccagcttccccatcgccctgatctacctggtgctgatcgccgtgggccagaactacatgaaggagagaaagggcttcaacctgcagggccccctgatcctgtggagcttctgcctggccatcttcagcatcctgggcgccgtgagaatgtggggcatcatgggcaccgtgctgctgaccggcggcctgaagcagaccgtgtgcttcatcaacttcatcgacaacagcaccgtgaagttctggagctgggtgttcctgctgagcaaggtgatcgagctgggcgacaccgccttcatcatcctgagaaagagacccctgatcttcatccactggtaccaccacagcaccgtgctggtgtacaccagcttcggctacaagaacaaggtgcccgccggcggctggttcgtgaccatgaacttcggcgtgcacgccatcatgtacacctactacaccctgaaggccgccaacgtgaagccccccaagatgctgcccatgctgatcaccagcctgcagatcctgcagatgttcgtgggcgccatcgtgagcatcctgacctacatctggagacaggaccagggctgccacaccaccatggagcacctgttctggagcttcatcctgtacatgacctacttcatcctgttcgcccacttcttctgccagacctacatcagacccaaggtgaaggccaagaccaagagccagtag

SEQ ID NO: 80298 - DNA, 945 bp, Artificial Sequence
  Description of Artificial Sequence: Synthetic coding sequence
atgggcctgctggacagcgagcccggcagcgtgctgaacgtggtgagcaccgccctgaacgacaccgtggagttctacagatggacctggagcatcgccgacaagagagtggagaactggcccctgatgcagagcccctggcccaccctgagcatcagcaccctgtacctgctgttcgtgtggctgggccccaagtggatgaaggacagagagcccttccagatgagactggtgctgatcatctacaacttcggcatggtgctgctgaacctgttcatcttcagagagctgttcatgggcagctacaacgccggctacagctacatctgccagagcgtggactacagcaacaacgtgcacgaggtgagaatcgccgccgccctgtggtggtacttcgtgagcaagggcgtggagtacctggacaccgtgttcttcatcctgagaaagaagaacaaccaggtgagcttcctgcacgtgtaccaccactgcaccatgttcaccctgtggtggatcggcatcaagtgggtggccggcggccaggccttcttcggcgcccagctgaacagcttcatccacgtgatcatgtacagctactacggcctgaccgccttcggcccctggatccagaagtacctgtggtggaagagatacctgaccatgctgcagctgatccagttccacgtgaccatcggccacaccgccctgagcctgtacaccgactgccccttccccaagtggatgcactgggccctgatcgcctacgccatcagcttcatcttcctgttcctgaacttctacatcagaacctacaaggagcccaagaagcccaaggccggcaagaccgccatgaacggcatcagcgccaacggcgtgagcaagagcgagaagcagctgatgatcgagaacggcaagaagcagaagaacggcaaggccaagggcgactag

SEQ ID NO: 80299 - DNA, 900 bp, Artificial Sequence
  Description of Artificial Sequence: Synthetic coding sequence
atggagcacttcgacgccagcctgagcacctacttcaaggccctgctgggccccagagacaccagagtgaagggctggttcctgctggacaactacatccccaccttcatctgcagcgtgatctacctgctgatcgtgtggctgggccccaagtacatgagaaacaagcagcccttcagctgcagaggcatcctggtggtgtacaacctgggcctgaccctgctgagcctgtacatgttctgcgagctggtgaccggcgtgtgggagggcaagtacaacttcttctgccagggcaccagaaccgccggcgagagcgacatgaagatcatcagagtgctgtggtggtactacttcagcaagctgatcgagttcatggacaccttcttcttcatcctgagaaagaacaaccaccagatcaccgtgctgcacgtgtaccaccacgccagcatgctgaacatctggtggttcgtgatgaactgggtgccctgcggccacagctacttcggcgccaccctgaacagcttcatccacgtgctgatgtacagctactacggcctgagcagcgtgcccagcatgagaccctacctgtggtggaagaagtacatcacccagggccagctgctgcagttcgtgctgaccatcatccagaccagctgcggcgtgatctggccctgcaccttccccctgggctggctgtacttccagatcggctacatgatcagcctgatcgccctgttcaccaacttctacatccagacctacaacaagaagggcgccagcagaagaaaggaccacctgaaggaccaccagaacggcagcatggccgccgtgaacggccacaccaacagcttcagccccctggagaacaacgtgaagcccagaaagctgagaaaggactag

SEQ ID NO: 80300 - DNA, 267 bp, Artificial Sequence
  Description of Artificial Sequence: Synthetic coding sequence
atggagcacttcgacgccagcctgagcacctacttcaaggccctgctgggccccagaggcatcagcagcagcgtgctgagaatgggcccccccctgcacaccgtggtgggctggctgcagcagctgcaggccgcccacagcgaggaggaggagaagatgttccacctgtgcggcttcaagcacaaggaggtggtgagccagagcagcctgcccgccgtgatcccccagaacagcctggccaccatcgccagccacgcccccgcctag

SEQ ID NO: 80301 - DNA, 870 bp, Artificial Sequence
  Description of Artificial Sequence: Synthetic coding sequence
atggagcacttcgacgccagcctgagcacctacttcaaggccctgctgggccccagagacaccagagtgaagggctggttcctgctggacaactacatccccaccttcatctgcagcgtgatctacctgctgatcgtgtggctgggccccaagtacatgagaaacaagcagcccttcagctgcagaggcatcctggtggtgtacaagttctgcgagctggtgaccggcgtgtgggagggcaagtacaacttcttctgccagggcaccagaaccgccggcgagagcgacatgaagatcatcagagtgctgtggtggtactacttcagcaagctgatcgagttcatggacaccttcttcttcatcctgagaaagaacaaccaccagatcaccgtgctgcacgtgtaccaccacgccagcatgctgaacatctggtggttcgtgatgaactgggtgccctgcggccacagctacttcggcgccaccctgaacagcttcatccacgtgctgatgtacagctactacggcctgagcagcgtgcccagcatgagaccctacctgtggtggaagaagtacatcacccagggccagctgctgcagttcgtgctgaccatcatccagaccagctgcggcgtgatctggccctgcaccttccccctgggctggctgtacttccagatcggctacatgatcagcctgatcgccctgttcaccaacttctacatccagacctacaacaagaagggcgccagcagaagaaaggaccacctgaaggaccaccagaacggcagcatggccgccgtgaacggccacaccaacagcttcagccccctggagaacaacgtgaagcccagaaagctgagaaaggactag

SEQ ID NO: 80302 - DNA, 981 bp, Artificial Sequence
  Description of Artificial Sequence: Synthetic coding sequence
atggagcacttcgacgccagcctgagcacctacttcaaggccctgctgggccccagagacaccagagtgaagggctggttcctgctggacaactacatccccaccttcatctgcagcgtgatctacctgctgatcgtgtggctgggccccaagtacatgagaaacaagcagcccttcagctgcagaggcatcctggtggtgtacaacctgggcctgaccctgctgagcctgtacatgttctgcgagagcaagagagagcagcccagaagaagcgcctgcgccagcagaaccgaccccagcacccagcagcagctgcccgagaacagactggtgaccggcgtgtgggagggcaagtacaacttcttctgccagggcaccagaaccgccggcgagagcgacatgaagatcatcagagtgctgtggtggtactacttcagcaagctgatcgagttcatggacaccttcttcttcatcctgagaaagaacaaccaccagatcaccgtgctgcacgtgtaccaccacgccagcatgctgaacatctggtggttcgtgatgaactgggtgccctgcggccacagctacttcggcgccaccctgaacagcttcatccacgtgctgatgtacagctactacggcctgagcagcgtgcccagcatgagaccctacctgtggtggaagaagtacatcacccagggccagctgctgcagttcgtgctgaccatcatccagaccagctgcggcgtgatctggccctgcaccttccccctgggctggctgtacttccagatcggctacatgatcagcctgatcgccctgttcaccaacttctacatccagacctacaacaagaagggcgccagcagaagaaaggaccacctgaaggaccaccagaacggcagcatggccgccgtgaacggccacaccaacagcttcagccccctggagaacaacgtgaagcccagaaagctgagaaaggactag

SEQ ID NO: 80303 - DNA, 900 bp, Artificial Sequence; identical to SEQ ID NO: 80299
  Description of Artificial Sequence: Synthetic coding sequence

SEQ ID NO: 80304 - DNA, 798 bp, Artificial Sequence
  Description of Artificial Sequence: Synthetic coding sequence
atgaacatgagcgtgctgaccctgcaggagtacgagttcgagaagcagttcaacgagaacgaggccatccagtggatgcaggagaactggaagaagagcttcctgttcagcgccctgtacgccgccttcatcttcggcggcagacacctgatgaacaagagagccaagttcgagctgagaaagcccctggtgctgtggagcctgaccctggccgtgttcagcatcttcggcgccctgagaaccggcgcctacatggtgtacatcctgatgaccaagggcctgaagcagagcgtgtgcgaccagggcttctacaacggccccgtgagcaagttctgggcctacgccttcgtgctgagcaaggcccccgagctgggcgacaccatcttcatcatcctgagaaagcagaagctgatcttcctgcactggtaccaccacatcaccgtgctgctgtacagctggtacagctacaaggacatggtggccggcggcggctggttcatgaccatgaactacggcgtgcacgccgtgatgtacagctactacgccctgagagccgccggcttcagagtgagcagaaagttcgccatgttcatcaccctgagccagatcacccagatgctgatgggctgcgtggtgaactacctggtgttctgctggatgcagcacgaccagtgccacagccacttccagaacatcttctggagcagcctgatgtacctgagctacctggtgctgttctgccacttcttcttcgaggcctacatcggcaagatgagaaagaccaccaaggccgagtag

SEQ ID NO: 80305 - DNA, 798 bp, Artificial Sequence; identical to SEQ ID NO: 80304
  Description of Artificial Sequence: Synthetic coding sequence

SEQ ID NO: 80306 - DNA, 327 bp, Artificial Sequence
  Description of Artificial Sequence: Synthetic coding sequence
atgaacatgagcgtgctgaccctgcaggagtacgagttcgagaagcagttcaacgagaacgaggccatccagtggatgcaggagaactggaagaagagcttcctgttcagcgccctgtacgccgccttcatcttcggcggcagacacctgatgaacaagagagccaagttcgagctgagaaagcccctggtgctgtggagcctgaccctggccgtgttcagcatcttcggcgccctgagaaccggcgcctacatggtgtacatcctgatgaccaagggcctgaagcagagcgtgtgcgaccagggcttctacaacggccccgtgtag

SEQ ID NO: 80307 - DNA, 414 bp, Artificial Sequence
  Description of Artificial Sequence: Synthetic coding sequence
atgaacatgagcgtgctgaccctgcaggagtacgagttcgagaagcagttcaacgagaacgaggccatccagtggatgcaggagaactggaagaagagcttcctgttcagcgccctgtacgccgccttcatcttcggcggcagacacctgatgaacaagagagccaagttcgagctgagaaagcccctggtgctgtggagcctgaccctggccgtgttcagcatcttcggcgccctgagaaccggcgcctacatggtgtacatcctgatgaccaagggcctgaagcagagcgtgtgcgaccagggcttctacaacggccccgtgagcaagttctgggcctacgccttcgtgctgagcaaggcccccgagctgggcgacaccatcttcatcatcctgagaaagcagaagctgtag

SEQ ID NO: 80308 - DNA, 846 bp, Artificial Sequence
  Description of Artificial Sequence: Synthetic coding sequence
atggccttcagcgacctgaccagcagaaccgtgcacctgtacgacaactggatcaaggacgccgaccccagagtggaggactggctgctgatgagcagccccctgccccagaccatcctgctgggcttctacgtgtacttcgtgaccagcctgggccccaagctgatggagaacagaaagcccttcgagctgaagaaggccatgatcacctacaacttcttcatcgtgctgttcagcgtgtacatgtgctacgagttcgtgatgagcggctggggcatcggctacagcttcagatgcgacatcgtggactacagcagaagccccaccgccctgagaatggccagaacctgctggctgtactacttcagcaagttcatcgagctgctggacaccatcttcttcgtgctgagaaagaagaacagccaggtgaccttcctgcacgtgttccaccacaccatcatgccctggacctggtggttcggcgtgaagttcgccgccggcggcctgggcaccttccacgccctgctgaacaccgccgtgcacgtggtgatgtacagctactacggcctgagcgccctgggccccgcctaccagaagtacctgtggtggaagaagtacctgaccagcctgcagctggtgcagttcgtgatcgtggccatccacatcagccagttcttcttcatggaggactgcaagtaccagttccccgtgttcgcctgcatcatcatgagctacagcttcatgttcctgctgctgttcctgcacttctggtacagagcctacaccaagggccagagactgcccaagaccgtgaagaacggcacctgcaagaacaaggacaactag

SEQ ID NO: 80309 - DNA, 846 bp, Artificial Sequence; identical to SEQ ID NO: 80308
  Description of Artificial Sequence: Synthetic coding sequence

SEQ ID NO: 80310 - DNA, 498 bp, Artificial Sequence
  Description of Artificial Sequence: Synthetic coding sequence
atggccttcagcgacctgaccagcagaaccgtgcacctgtacgacaactggatcaaggacgccgaccccagagtggaggactggctgctgatgagcagccccctgccccagaccatcctgctgggcttctacgtgtacttcgtgaccagcctgggccccaagctgatggagaacagaaagcccttcgagctgaagaaggccatgatcacctacaacttcttcatcgtgctgttcagcgtgtacatgtgctacgagttcgtgatgagcggctggggcatcggctacagcttcagatgcgacatcgtggactacagcagaagccccaccgccctgagaatggccagaacctgctggctgtactacttcagcaagttcatcgagctgctggacaccatcttcttcgtgctgagaaagaagaacagccaggtgaccttcctgcacgtgttccaccacaccatcatgccctggacctggtggttcggcgtgaagttcgcctag

SEQ ID NO: 80311 - DNA, 846 bp, Artificial Sequence; identical to SEQ ID NO: 80308
  Description of Artificial Sequence: Synthetic coding sequence

SEQ ID NO: 80312 - DNA, 498 bp, Artificial Sequence; identical to SEQ ID NO: 80310
  Description of Artificial Sequence: Synthetic coding sequence

SEQ ID NO: 80313 - DNA, 921 bp, Artificial Sequence
  Description of Artificial Sequence: Synthetic coding sequence
atggccgccgccgccgccgccgccgccgccgccggcgccgccggcggcagaggcagcggccccggcagaagaagacacctggtgcccggcgccggcggcgaggccggcgagggcgcccccggcggcgccggcgactacggcaacggcctggagagcgaggagctggagcccgaggagctgctgctggagcccgagcccgagcccgagcccgaggaggagccccccagacccagagccccccccggcgcccccggccccggccccggcagcggcgcccccggcagccaggaggaggaggaggagcccggcctggtggagggcgaccccggcgacggcgccatcgaggaccccgagctggaggccatcaaggccagagtgagagagatggaggaggaggccgagaagctgaaggagctgcagaacgaggtggagaagcagatgaacatgagccccccccccggcaacgccggccccgtgatcatgagcatcgaggagaagatggaggccgacgccagaagcatctacgtgggcaacgtggactacggcgccaccgccgaggagctggaggcccacttccacggctgcggcagcgtgaacagagtgaccatcctgtgcgacaagttcagcggccaccccaagggcttcgcctacatcgagttcagcgacaaggagagcgtgagaaccagcctggccctggacgagagcctgttcagaggcagacagatcaaggtgatccccaagagaaccaacagacccggcatcagcaccaccgacagaggcttccccagagccagatacagagccagaaccaccaactacaacagcagcagaagcagattctacagcggcttcaacagcagacccagaggcagagtgtacagaggcagagccagagccaccagctggtacagcccctactag

SEQ ID NO: 80314 - DNA, 1407 bp, Artificial Sequence
  Description of Artificial Sequence: Synthetic coding sequence
atggccatcgccaccagcgtgtacgtggtgcccccccccgccagaccctgccccaccagcggcccccccgccggcccctgcccccccagccccgacctgatctacaagatccccagagccagcggcacccagctggccgcccccagagacgccctggaggtgtacgacgtgccccccaccgccctgagagtgcccagcagcggcccctacgactgccccgccagcttcagccaccccctgaccagagtggccccccagccccccggcgaggacgacgccccctacgacgtgcccctgacccccaagccccccgccgagctggagcccgacctggagtgggagggcggcagagagcccggcccccccatctacgccgcccccagcaacctgaagagagccagcgccctgctgaacctgtacgaggcccccgaggagctgctggccgacggcgagggcggcggcaccgacgagggcatctacgacgtgcccctgctgggccccgaggccccccccagccccgagccccccggcgccctggccagccacgaccaggacaccctggcccagctgctggccagaagccccccccccccccacagacccagactgcccagcgccgagagcctgagcagaagacccctgcccgccctgcccgtgcccgaggcccccagccccagccccgtgcccagccccgcccccggcagaaagggcagcatccaggacagacccctgcccccccccccccccagactgcccggctacggcggccccaaggtggagggcgaccccgagggcagagagatggaggacgaccccgccggccaccacaacgagtacgagggcatccccatggccgaggagtacgactacgtgcacctgaagggcatggacaaggcccagggcagcagaccccccgaccaggcctgcaccggcgaccccgagctgcccgagagaggcatgcccgccccccaggaggccctgagccccggcgagcccctggtggtgagcaccggcgacctgcagctgctgtacttctacgccggccagtgccagagccactacagcgccctgcaggccgccgtggccgccctgatgagcagcacccaggccaaccagccccccagactgttcgtgccccacagcaagagagtggtggtggccgcccacagactggtgttcgtgggcgacaccctgggcagactggccgccagcgcccccctgagagcccaggtgagagccgccggcaccgccctgggccaggccctgagagccaccgtgctggccgtgaagggcgccgccctgggctaccccagcagccccgccatccaggagatggtgcagtgcgtgaccgagctggccggccaggccctgcagttcaccaccctgctgaccagcctggccccctag

SEQ ID NO: 80315 - DNA, 1179 bp, Artificial Sequence
  Description of Artificial Sequence: Synthetic coding sequence
atggccatcgccaccagcgtgtacgtggtgcccccccccgccagaccctgccccaccagcggcccccccgccggcccctgcccccccagccccgacctgatctacaagatccccagagccagcggcacccagctggccgcccccagagacgccctggaggtgtacgacgtgccccccaccgccctgagagtgcccagcagcggcccctacgactgccccgccagcttcagccaccccctgaccagagtggccccccagccccccggcgaggacgacgccccccccagccccgagccccccggcgccctggccagccacgaccaggacaccctggcccagctgctggccagaagccccccccccccccacagacccagactgcccagcgccgagagcctgagcagaagacccctgcccgccctgcccgtgcccgaggcccccagccccagccccgtgcccagccccgcccccggcagaaagggcagcatccaggacagacccctgcccccccccccccccagactgcccggctacggcggccccaaggtggagggcgaccccgagggcagagagatggaggacgaccccgccggccaccacaacgagtacgagggcatccccatggccgaggagtacgactacgtgcacctgaagggcatggacaaggcccagggcagcagaccccccgaccaggcctgcaccggcgaccccgagctgcccgagagaggcatgcccgccccccaggaggccctgagccccggcgagcccctggtggtgagcaccggcgacctgcagctgctgtacttctacgccggccagtgccagagccactacagcgccctgcaggccgccgtggccgccctgatgagcagcacccaggccaaccagccccccagactgttcgtgccccacagcaagagagtggtggtggccgcccacagactggtgttcgtgggcgacaccctgggcagactggccgccagcgcccccctgagagcccaggtgagagccgccggcaccgccctgggccaggccctgagagccaccgtgctggccgtgaagggcgccgccctgggctaccccagcagccccgccatccaggagatggtgcagtgcgtgaccgagctggccggccaggccctgcagttcaccaccctgctgaccagcctggccccctag

SEQ ID NO: 80316 - DNA, 1326 bp, Artificial Sequence
  Description of Artificial Sequence: Synthetic coding sequence
atgagcgagagagaggtgagcaccgcccccgccggcaccgacatgcccgccgccaagaagcagaagctgagcagcgacgagaacagcaaccccgacctgagcggcgacgagaacgacgacgccgtgagcatcgagagcggcaccaacaccgagagacccgacacccccaccaacacccccaacgcccccggcagaaagagctggggcaagggcaagtggaagagcaagaagtgcaagtacagcttcaagtgcgtgaacagcctgaaggaggaccacaaccagcccctgttcggcgtgcagttcaactggcacagcaaggagggcgaccccctggtgttcgccaccgtgggcagcaacagagtgaccctgtacgagtgccacagccagggcgagatcagactgctgcagagctacgtggacgccgacgccgacgagaacttctacacctgcgcctggacctacgacagcaacaccagccaccccctgctggccgtggccggcagcagaggcatcatcagaatcatcaaccccatcaccatgcagtgcatcaagcactacgtgggccacggcaacgccatcaacgagctgaagttccaccccagagaccccaacctgctgctgagcgtgagcaaggaccacgccctgagactgtggaacatccagaccgacaccctggtggccatcttcggcggcgtggagggccacagagacgaggtgctgagcgccgactacgacctgctgggcgagaagatcatgagctgcggcatggaccacagcctgaagctgtggagaatcaacagcaagagaatgatgaacgccatcaaggagagctacgactacaaccccaacaagaccaacagacccttcatcagccagaagatccacttccccgacttcagcaccagagacatccacagaaactacgtggactgcgtgagatggctgggcgacctgatcctgagcaagagctgcgagaacgccatcgtgtgctggaagcccggcaagatggaggacgacatcgacaagatcaagcccagcgagagcaacgtgaccatcctgggcagattcgactacagccagtgcgacatctggtacatgagattcagcatggacttctggcagaagatgctggccctgggcaaccaggtgggcaagctgtacgtgtgggacctggaggtggaggacccccacaaggccaagtgcaccaccctgacccaccacaagtgcggcgccgccatcagacagaccagcttcagcagagacagcagcatcctgatcgccgtgtgcgacgacgccagcatctggagatgggacagactgagatag

SEQ ID NO: 80317 - DNA, 1203 bp, Artificial Sequence
  Description of Artificial Sequence: Synthetic coding sequence
atgagcgagagagaggtgagcaccgcccccgccggcaccgacatgcccgccgccaagaagcagaagctgagcagcgacgagaacagcaaccccgacctgagcggcgacgagaacgacgacgccgtgagcatcgagagcggcaccaacaccgagagacccgacacccccaccaacacccccaacgcccccggcagaaagagctggggcaagggcaagtggaagagcaagaagtgcaagtacagcttcaagtgcgtgaacagcctgaaggaggaccacaaccagcccctgttcggcgtgcagttcaactggcacagcaaggagggcgaccccctggtgttcgccaccgtgggcagcaacagagtgaccctgtacgagtgccacagccagggcgagatcagactgctgcagagctacgtggacgccgacgccgacgagaacttctacacctgcgcctggacctacgacagcaacaccagccaccccctgctggccgtggccggcagcagaggcatcatcagaatcatcaaccccatcaccatgcagtgcatcaagcactacgtgggccacggcaacgccatcaacgagctgaagttccaccccagagaccccaacctgctgctgagcgtgagcaaggaccacgccctgagactgtggaacatccagaccgacaccctggtggccatcttcggcggcgtggagggccacagagacgaggtgctgagcgccgactacgacctgctgggcgagaagatcatgagctgcggcatggaccacagcctgaagctgtggagaatcaacagcaagagaatgatgaacgccatcaaggagagctacgactacaaccccaacaagaccaacagacccttcatcagccagaagatccacttccccgacttcagcaccagagacatccacagaaactacgtggactgcgtgagatggctgggcgacctgatcctgagcaagagctgcgagaacgccatcgtgtgctggaagcccggcaagatggaggacgacatcgacaagatcaagcccagcgagagcaacgtgaccatcctgggcagattcgactacagccagtgcgacatctggtacatgagattcagcatggacttctggcagaagatgctggccctgggcaaccaggtgggcaagctgtacgtgtgggacctggaggtggaggacccccacaaggccaagtag

SEQ ID NO: 80318 - DNA, 1401 bp, Artificial Sequence
  Description of Artificial Sequence: Synthetic coding sequence
atgagcgagagagaggtgagcaccgcccccgccggcaccgacatgcccgccgccaagaagcagaagctgagcagcgacgagaacagcaaccccgacctgagcggcgacgagaacgacgacgccgtgagcatcgagagcggcaccaacaccgagagacccgacacccccaccaacacccccaacgcccccggcagaaagagctggggcaagggcaagtggaagagcaagaagtgcaagtacagcttcaagtgcgtgaacagcctgaaggaggaccacaaccagcccctgttcggcgtgcagttcaactggcacagcaaggagggcgaccccctggtgttcgccaccgtgggcagcaacagagtgaccctgtacgagtgccacagccagggcgagatcagactgctgcagagctacgtggacgccgacgccgacgagaacttctacacctgcgcctggacctacgacagcaacaccagccaccccctgctggccgtggccggcagcagaggcatcatcagaatcatcaaccccatcaccatgcagtgcatcaagcactacgtgggccacggcaacgccatcaacgagctgaagttccaccccagagaccccaacctgctgctgagcgtgagcaaggaccacgccctgagactgtggaacatccagaccgacaccctggtggccatcttcggcggcgtggagggccacagagacgaggtgctgagcgccgactacgacctgctgggcgagaagatcatgagctgcggcatggaccacagcctgaagctgtggagaatcaacagcaagagaatgatgaacgccatcaaggagagctacgactacaaccccaacaagaccaacagacccttcatcagccagaagatccacttccccgacttcagcaccagagacatccacagaaactacgtggactgcgtgagatggctgggcgacctgatcctgagcaagagcggcagagccatcctgcacagccaccagcagtgcatgagagaccccgtgagccccaacctgagacagcacctgagctgcgagaacgccatcgtgtgctggaagcccggcaagatggaggacgacatcgacaagatcaagcccagcgagagcaacgtgaccatcctgggcagattcgactacagccagtgcgacatctggtacatgagattcagcatggacttctggcagaagatgctggccctgggcaaccaggtgggcaagctgtacgtgtgggacctggaggtggaggacccccacaaggccaagtgcaccaccctgacccaccacaagtgcggcgccgccatcagacagaccagcttcagcagagacagcagcatcctgatcgccgtgtgcgacgacgccagcatctggagatgggacagactgagatag

SEQ ID NO: 80319 - DNA, 471 bp, Artificial Sequence
  Description of Artificial Sequence: Synthetic coding sequence
atgagcgagagagaggtgagcaccgcccccgccggcaccgacatgcccgccgccaagaagcagaagctgagcagcgacgagaacagcaaccccgacctgagcggcgacgagaacgacgacgccgtgagcatcgagagcggcaccaacaccgagagacccgacacccccaccaacacccccaacgcccccggcagaaagagctggggcaagggcaagtggaagagcaagaagtgcaagtacagcttcaagtgcgtgaacagcctgaaggaggaccacaaccagcccctgttcggcgtgcagttcaactggcacagcaaggagggcgaccccctggtgttcgccaccgtgggcagcaacagagtgaccctgtacgagtgccacagccagggcgagatcagactgctgcagagctacgtggacgccgacgccgacgagaacttctacacctgcgcctggaagtgctaccagtag

SEQ ID NO: 80320 - DNA, 660 bp, Artificial Sequence
  Description of Artificial Sequence: Synthetic coding sequence
atggacaactacgccgacctgagcgacaccgagctgaccaccctgctgagaagatacaacatcccccacggccccgtggtggacctgaacagcaccagaggcgacgccgacatgtacgacctgcccaagaaggaggacgccctgctgtaccagagcaagggctacaacgacgactactacgaggagagctacttcaccaccagaacctacggcgagcccgagagcgccggccccagcagagccgtgagacagagcgtgaccagcttccccgacgccgacgccttccaccaccaggtgcacgacgacgacctgctgagcagcagcgaggaggagtgcaaggacagagagagacccatgtacggcagagacagcgcctaccagagcatcacccactacagacccgtgagcgccagcagaagcagcctggacctgagctactaccccaccagcagcagcaccagcttcatgagcagcagcagcagcagcagcagctggctgaccagaagagccatcagacccgagaacagagcccccggcgccggcctgggccaggacagacaggtgcccctgtggggccagctgctgctgttcctggtgttcgtgatcgtgctgttcttcatctaccacttcatgcaggccgaggagggcaaccccttctag

SEQ ID NO: 80321 - DNA, 765 bp, Artificial Sequence
  Description of Artificial Sequence: Synthetic coding sequence
atggacaactacgccgacctgagcgacaccgagctgaccaccctgctgagaagatacaacatcccccacggccccgtggtgggcagcaccagaagactgtacgagaagaagatcttcgagtacgagacccagagaagaagactgagcccccccagcagcagcgccgccagcagctacagcttcagcgacctgaacagcaccagaggcgacgccgacatgtacgacctgcccaagaaggaggacgccctgctgtaccagagcaagggctacaacgacgactactacgaggagagctacttcaccaccagaacctacggcgagcccgagagcgccggccccagcagagccgtgagacagagcgtgaccagcttccccgacgccgacgccttccaccaccaggtgcacgacgacgacctgctgagcagcagcgaggaggagtgcaaggacagagagagacccatgtacggcagagacagcgcctaccagagcatcacccactacagacccgtgagcgccagcagaagcagcctggacctgagctactaccccaccagcagcagcaccagcttcatgagcagcagcagcagcagcagcagctggctgaccagaagagccatcagacccgagaacagagcccccggcgccggcctgggccaggacagacaggtgcccctgtggggccagctgctgctgttcctggtgttcgtgatcgtgctgttcttcatctaccacttcatgcaggccgaggagggcaaccccttctag

SEQ ID NO: 80322 - DNA, 441 bp, Artificial Sequence
  Description of Artificial Sequence: Synthetic coding sequence
atgaccaccaacgccggccccctgcacccctactggccccagcacctgagactggacaacttcgtgcccaacgacagacccacctggcacatcctggccggcctgttcagcgtgaccggcgtgctggtggtgaccacctggctgctgagcggcagagccgccgtggtgcccctgggcacctggagaagactgagcctgtgctggttcgccgtgtgcggcttcatccacctggtgatcgagggctggttcgtgctgtactacgaggacctgctgggcgaccaggccttcctgagccagctgtggaaggagtacgccaagggcgacagcagatacatcctgggcgacaacttcaccgtgtgcatggagaccatcaccgcctgcctgtggggccccctgagcctgtgggtggtgatcgccttcctgagacagcaccccctgtag

SEQ ID NO: 80323 - DNA, 483 bp, Artificial Sequence
  Description of Artificial Sequence: Synthetic coding sequence
atgaccaccaacgccggccccctgcacccctactggccccagcacctgagactggacaacttcgtgcccaacgacagacccacctggcacatcctggccggcctgttcagcgtgaccggcgtgctggtggtgaccacctggctgctgagcggcagagccgccgtggtgcccctgggcacctggagaagactgagcctgtgctggttcgccgtgtgcggcttcatccacctggtgatcgagggctggttcgtgctgtactacgaggacctgctgggcgaccaggccttcctgagccagctgtggaaggagtacgccaagggcgacagcagatacatcctgggcgacaacttcaccgtgtgcatggagaccatcaccgcctgcctgtggggccccctgagcctgtgggtggtgatcgccttcctgagacagcaccccctgagattcatcctgcagctggtggtgagcgtgggccagatctactag

SEQ ID NO: 80324 - DNA, 693 bp, Artificial Sequence
  Description of Artificial Sequence: Synthetic coding sequence
atgaccaccaacgccggccccctgcacccctactggccccagcacctgagactggacaacttcgtgcccaacgacagacccacctggcacatcctggccggcctgttcagcgtgaccggcgtgctggtggtgaccacctggctgctgagcggcagagccgccgtggtgcccctgggcacctggagaagactgagcctgtgctggttcgccgtgtgcggcttcatccacctggtgatcgagggctggttcgtgctgtactacgaggacctgctgggcgaccaggccttcctgagccagctgtggaaggagtacgccaagggcgacagcagatacatcctgggcgacaacttcaccgtgtgcatggagaccatcaccgcctgcctgtggggccccctgagcctgtgggtggtgatcgccttcctgagacagcaccccctgagattcatcctgcagctggtggtgagcgtgggccagatctacggcgacgtgctgtacttcctgaccgagcacagagacggcttccagcacggcgagctgggccaccccctgtacttctggttctacttcgtgttcatgaacgccctgtggctggtgctgcccggcgtgctggtgctggacgccgtgaagcacctgacccacgcccagagcaccctggacgccaaggccaccaaggccaagagcaagaagaactag

SEQ ID NO: 80325 - DNA, 873 bp, Artificial Sequence
  Description of Artificial Sequence: Synthetic coding sequence
atgtgcctggccggctgcacccccagaaaggccgccgcccccggcagaggcgccctgcccagagccagactgcccagaaccgcccccgccgccgccaccatgttccagcccgccgccaagagaggcttcaccatcgagagcctggtggccaaggacggcggcaccggcggcggcaccggcggcggcggcgccggcagccacctgctggccgccgccgccagcgaggagcccctgagacccaccgccctgaactacccccaccccagcgccgccgaggccgccttcgtgagcggcttccccgccgccgccgccgccggcgccggcagaagcctgtacggcggccccgagctggtgttccccgaggccatgaaccaccccgccctgaccgtgcaccccgcccaccagctgggcgccagccccctgcagcccccccacagcttcttcggcgcccagcacagagaccccctgcacttctacccctgggtgctgagaaacagattcttcggccacagattccaggccagcgacgtgccccaggacggcctgctgctgcacggccccttcgccagaaagcccaagagaatcagaaccgccttcagccccagccagctgctgagactggagagagccttcgagaagaaccactacgtggtgggcgccgagagaaagcagctggccggcagcctgagcctgagcgagacccaggtgaaggtgtggttccagaacagaagaaccaagtacaagagacagaagctggaggaggagggccccgagagcgagcagaagaagaagggcagccaccacatcaacagatggagaatcgccaccaagcaggccaacggcgaggacatcgacgtgaccagcaacgactag

SEQ ID NO: 80326 - DNA, 759 bp, Artificial Sequence
  Description of Artificial Sequence: Synthetic coding sequence
atgttccagcccgcccccaagagatgcttcaccatcgagagcctggtggccaaggacagccccctgcccgccagcagaagcgaggaccccatcagacccgccgccctgagctacgccaacagcagccccatcaaccccttcctgaacggcttccacagcgccgccgccgccgccgccggcagaggcgtgtacagcaaccccgacctggtgttcgccgaggccgtgagccacccccccaaccccgccgtgcccgtgcaccccgtgccccccccccacgccctggccgcccaccccctgcccagcagccacagcccccaccccctgttcgccagccagcagagagaccccagcaccttctacccctggctgatccacagatacagatacctgggccacagattccagggcaacgacaccagccccgagagcttcctgctgcacaacgccctggccagaaagcccaagagaatcagaaccgccttcagccccagccagctgctgagactggagcacgccttcgagaagaaccactacgtggtgggcgccgagagaaagcagctggcccacagcctgagcctgaccgagacccaggtgaaggtgtggttccagaacagaagaaccaagttcaagagacagaagctggaggaggagggcagcgacagccagcagaagaagaagggcacccaccacatcaacagatggagaatcgccaccaagcaggccagccccgaggagatcgacgtgaccagcgacgactag

SEQ ID NO: 80327 - DNA, 510 bp, Artificial Sequence
  Description of Artificial Sequence: Synthetic coding sequence
atgttccagcccgcccccaagagatgcttcaccatcgagagcctggtggccaaggacagccccctgcccgccagcagaagcgaggaccccatcagacccgccgccctgagctacgccaacagcagccccatcaaccccttcctgaacggcttccacagcgccgccgccgccgccgccggcagaggcgtgtacagcaaccccgacctggtgttcgccgaggccgtgagccacccccccaaccccgccgtgcccgtgcaccccgtgccccccccccacgccctggccgcccaccccctgcccagcagccacagcccccaccccctgttcgccagccagcagagagaccccagcaccttctacccctggctgatccacagatacagatacctgggccacagattccagggcaagagcatggtgagcgagcccaagaacaaggtgcagaaggccgaggccggcggcagaagactgagattcgccaccaaggagaagagagacgccccctactag

SEQ ID NO: 80328 - DNA, 957 bp, Artificial Sequence
  Description of Artificial Sequence: Synthetic coding sequence
atggccatcaagagcatcgccagcagactgagaggcagcagaagattcctgagcggcttcgtggccggcgccgtggtgggcgccgccggcgccggcctggccgccctgcagttcttcagaagccagggcgccgagggcgccctgaccggcaagcagcccgacggcgacgccgacagaaagcactgcaagttcaagcccgaccccaacatcccccccaccttcagcgccttcaacgaggactacgtgggcagcggctggagcagaggccacatggcccccgccggcaacaacaagttcagcagcaaggccatggccgagaccttctacctgagcaacatcgtgccccaggacttcgacaacaacagcggctactggaacagaatcgagatgtactgcagagagctgaccgagagattcgaggacgtgtgggtggtgagcggccccctgaccctgccccagaccagaggcgacggcaagaagatcgtgagctaccaggtgatcggcgaggacaacgtggccgtgcccagccacctgtacaaggtgatcctggccagaagaagcagcgtgagcaccgagcccctggccctgggcgccttcgtggtgcccaacgaggccatcggcttccagccccagctgaccgagttccaggtgagcctgcaggacctggagaagctgagcggcctggtgttcttcccccacctggacagaaccagcgacatcagaaacatctgcagcgtggacacctgcaagctgctggacttccaggagttcaccctgtacctgagcaccagaaagatcgagggcgccagaagcgtgctgagactggagaagatcatggagaacctgaagaacgccgagatcgagcccgacgactacttcatgagcagatacgagaagaagctggaggagctgaaggccaaggagcagagcggcacccagatcagaaagcccagctag

SEQ ID NO: 80329 - DNA, 1107 bp, Artificial Sequence
  Description of Artificial Sequence: Synthetic coding sequence
atggccatcaagagcatcgccagcagactgagaggcagcagaagattcctgagcggcttcgtggccggcgccgtggtgggcgccgccggcgccggcctggccgccctgcagttcttcagaagccagggcgccgagggcgccctgaccggcaagcagcccgacggcagcgccgagaaggccgtgctggagcagttcggcttccccctgaccggcaccgaggccagatgctacaccaaccacgccctgagctacgaccaggccaagagagtgcccagatgggtgctggagcacatcagcaagagcaagatcatgggcgacgccgacagaaagcactgcaagttcaagcccgaccccaacatcccccccaccttcagcgccttcaacgaggactacgtgggcagcggctggagcagaggccacatggcccccgccggcaacaacaagttcagcagcaaggccatggccgagaccttctacctgagcaacatcgtgccccaggacttcgacaacaacagcggctactggaacagaatcgagatgtactgcagagagctgaccgagagattcgaggacgtgtgggtggtgagcggccccctgaccctgccccagaccagaggcgacggcaagaagatcgtgagctaccaggtgatcggcgaggacaacgtggccgtgcccagccacctgtacaaggtgatcctggccagaagaagcagcgtgagcaccgagcccctggccctgggcgccttcgtggtgcccaacgaggccatcggcttccagccccagctgaccgagttccaggtgagcctgcaggacctggagaagctgagcggcctggtgttcttcccccacctggacagaaccagcgacatcagaaacatctgcagcgtggacacctgcaagctgctggacttccaggagttcaccctgtacctgagcaccagaaagatcgagggcgccagaagcgtgctgagactggagaagatcatggagaacctgaagaacgccgagatcgagcccgacgactacttcatgagcagatacgagaagaagctggaggagctgaaggccaaggagcagagcggcacccagatcagaaagcccagctag

SEQ ID NO: 80330 - DNA, 450 bp, Artificial Sequence
  Description of Artificial Sequence: Synthetic coding sequence
atggcccccgccggcaacaacaagttcagcagcaaggccatggccgagaccttctacctgagcaacatcgtgccccaggacttcgacaacaacagcggctactggaacagaatcgagatgtactgcagagagctgaccgagagattcgaggacgtgtgggtggtgagcggccccctgaccctgccccagaccagaggcgacggcaagaagatcgtgagctaccaggtgatcggcgaggacaacgtggccgtgcccagccacctgtacaaggaccacgccggctgctgcgtggagagccccctgggcaccagaaccagcgaggaggccaccgccagaatccaggagagagacgacggcggcagcgaccagagaagcggcctggtggagctgggcatctacttcgagggcagagccaacagaatcagcggcagaatcggctgcagagtgtag

SEQ ID NO: 80331 - DNA, 819 bp, Artificial Sequence
  Description of Artificial Sequence: Synthetic coding sequence
atgggctacttcctgaagctgtacgcctacgtgaacagccacagcctgttcgtgtgggtgtgcgacagaagctacaagagaagcttcagacccatgatcctgaacaagatcaaggagctgagcagaaaccagttcagcaccatgagccacctgagaaaggacagccagcccagcagccccggcgacgacgccatggacagaagcggcctgcccgacctgcagggcagattcgagctgagcggcaagaacagacagtaccccctggacgccctggagccccagcccagcatcggcgacatcaaggacatcaagaaggccgccaagagcatgctggaccccgcccacaagagccacttccaccccgtgacccccagcctggtgttcctgtgcttcatcttcgacggcctgcaccaggccctgctgagcgtgggcgtgagcaagagaagcaacaccgtggtgggcaacgagaacgaggagagaggcaccccctacgccagcagattcaaggacatgcccaacttcatcgccctggagaagagcagcgtgctgagacactgctgcgacctgctgatcggcatcgccgccggcagcagcgacaagatctgcaccagcagcctgcaggtgcagagaagattcaaggccatgatggccagcatcggcagactgagccacggcgagagcgccgacctgctgatcagctgcaacgccgagagcgccatcggctggatcagcagcagaccctgggtgggcgagctgatgttcaccctgctgttcggcgacttcgagagccccctgcacaagctgagaaagagcagctag

SEQ ID NO: 80332 - DNA, 894 bp, Artificial Sequence
  Description of Artificial Sequence: Synthetic coding sequence
atgagagccctgagagccggcctgaccctggccagcggcgccggcctgggcgccgtggtggagggctggagaagaagaagagaggacgccagagccgcccccggcctgctgggcagactgcccgtgctgcccgtggccgccgccgccgagctgccccccgtgcccggcggccccagaggccccggcgagctggccaagtacggcctgcccggcctggcccagctgaagagcagagagagctacgtgctgtgctacgaccccagaaccagaggcgccctgtgggtggtggagcagctgagacccgagagactgagaggcgacggcgacagaagagagtgcgacttcagagaggacgacagcgtgcacgcctaccacagagccaccaacgccgactacagaggcagcggcttcgacagaggccacctggccgccgccgccaaccacagatggagccagaaggccatggacgacaccttctacctgagcaacgtggccccccaggtgccccacctgaaccagaacgcctggaacaacctggagaagtacagcagaagcctgaccagaagctaccagaacgtgtacgtgtgcaccggccccctgttcctgcccagaaccgaggccgacggcaagagctacgtgaagtaccaggtgatcggcaagaaccacgtggccgtgcccacccacttcttcaaggtgctgatcctggaggccgccggcggccagatcgagctgagaacctacgtgatgcccaacgcccccgtggacgaggccatccccctggagagattcctggtgcccatcgagagcatcgagagagccagcggcctgctgttcgtgcccaacatcctggccagagccggcagcctgaaggccatcaccgccggcagcaagtag

SEQ ID NO: 80333 - DNA, 2847 bp, Artificial Sequence
  Description of Artificial Sequence: Synthetic coding sequence
atggtgttcctgcccctgaagtggagcctggccaccatgagcttcctgctgagcagcctgctggccctgctgaccgtgagcacccccagctggtgccagagcaccgaggccagccccaagagaagcgacggcacccccttcccctggaacaagatcagactgcccgagtacgtgatccccgtgcactacgacctgctgatccacgccaacctgaccaccctgaccttctggggcaccaccaaggtggagatcaccgccagccagcccaccagcaccatcatcctgcacagccaccacctgcagatcagcagagccaccctgagaaagggcgccggcgagagactgagcgaggagcccctgcaggtgctggagcaccccagacaggagcagatcgccctgctggcccccgagcccctgctggtgggcctgccctacaccgtggtgatccactacgccggcaacctgagcgagaccttccacggcttctacaagagcacctacagaaccaaggagggcgagctgagaatcctggccagcacccagttcgagcccaccgccgccagaatggccttcccctgcttcgacgagcccgccttcaaggccagcttcagcatcaagatcagaagagagcccagacacctggccatcagcaacatgcccctggtgaagagcgtgaccgtggccgagggcctgatcgaggaccacttcgacgtgaccgtgaagatgagcacctacctggtggccttcatcatcagcgacttcgagagcgtgagcaagatcaccaagagcggcgtgaaggtgagcgtgtacgccgtgcccgacaagatcaaccaggccgactacgccctggacgccgccgtgaccctgctggagttctacgaggactacttcagcatcccctaccccctgcccaagcaggacctggccgccatccccgacttccagagcggcgccatggagaactggggcctgaccacctacagagagagcgccctgctgttcgacgccgagaagagcagcgccagcagcaagctgggcatcaccatgaccgtggcccacgagctggcccaccagtggttcggcaacctggtgaccatggagtggtggaacgacctgtggctgaacgagggcttcgccaagttcatggagttcgtgagcgtgagcgtgacccaccccgagctgaaggtgggcgactacttcttcggcaagtgcttcgacgccatggaggtggacgccctgaacagcagccaccccgtgagcacccccgtggagaaccccgcccagatcagagagatgttcgacgacgtgagctacgacaagggcgcctgcatcctgaacatgctgagagagtacctgagcgccgacgccttcaagagcggcatcgtgcagtacctgcagaagcacagctacaagaacaccaagaacgaggacctgtgggacagcatggccagcatctgccccaccgacggcgtgaagggcatggacggcttctgcagcagaagccagcacagcagcagcagcagccactggcaccaggagggcgtggacgtgaagaccatgatgaacacctggaccctgcagaagggcttccccctgatcaccatcaccgtgagaggcagaaacgtgcacatgaagcaggagcactacatgaagggcagcgacggcgcccccgacaccggctacctgtggcacgtgcccctgaccttcatcaccagcaagagcgacatggtgcacagattcctgctgaagaccaagaccgacgtgctgatcctgcccgaggaggtggagtggatcaagttcaacgtgggcatgaacggctactacatcgtgcactacgaggacgacggctgggacagcctgaccggcctgctgaagggcacccacaccgccgtgagcagcaacgacagagccagcctgatcaacaacgccttccagctggtgagcatcggcaagctgagcatcgagaaggccctggacctgagcctgtacctgaagcacgagaccgagatcatgcccgtgttccagggcctgaacgagctgatccccatgtacaagctgatggagaagagagacatgaacgaggtggagacccagttcaaggccttcctgatcagactgctgagagacctgatcgacaagcagacctggaccgacgagggcagcgtgagcgagagaatgctgagaagccagctgctgctgctggcctgcgtgcacaactaccagccctgcgtgcagagagccgagggctacttcagaaagtggaaggagagcaacggcaacctgagcctgcccgtggacgtgaccctggccgtgttcgccgtgggcgcccagagcaccgagggctgggacttcctgtacagcaagtaccagttcagcctgagcagcaccgagaagagccagatcgagttcgccctgtgcagaacccagaacaaggagaagctgcagtggctgctggacgagagcttcaagggcgacaagatcaagacccaggagttcccccagatcctgaccctgatcggcagaaaccccgtgggctaccccctggcctggcagttcctgagaaagaactggaacaagctggtgcagaagttcgagctgggcagcagcagcatcgcccacatggtgatgggcaccaccaaccagttcagcaccagaaccagactggaggaggtgaagggcttcttcagcagcctgaaggagaacggcagccagctgagatgcgtgcagcagaccatcgagaccatcgaggagaacatcggctggatggacaagaacttcgacaagatcagagtgtggctgcagagcgagaagctggagcacgaccccgaggccgacgccaccggctag

SEQ ID NO: 80334 - DNA, 2826 bp, Artificial Sequence
  Description of Artificial Sequence: Synthetic coding sequence
atggtgttcctgcccctgaagtggagcctggccaccatgagcttcctgctgagcagcctgctggccctgctgaccgtgagcacccccagctggtgccagagcaccgaggccagccccaagagaagcgacggcacccccttcccctggaacaagatcagactgcccgagtacgtgatccccgtgcactacgacctgctgatccacgccaacctgaccaccctgaccttctggggcaccaccaaggtggagatcaccgccagccagcccaccagcaccatcatcctgcacagccaccacctgcagatcagcagagccaccctgagaaagggcgccggcgagagactgagcgaggagcccctgcaggtgctggagcaccccagacaggagcagatcgccctgctggcccccgagcccctgctggtgggcctgccctacaccgtggtgatccactacgccggcaacctgagcgagaccttccacggcttctacaagagcacctacagaaccaaggagggcgagctgagaatcctggccagcacccagttcgagcccaccgccgccagaatggccttcccctgcttcgacgagcccgccttcaaggccagcttcagcatcaagatcagaagagagcccagacacctggccatcagcaacatgcccctggtgaagagcgtgaccgtggccgagggcctgatcgaggaccacttcgacgtgaccgtgaagatgagcacctacctggtggccttcatcatcagcgacttcgagagcgtgagcaagatcaccaagagcggcgtgaaggtgagcgtgtacgccgtgcccgacaagatcaaccaggccgactacgccctggacgccgccgtgaccctgctggagttctacgaggactacttcagcatcccctaccccctgcccaagcaggacctggccgccatccccgacttccagagcggcgccatggagaactggggcctgaccacctacagagagagcgccctgctgttcgacgccgagaagagcagcgccagcagcaagctgggcatcaccatgaccgtggcccacgagctggcccaccagtggttcggcaacctggtgaccatggagtggtggaacgacctgtggctgaacgagggcttcgccaagttcatggagttcgtgagcgtgagcgtgacccaccccgagctgaaggtgggcgactacttcttcggcaagtgcttcgacgccatggaggtggacgccctgaacagcagccaccccgtgagcacccccgtggagaaccccgcccagatcagagagatgttcgacgacgtgagctacgacaagggcgcctgcatcctgaacatgctgagagagtacctgagcgccgacgccttcaagagcggcatcgtgcagtacctgcagaagcacagctacaagaacaccaagaacgaggacctgtgggacagcatggccagcatctgccccaccgacggcgtgaagggcatggacggcttctgcagcagaagccagcacagcagcagcagcagccactggcaccaggagggcgtggacgtgaagaccatgatgaacacctggaccctgcagaagggcttccccctgatcaccatcaccgtgagaggcagaaacgtgcacatgaagcaggagcactacatgaagggcagcgacggcgcccccgacaccggctacctgtggcacgtgcccctgaccttcatcaccagcaagagcgacatggtgcacagattcctgctgaagaccaagaccgacgtgctgatcctgcccgaggaggtggagtggatcaagttcaacgtgggcatgaacggctactacatcgtgcactacgaggacgacggctgggacagcctgaccggcctgctgaagggcacccacaccgccgtgagcagcaacgacagagccagcctgatcaacaacgccttccagctggtgagcatcggcaagctgagcatcgagaaggccctggacctgagcctgtacctgaagcacgagaccgagatcatgcccgtgttccagggcctgaacgagctgatccccatgtacaagctgatggagaagagagacatgaacgaggtggagacccagttcaaggccttcctgatcagactgctgagagacctgatcgacaagcagacctggaccgacgagggcagcgtgagcgagagaatgctgagaagccagctgctgctgctggcctgcgtgcacaactaccagccctgcgtgcagagagccgagggctacttcagaaagtggaaggagagcaacggcaacctgagcctgcccgtggacgtgaccctggccgtgttcgccgtgggcgcccagagcaccgagggctgggacttcctgtacagcaagtaccagttcagcctgagcagcaccgagaagagccagatcgagttcgccctgtgcagaacccagaacaaggagaagctgcagtggctgctggacgagagcttcaagggcgacaagatcaagacccaggagttcccccagatcctgaccctgatcggcagaaaccccgtgggctaccccctggcctggcagttcctgagaaagaactggaacaagctggtgcagaagttcgagctgggcagcagcagcatcgcccacatggtgatgggcaccaccaaccagttcagcaccagaaccagactggaggaggtgaagggcttcttcagcagcctgaaggagaacggcagccagctgagatgcgtgcagcagaccatcgagaccatcgaggagaacatcggctggatggacaagaacttcgacaagatcagagtgtggctgcagagcgagaagctggagagaatgtag

SEQ ID NO: 80335 - DNA, 2826 bp, Artificial Sequence; identical to SEQ ID NO: 80334
  Description of Artificial Sequence: Synthetic coding sequence

SEQ ID NO: 80336 - DNA, 390 bp, Artificial Sequence
  Description of Artificial Sequence: Synthetic coding sequence
atggtgttcctgcccctgaagtggagcctggccaccatgagcttcctgctgagcagcctgctggccctgctgaccgtgagcacccccagctggtgccagagcaccgaggccagccccaagagaagcgacggcacccccttcccctggaacaagatcagactgcccgagtacgtgatccccgtgcactacgacctgctgatccacgccaacctgaccaccctgaccttctggggcaccaccaaggtggagatcaccgccagccagcccaccagcaccatcatcctgcacagccaccacctgcagatcagcagagccaccctgagaaagggcgccggcgagagactgagcgaggagcccctgcaggtgctggagcaccccagacaggagtag

SEQ ID NO: 80337 - DNA, 2748 bp, Artificial Sequence
  Description of Artificial Sequence: Synthetic coding sequence
atgttccacagcagcgccatggtgaacagccacagaaagcccatgttcaacatccacagaggcttctactgcctgaccgccatcctgccccagatctgcatctgcagccagttcagcgtgcccagcagctaccacttcaccgaggaccccggcgccttccccgtggccaccaacggcgagagattcccctggcaggagctgagactgcccagcgtggtgatccccctgcactacgacctgttcgtgcaccccaacctgaccagcctggacttcgtggccagcgagaagatcgaggtgctggtgagcaacgccacccagttcatcatcctgcacagcaaggacctggagatcaccaacgccaccctgcagagcgaggaggacagcagatacatgaagcccggcaaggagctgaaggtgctgagctaccccgcccacgagcagatcgccctgctggtgcccgagaagctgaccccccacctgaagtactacgtggccatggacttccaggccaagctgggcgacggcttcgagggcttctacaagagcacctacagaaccctgggcggcgagaccagaatcctggccgtgaccgacttcgagcccacccaggccagaatggccttcccctgcttcgacgagcccctgttcaaggccaacttcagcatcaagatcagaagagagagcagacacatcgccctgagcaacatgcccaaggtgagcatctacgccagccccgacaagagaaaccagacccactacgccctgcaggccagcctgaagctgctggacttctacgagaagtacttcgacatctactaccccctgagcaagctggacctgatcgccatccccgacttcgcccccggcgccatggagaactggggcctgatcacctacagagagaccagcctgctgttcgaccccaagaccagcagcgccagcgacaagctgtgggtgaccagagtgatcgcccacgagctggcccaccagtggttcggcaacctggtgaccatggagtggtggaacgacatctggctgaaggagggcttcgccaagtacatggagctgatcgccgtgaacgccacctaccccgagctgcagttcgacgactacttcctgaacgtgtgcttcgaggtgatcaccaaggacagcctgaacagcagcagacccatcagcaagcccgccgagacccccacccagatccaggagatgttcgacgaggtgagctacaacaagggcgcctgcatcctgaacatgctgaaggacttcctgggcgaggagaagttccagaagggcatcatccagtacctgaagaagttcagctacagaaacgccaagaacgacgacctgtggagcagcctgagcaacagctgcctggagagcgacttcaccagcggcggcgtgtgccacagcgaccccaagatgaccagcaacatgctggccttcctgggcgagaacgccgaggtgaaggagatgatgaccacctggaccctgcagaagggcatccccctgctggtggtgaagcaggacggctgcagcctgagactgcagcaggagagattcctgcagggcgtgttccaggaggaccccgagtggagagccctgcaggagagatacctgtggcacatccccctgacctacagcaccagcagcagcaacgtgatccacagacacatcctgaagagcaagaccgacaccctggacctgcccgagaagaccagctgggtgaagttcaacgtggacagcaacggctactacatcgtgcactacgagggccacggctgggaccagctgatcacccagctgaaccagaaccacaccctgctgagacccaaggacagagtgggcctgatccacgacgtgttccagctggtgggcgccggcagactgaccctggacaaggccctggacatgacctactacctgcagcacgagaccagcagccccgccctgctggagggcctgagctacctggagagcttctaccacatgatggacagaagaaacatcagcgacatcagcgagaacctgaagagatacctgctgcagtacttcaagcccgtgatcgacagacagagctggagcgacaagggcagcgtgtgggacagaatgctgagaagcgccctgctgaagctggcctgcgacctgaaccacgccccctgcatccagaaggccgccgagctgttcagccagtggatggagagcagcggcaagctgaacatccccaccgacgtgctgaagatcgtgtacagcgtgggcgcccagaccaccgccggctggaactacctgctggagcagtacgagctgagcatgagcagcgccgagcagaacaagatcctgtacgccctgagcaccagcaagcaccaggagaagctgctgaagctgatcgagctgggcatggagggcaaggtgatcaagacccagaacctggccgccctgctgcacgccatcgccagaagacccaagggccagcagctggcctgggacttcgtgagagagaactggacccacctgctgaagaagttcgacctgggcagctacgacatcagaatgatcatcagcggcaccaccgcccacttcagcagcaaggacaagctgcaggaggtgaagctgttcttcgagagcctggaggcccagggcagccacctggacatcttccagaccgtgctggagaccatcaccaagaacatcaagtggctggagaagaacctgcccaccctgagaacctggctgatggtgaacacctag

SEQ ID NO: 80338 - DNA, 2883 bp, Artificial Sequence
  Description of Artificial Sequence: Synthetic coding sequence
atgttccacagcagcgccatggtgaacagccacagaaagcccatgttcaacatccacagaggcttctactgcctgaccgccatcctgccccagatctgcatctgcagccagttcagcgtgcccagcagctaccacttcaccgaggaccccggcgccttccccgtggccaccaacggcgagagattcccctggcaggagctgagactgcccagcgtggtgatccccctgcactacgacctgttcgtgcaccccaacctgaccagcctggacttcgtggccagcgagaagatcgaggtgctggtgagcaacgccacccagttcatcatcctgcacagcaaggacctggagatcaccaacgccaccctgcagagcgaggaggacagcagatacatgaagcccggcaaggagctgaaggtgctgagctaccccgcccacgagcagatcgccctgctggtgcccgagaagctgaccccccacctgaagtactacgtggccatggacttccaggccaagctgggcgacggcttcgagggcttctacaagagcacctacagaaccctgggcggcgagaccagaatcctggccgtgaccgacttcgagcccacccaggccagaatggccttcccctgcttcgacgagcccctgttcaaggccaacttcagcatcaagatcagaagagagagcagacacatcgccctgagcaacatgcccaaggtgaagaccatcgagctggagggcggcctgctggaggaccacttcgagaccaccgtgaagatgagcacctacctggtggcctacatcgtgtgcgacttccacagcctgagcggcttcaccagcagcggcgtgaaggtgagcatctacgccagccccgacaagagaaaccagacccactacgccctgcaggccagcctgaagctgctggacttctacgagaagtacttcgacatctactaccccctgagcaagctggacctgatcgccatccccgacttcgcccccggcgccatggagaactggggcctgatcacctacagagagaccagcctgctgttcgaccccaagaccagcagcgccagcgacaagctgtgggtgaccagagtgatcgcccacgagctggcccaccagtggttcggcaacctggtgaccatggagtggtggaacgacatctggctgaaggagggcttcgccaagtacatggagctgatcgccgtgaacgccacctaccccgagctgcagttcgacgactacttcctgaacgtgtgcttcgaggtgatcaccaaggacagcctgaacagcagcagacccatcagcaagcccgccgagacccccacccagatccaggagatgttcgacgaggtgagctacaacaagggcgcctgcatcctgaacatgctgaaggacttcctgggcgaggagaagttccagaagggcatcatccagtacctgaagaagttcagctacagaaacgccaagaacgacgacctgtggagcagcctgagcaacagctgcctggagagcgacttcaccagcggcggcgtgtgccacagcgaccccaagatgaccagcaacatgctggccttcctgggcgagaacgccgaggtgaaggagatgatgaccacctggaccctgcagaagggcatccccctgctggtggtgaagcaggacggctgcagcctgagactgcagcaggagagattcctgcagggcgtgttccaggaggaccccgagtggagagccctgcaggagagatacctgtggcacatccccctgacctacagcaccagcagcagcaacgtgatccacagacacatcctgaagagcaagaccgacaccctggacctgcccgagaagaccagctgggtgaagttcaacgtggacagcaacggctactacatcgtgcactacgagggccacggctgggaccagctgatcacccagctgaaccagaaccacaccctgctgagacccaaggacagagtgggcctgatccacgacgtgttccagctggtgggcgccggcagactgaccctggacaaggccctggacatgacctactacctgcagcacgagaccagcagccccgccctgctggagggcctgagctacctggagagcttctaccacatgatggacagaagaaacatcagcgacatcagcgagaacctgaagagatacctgctgcagtacttcaagcccgtgatcgacagacagagctggagcgacaagggcagcgtgtgggacagaatgctgagaagcgccctgctgaagctggcctgcgacctgaaccacgccccctgcatccagaaggccgccgagctgttcagccagtggatggagagcagcggcaagctgaacatccccaccgacgtgctgaagatcgtgtacagcgtgggcgcccagaccaccgccggctggaactacctgctggagcagtacgagctgagcatgagcagcgccgagcagaacaagatcctgtacgccctgagcaccagcaagcaccaggagaagctgctgaagctgatcgagctgggcatggagggcaaggtgatcaagacccagaacctggccgccctgctgcacgccatcgccagaagacccaagggccagcagctggcctgggacttcgtgagagagaactggacccacctgctgaagaagttcgacctgggcagctacgacatcagaatgatcatcagcggcaccaccgcccacttcagcagcaaggacaagctgcaggaggtgaagctgttcttcgagagcctggaggcccagggcagccacctggacatcttccagaccgtgctggagaccatcaccaagaacatcaagtggctggagaagaacctgcccaccctgagaacctggctgatggtgaacacctag

SEQ ID NO: 80339 - DNA, 1053 bp, Artificial Sequence
  Description of Artificial Sequence: Synthetic coding sequence
atgttccacagcagcgccatggtgaacagccacagaaagcccatgttcaacatccacagaggcttctactgcctgaccgccatcctgccccagatctgcatctgcagccagttcagcgtgcccagcagctaccacttcaccgaggaccccggcgccttccccgtggccaccaacggcgagagattcccctggcaggagctgagactgcccagcgtggtgatccccctgcactacgacctgttcgtgcaccccaacctgaccagcctggacttcgtggccagcgagaagatcgaggtgctggtgagcaacgccacccagttcatcatcctgcacagcaaggacctggagatcaccaacgccaccctgcagagcgaggaggacagcagatacatgaagcccggcaaggagctgaaggtgctgagctaccccgcccacgagcagatcgccctgctggtgcccgagaagctgaccccccacctgaagtactacgtggccatggacttccaggccaagctgggcgacggcttcgagggcttctacaagagcacctacagaaccctgggcggcgagaccagaatcctggccgtgaccgacttcgagcccacccaggccagaatggccttcccctgcttcgacgagcccctgttcaaggccaacttcagcatcaagatcagaagagagagcagacacatcgccctgagcaacatgcccaaggtgaagaccatcgagctggagggcggcctgctggaggaccacttcgagaccaccgtgaagatgagcacctacctggtggcctacatcgtgtgcgacttccacagcctgagcggcttcaccagcagcggcgtgaaggtgagcatctacgccagccccgacaagagaaaccagacccactacgccctgcaggccagcctgaagctgctggacttctacgagaagtacttcgacatctactaccccctgagcaagctgggcatgttcaagttccacatcatcgtgttcatcttcgcccacaagacctgcttcgacctgttccccctgagcctgagcatgtag

SEQ ID NO: 80340 - DNA, 2085 bp, Artificial Sequence
  Description of Artificial Sequence: Synthetic coding sequence
atgttccacagcagcgccatggtgaacagccacagaaagcccatgttcaacatccacagaggcttctactgcctgaccgccatcctgccccagatctgcatctgcagccagttcagcgtgcccagcagctaccacttcaccgaggaccccggcgccttccccgtggccaccaacggcgagagattcccctggcaggagctgagactgcccagcgtggtgatccccctgcactacgacctgttcgtgcaccccaacctgaccagcctggacttcgtggccagcgagaagatcgaggtgctggtgagcaacgccacccagttcatcatcctgcacagcaaggacctggagatcaccaacgccaccctgcagagcgaggaggacagcagatacatgaagcccggcaaggagctgaaggtgctgagctaccccgcccacgagcagatcgccctgctggtgcccgagaagctgaccccccacctgaagtactacgtggccatggacttccaggccaagctgggcgacggcttcgagggcttctacaagagcacctacagaaccctgggcggcgagaccagaatcctggccgtgaccgacttcgagcccacccaggccagaatggccttcccctgcttcgacgagcccctgttcaaggccaacttcagcatcaagatcagaagagagagcagacacatcgccctgagcaacatgcccaaggtgaagaccatcgagctggagggcggcctgctggaggaccacttcgagaccaccgtgaagatgagcacctacctggtggcctacatcgtgtgcgacttccacagcctgagcggcttcaccagcagcggcgtgaaggtgagcatctacgccagccccgacaagagaaaccagacccactacgccctgcaggccagcctgaagctgctggacttctacgagaagtacttcgacatctactaccccctgagcaagctggacctgatcgccatccccgacttcgcccccggcgccatggagaactggggcctgatcacctacagagagaccagcctgctgttcgaccccaagaccagcagcgccagcgacaagctgtgggtgaccagagtgatcgcccacgagctggcccaccagtggttcggcaacctggtgaccatggagtggtggaacgacatctggctgaaggagggcttcgccaagtacatggagctgatcgccgtgaacgccacctaccccgagctgcagttcgacgactacttcctgaacgtgtgcttcgaggtgatcaccaaggacagcctgaacagcagcagacccatcagcaagcccgccgagacccccacccagatccaggagatgttcgacgaggtgagctacaacaagggcgcctgcatcctgaacatgctgaaggacttcctgggcgaggagaagttccagaagggcatcatccagtacctgaagaagttcagctacagaaacgccaagaacgacgacctgtggagcagcctgagcaacagctgcctggagagcgacttcaccagcggcggcgtgtgccacagcgaccccaagatgaccagcaacatgctggccttcctgggcgagaacgccgaggtgaaggagatgatgaccacctggaccctgcagaagggcatccccctgctggtggtgaagcaggacggctgcagcctgagactgcagcaggagagattcctgcagggcgtgttccaggaggaccccgagtggagagccctgcaggagagatacctgtggcacatccccctgacctacagcaccagcagcagcaacgtgatccacagacacatcctgaagagcaagaccgacaccctggacctgcccgagaagaccagctgggtgaagttcaacgtggacagcaacggctactacatcgtgcactacgagggccacggctgggaccagctgatcacccagctgaaccagaaccacaccctgctgagacccaaggacagagtgggcctgatccacgacgtgttccagctggtgggcgccggcagactgaccctggacaaggccctggacatgacctactacctgcagcacgagaccagcagcccctag

SEQ ID NO: 80341 - DNA, 1452 bp, Artificial Sequence
  Description of Artificial Sequence: Synthetic coding sequence
atggaggagggcggcggcggcgtgagaagcctggtgcccggcggccccgtgctgctggtgctgtgcggcctgctggaggccagcggcggcggcagagccctgccccagctgagcgacgacatccccttcagagtgaactggcccggcaccgagttcagcctgcccaccaccggcgtgctgtacaaggaggacaactacgtgatcatgaccaccgcccacaaggagaagtacaagtgcatcctgcccctggtgaccagcggcgacgaggaggaggagaaggactacaagggccccaaccccagagagctgctggagcccctgttcaagcagagcagctgcagctacagaatcgagagctactggacctacgaggtgtgccacggcaagcacatcagacagtaccacgaggagaaggagaccggccagaagatcaacatccacgagtactacctgggcaacatgctggccaagaacctgctgttcgagaaggagagagaggccgaggagaaggagaagagcaacgagatccccaccaagaacatcgagggccagatgaccccctactaccccgtgggcatgggcaacggcaccccctgcagcctgaagcagaacagacccagaagcagcaccgtgatgtacatctgccaccccgagagcaagcacgagatcctgagcgtggccgaggtgaccacctgcgagtacgaggtggtgatcctgacccccctgctgtgcagccaccccaagtacagattcagagccagccccgtgaacgacatcttctgccagagcctgcccggcagccccttcaagcccctgaccctgagacagctggagcagcaggaggagatcctgagagtgcccttcagaagaaacaaggaggaggacctgcagagcaccaaggaggagagattccccgccatccacaagagcatcgccatcggcagccagcccgtgctgaccgtgggcaccacccacatcagcaagctgaccgacgaccagctgatcaaggagttcctgagcggcagctactgcttcagaggcggcgtgggctggtggaagtacgagttctgctacggcaagcacgtgcaccagtaccacgaggacaaggacagcggcaagaccagcgtggtggtgggcacctggaaccaggaggagcacatcgagtgggccaagaagaacaccgccagagcctaccacctgcaggacgacggcacccagaccgtgagaatggtgagccacttctacggcaacggcgacatctgcgacatcaccgacaagcccagacaggtgaccgtgaagctgaagtgcaaggagagcgacagcccccacgccgtgaccgtgtacatgctggagccccacagctgccagtacatcctgggcgtggagagccccgtgatctgcaagatcctggacaccgccgacgagaacggcctgctgagcctgcccaactag

SEQ ID NO: 80342 - DNA, 1290 bp, Artificial Sequence
  Description of Artificial Sequence: Synthetic coding sequence
atggaggagggcggcggcggcgtgagaagcctggtgcccggcggccccgtgctgctggtgctgtgcggcctgctggaggccagcggcggcggcagagccctgccccagctgagcgacgacatccccttcagagtgaactggcccggcaccgagttcagcctgcccaccaccggcgtgctgtacaaggaggacaactacgtgatcatgaccaccgcccacaaggagaagtacaagtgcatcctgcccctggtgaccagcggcgacgaggaggaggagaaggactacaagggccccaaccccagagagctgctggagcccctgttcaagcagagcagctgcagctacagaatcgagagctactggacctacgaggtgtgccacggcaagcacatcagacagtaccacgaggagaaggagaccggccagaagatcaacatccacgagtactacctgggcaacatgctggccaagaacctgctgttcgagaaggagagagaggccgaggagaaggagaagagcaacgagatccccaccaagaacatcgagggccagatgaccccctactaccccgtgggcatgggcaacggcaccccctgcagcctgaagcagaacagacccagaagcagcaccgtgatgtacatctgccaccccgagagcaagcacgagatcctgagcgtggccgaggtgaccacctgcgagtacgaggtggtgatcctgacccccctgctgtgcagccaccccaagtacagattcagagccagccccgtgaacgacatcttctgccagagcctgcccggcagccccttcaagcccctgaccctgagacagctggagcagcaggaggagatcctgagagtgcccttcagaagaaacaaggagggcgtgggctggtggaagtacgagttctgctacggcaagcacgtgcaccagtaccacgaggacaaggacagcggcaagaccagcgtggtggtgggcacctggaaccaggaggagcacatcgagtgggccaagaagaacaccgccagagcctaccacctgcaggacgacggcacccagaccgtgagaatggtgagccacttctacggcaacggcgacatctgcgacatcaccgacaagcccagacaggtgaccgtgaagctgaagtgcaaggagagcgacagcccccacgccgtgaccgtgtacatgctggagccccacagctgccagtacatcctgggcgtggagagccccgtgatctgcaagatcctggacaccgccgacgagaacggcctgctgagcctgcccaactag

SEQ ID NO: 80343 - DNA, 1374 bp, Artificial Sequence
  Description of Artificial Sequence: Synthetic coding sequence
atggaggagggcggcggcggcgtgagaagcctggtgcccggcggccccgtgctgctggtgctgtgcggcctgctggaggccagcggcggcggcagagccctgccccagctgagcgacgacatccccttcagagtgaactggcccggcaccgagttcagcctgcccaccaccggcgtgctgtacaaggaggacaactacgtgatcatgaccaccgcccacaaggagaagtacaagtgcatcctgcccctggtgaccagcggcgacgaggaggaggagaaggactacaagggccccaaccccagagagctgctggagcccctgttcaagcagagcagctgcagctacagaatcgagagctactggacctacgaggtgtgccacggcaagcacatcagacagtaccacgaggagaaggagaccggccagaagatcaacatccacgagtactacctgggcaacatgctggccaagaacctgctgttcgagaaggagagagaggccgaggagaaggagaagagcaacgagatccccaccaagaacatcgagggccagatgaccccctactaccccgtgggcatgggcaacggcaccccctgcagcctgaagcagaacagacccagaagcagcaccgtgatgtacatctgccaccccgagagcaagcacgagatcctgagcgtggccgaggtgaccacctgcgagtacgaggtggtgatcctgacccccctgctgtgcagccaccccaagtacagattcagagccagccccgtgaacgacatcttctgccagagcctgcccggcagccccttcaagcccctgaccctgagacagctggagcagcaggaggagatcctgagagtgcccttcagaagaaacaaggaggaggacctgcagagcaccaaggaggagagattccccgccatccacaagagcatcgccatcggcagccagcccgtgctgaccgtgggcaccacccacatcagcaagctgaccgacgaccagctgatcaaggagttcctgagcggcagctactgcttcagaggcggcgtgggctggtggaagtacgagttctgctacggcaagcacgtgcaccagtaccacgaggacaaggacagcggcaagaccagcgtggtggtgggcacctggaaccaggaggagcacatcgagtgggccaagaagaacaccgccagagcctaccacctgcaggacgacggcacccagaccgtgagatgcaaggagagcgacagcccccacgccgtgaccgtgtacatgctggagccccacagctgccagtacatcctgggcgtggagagccccgtgatctgcaagatcctggacaccgccgacgagaacggcctgctgagcctgcccaactag

SEQ ID NO: 80344 - DNA, 2715 bp, Artificial Sequence
  Description of Artificial Sequence: Synthetic coding sequence
atggagtggggcagcgagagcgccgccgtgagaagacacagagtgggcgtggagagaagagagggcgccgccgccgcccccccccccgagagagaggccagagcccaggagcccctggtggacggctgcagcggcggcggcagaaccagaaagagaagccccggcggcagcggcggcgccagcagaggcgccggcaccggcctgagcgaggtgagagccgccctgggcctggccctgtacctgatcgccctgagaaccctggtgcagctgagcctgcagcagctggtgctgagaggcgccgccggccacagaggcgagttcgacgccctgcaggccagagactacctggagcacatcaccagcatcggccccagaaccaccggcagccccgagaacgagatcctgaccgtgcactacctgctggagcagatcaagctgatcgaggtgcagagcaacagcctgcacaagatcagcgtggacgtgcagagacccaccggcagcttcagcatcgacttcctgggcggcttcaccagctactacgacaacatcaccaacgtggtggtgaagctggagcccagagacggcgcccagcacgccgtgctggccaactgccacttcgacagcgtggccaacagccccggcgccagcgacgacgccgtgagctgcagcgtgatgctggaggtgctgagagtgctgagcaccagcagcgaggccctgcaccacgccgtgatcttcctgttcaacggcgccgaggagaacgtgctgcaggccagccacggcttcatcacccagcacccctgggccagcctgatcagagccttcatcaacctggaggccgccggcgtgggcggcaaggagctggtgttccagaccggccccgagaacccctggctggtgcaggcctacgtgagcgccgccaagcaccccttcgccagcgtggtggcccaggaggtgttccagagcggcatcatccccagcgacaccgacttcagaatctacagagacttcggcaacatccccggcatcgacctggccttcatcgagaacggctacatctaccacaccaagtacgacaccgccgacagaatcctgaccgacagcatccagagagccggcgacaacatcctggccgtgctgaagcacctggccaccagcgacatgctggccgccgccagcaagtacagacacggcaacatggtgttcttcgacgtgctgggcctgttcgtgatcgcctaccccagcagaatcggcagcatcatcaactacatggtggtgatgggcgtggtgctgtacctgggcaagaagttcctgcagcccaagcacaagaccggcaactacaagaaggacttcctgtgcggcctgggcatcaccctgatcagctggttcaccagcctggtgaccgtgctgatcatcgccgtgttcatcagcctgatcggccagagcctgagctggtacaaccacttctacgtgagcgtgtgcctgtacggcaccgccaccgtggccaagatcatcctgatccacaccctggccaagagattctactacatgaacgccagcgcccagtacctgggcgaggtgttcttcgacatcagcctgttcgtgcactgctgcttcctggtgaccctgacctaccagggcctgtgcagcgccttcatcagcgccgtgtgggtggccttccccctgctgaccaagctgtgcgtgcacaaggacttcaagcagcacggcgcccagggcaagttcatcgccttctacctgctgggcatgttcatcccctacctgtacgccctgtacctgatctgggccgtgttcgagatgttcacccccatcctgggcagaagcggcagcgagatcccccccgacgtggtgctggccagcatcctggccggctgcaccatgatcctgagcagctacttcatcaacttcatctacctggccaagagcaccaagaagaccatgctgaccctgaccctggtgtgcgccatcaccttcctgctggtgtgcagcggcaccttcttcccctacagcagcaaccccgccaaccccaagcccaagagagtgttcctgcagcacatgaccagaaccttccacgacctggagggcaacgccgtgaagagagacagcggcatctggatcaacggcttcgactacaccggcatcagccacatcaccccccacatccccgagatcaacgacagcatcagagcccactgcgaggagaacgcccccctgtgcggcttcccctggtacctgcccgtgcacttcctgatcagaaagaactggtacctgcccgcccccgaggtgagccccagaaaccccccccacttcagactgatcagcaaggagcagaccccctgggacagcatcaagctgaccttcgaggccaccggccccagccacatgagcttctacgtgagagcccacaagggcagcaccctgagccagtggagcctgggcaacggcacccccgtgaccagcaagggcggcgactacttcgtgttctacagccacggcctgcaggccagcgcctggcagttctggatcgaggtgcaggtgagcgaggagcaccccgagggcatggtgaccgtggccatcgccgcccactacctgagcggcgaggacaagagaagcccccagctggacgccctgaaggagaagttccccgactggaccttccccagcgcctgggtgtgcacctacgacctgttcgtgttctag

SEQ ID NO: 80345 - DNA, 1056 bp, Artificial Sequence
  Description of Artificial Sequence: Synthetic coding sequence
atgctggaggtgctgagagtgctgagcaccagcagcgaggccctgcaccacgccgtgatcttcctgttcaacggcgccgaggagaacgtgctgcaggccagccacggcttcatcacccagcacccctgggccagcctgatcagagccttcatcaacctggaggccgccggcgtgggcggcaaggagctggtgttccagaccggccccgagaacccctggctggtgcaggcctacgtgagcgccgccaagcaccccttcgccagcgtggtggcccaggaggtgttccagagcggcatcatccccagcgacaccgacttcagaatctacagagacttcggcaacatccccggcatcgacctggccttcatcgagaacggctacatctaccacaccaagtacgacaccgccgacagaatcctgaccgacagcatccagagagccggcgacaacatcctggccgtgctgaagcacctggccaccagcgacatgctggccgccgccagcaagtacagacacggcaacatggtgttcttcgacgtgctgggcctgttcgtgatcgcctaccccagcagaatcggcagcatcatcaactacatggtggtgatgggcgtggtgctgtacctgggcaagaagttcctgcagcccaagcacaagaccggcaactacaagaaggacttcctgtgcggcctgggcatcaccctgatcagctggttcaccagcctggtgaccgtgctgatcatcgccgtgttcatcagcctgatcggccagagcctgagctggtacaaccacttctacgtgagcgtgtgcctgtacggcaccgccaccgtggccaagatcatcctgatccacaccctggccaagagattctactacatgaacgccagcgcccagtacctgggcgaggtgttcttcgacatcagcctgttcgtgcactgctgcttcctggtgaccctgacctaccagggcctgtgcagcgccttcatcagcgccgtgtgggtggccttccccctgctgaccaagctgtgcgtgcacaaggacttcaagcagcacgactag

SEQ ID NO: 80346 - DNA, 2715 bp, Artificial Sequence; identical to SEQ ID NO: 80344
  Description of Artificial Sequence: Synthetic coding sequence

SEQ ID NO: 80347 - DNA, 1260 bp, Artificial Sequence
  Description of Artificial Sequence: Synthetic coding sequence
atggtggtgatgggcgtggtgctgtacctgggcaagaagttcctgcagcccaagcacaagaccggcaactacaagaaggacttcctgtgcggcctgggcatcaccctgatcagctggttcaccagcctggtgaccgtgctgatcatcgccgtgttcatcagcctgatcggccagagcctgagctggtacaaccacttctacgtgagcgtgtgcctgtacggcaccgccaccgtggccaagatcatcctgatccacaccctggccaagagattctactacatgaacgccagcgcccagtacctgggcgaggtgttcttcgacatcagcctgttcgtgcactgctgcttcctggtgaccctgacctaccagggcctgtgcagcgccttcatcagcgccgtgtgggtggccttccccctgctgaccaagctgtgcgtgcacaaggacttcaagcagcacggcgcccagggcaagttcatcgccttctacctgctgggcatgttcatcccctacctgtacgccctgtacctgatctgggccgtgttcgagatgttcacccccatcctgggcagaagcggcagcgagatcccccccgacgtggtgctggccagcatcctggccggctgcaccatgatcctgagcagctacttcatcaacttcatctacctggccaagagcaccaagaagaccatgctgaccctgaccctggtgtgcgccatcaccttcctgctggtgtgcagcggcaccttcttcccctacagcagcaaccccgccaaccccaagcccaagagagtgttcctgcagcacatgaccagaaccttccacgacctggagggcaacgccgtgaagagagacagcggcatctggatcaacggcttcgactacaccggcatcagccacatcaccccccacatccccgagatcaacgacagcatcagagcccactgcgaggagaacgcccccctgtgcggcttcccctggtacctgcccgtgcacttcctgatcagaaagaactggtacctgcccgcccccgaggtgagccccagaaaccccccccacttcagactgatcagcaaggagcagaccccctgggacagcatcaagctgaccttcgaggccaccgcctgcctgcccatcctgcagatcctggacctgcccgccagcaccatcatgaccaagccctacgtgctgctgtgcagcagcccccagagagtgaacaccttcagcgtggtgagctggcagtggcaccccagccacaagtag

SEQ ID NO: 80348 - DNA, 786 bp, Artificial Sequence
  Description of Artificial Sequence: Synthetic coding sequence
atggccgccgccgtgcccagagccgccttcctgagccccctgctgcccctgctgctgggcttcctgctgctgagcgccccccacggcggcagcggcctgcacaccaagggcgccctgcccctggacaccgtgaccttctacaaggtgatccccaagagcaagttcgtgctggtgaagttcgacacccagtacccctacggcgagaagcaggacgagttcaagagactggccgagaacagcgccagcagcgacgacctgctggtggccgaggtgggcatcagcgactacggcgacaagctgaacatggagctgagcgagaagtacaagctggacaaggagagctaccccgtgttctacctgttcagagacggcgacttcgagaaccccgtgccctacaccggcgccgtgaaggtgggcgccatccagagatggctgaagggccagggcgtgtacctgggcatgcccggctgcctgcccgtgtacgacgccctggccggcgagttcatcagagccagcggcgtggaggccagacaggccctgctgaagcagggccaggacaacctgagcagcgtgaaggagacccagaagaagtgggccgagcagtacctgaagatcatgggcaagatcctggaccagggcgaggacttccccgccagcgagatgaccagaatcgccagactgatcgagaagaacaagatgagcgacggcaagaaggaggagctgcagaagagcctgaacatcctgaccgccttccagaagaagggcgccgagaaggaggagctgtag

SEQ ID NO: 80349 - DNA, 162 bp, Artificial Sequence
  Description of Artificial Sequence: Synthetic coding sequence
atggccgccgccgtgcccagagccgccttcctgagccccctgctgcccctgctgctgggcttcctgctgctgagcgccccccacggcggcagcggcctgcacaccaagggcgccctgcccctggacaccgtgaccttctacaagatcatggtgaccagctag

SEQ ID NO: 80350 - DNA, 2925 bp, Artificial Sequence
  Description of Artificial Sequence: Synthetic coding sequence
atgagaagagccggcatcggcgaggacagcagactgggcctgcaggcccagcccggcgccgagcccagccccggcagagccggcaccgagagaagcctgggcggcacccagggccccggccagccctgcagctgccccggcgccatggccagcgccgtgagaggcagcagaccctggcccagactgggcctgcagctgcagttcgccgccctgctgctgggcaccctgagcccccaggtgcacaccctgagacccgagaacctgctgctggtgagcaccctggacggcagcctgcacgccctgagcaagcagaccggcgacctgaagtggaccctgagagacgaccccgtgatcgagggccccatgtacgtgaccgagatggccttcctgagcgaccccgccgacggcagcctgtacatcctgggcacccagaagcagcagggcctgatgaagctgcccttcaccatccccgagctggtgcacgccagcccctgcagaagcagcgacggcgtgttctacaccggcagaaagcaggacgcctggttcgtggtggaccccgagagcggcgagacccagatgaccctgaccaccgagggccccagcacccccagactgtacatcggcagaacccagtacaccgtgaccatgcacgaccccagagcccccgccctgagatggaacaccacctacagaagatacagcgccccccccatggacggcagccccggcaagtacatgagccacctggccagctgcggcatgggcctgctgctgaccgtggaccccggcagcggcaccgtgctgtggacccaggacctgggcgtgcccgtgatgggcgtgtacacctggcaccaggacggcctgagacagctgccccacctgaccctggccagagacaccctgcacttcctggccctgagatggggccacatcagactgcccgccagcggccccagagacaccgccaccctgttcagcaccctggacacccagctgctgatgaccctgtacgtgggcaaggacgagaccggcttctacgtgagcaaggccctggtgcacaccggcgtggccctggtgcccagaggcctgaccctggcccccgccgacggccccaccaccgacgaggtgaccctgcaggtgagcggcgagagagagggcagccccagcaccgccgtgagataccccagcggcagcgtggccctgcccagccagtggctgctgatcggccaccacgagctgccccccgtgctgcacaccaccatgctgagagtgcaccccaccctgggcagcggcaccgccgagaccagaccccccgagaacacccaggcccccgccttcttcctggagctgctgagcctgagcagagagaagctgtgggacagcgagctgcaccccgaggagaagacccccgacagctacctgggcctgggcccccaggacctgctggccgccagcctgaccgccgtgctgctgggcggctggatcctgttcgtgatgagacagcagcagccccaggtggtggagaagcagcaggagacccccctggcccccgccgacttcgcccacatcagccaggacgcccagagcctgcacagcggcgccagcagaagaagccagaagagactgcagagccccagcaagcaggcccagcccctggacgaccccgaggccgagcagctgaccgtggtgggcaagatcagcttcaaccccaaggacgtgctgggcagaggcgccggcggcaccttcgtgttcagaggccagttcgagggcagagccgtggccgtgaagagactgctgagagagtgcttcggcctggtgagaagagaggtgcagctgctgcaggagagcgacagacaccccaacgtgctgagatacttctgcaccgagagaggcccccagttccactacatcgccctggagctgtgcagagccagcctgcaggagtacgtggagaaccccgacctggacagaggcggcctggagcccgaggtggtgctgcagcagctgatgagcggcctggcccacctgcacagcctgcacatcgtgcacagagacctgaagcccggcaacatcctgatcaccggccccgacagccagggcctgggcagagtggtgctgagcgacttcggcctgtgcaagaagctgcccgccggcagatgcagcttcagcctgcacagcggcatccccggcaccgagggctggatggcccccgagctgctgcagctgctgccccccgacagccccaccagcgccgtggacatcttcagcgccggctgcgtgttctactacgtgctgagcggcggcagccaccccttcggcgacagcctgtacagacaggccaacatcctgaccggcgccccctgcctggcccacctggaggaggaggtgcacgacaaggtggtggccagagacctggtgggcgccatgctgagccccctgccccagcccagacccagcgccccccaggtgctggcccaccccttcttctggagcagagccaagcagctgcagttcttccaggacgtgagcgactggctggagaaggagagcgagcaggagcccctggtgagagccctggaggccggcggctgcgccgtggtgagagacaactggcacgagcacatcagcatgcccctgcagaccgacctgagaaagttcagaagctacaagggcaccagcgtgagagacctgctgagagccgtgagaaacaagaagcaccactacagagagctgcccgtggaggtgagacaggccctgggccaggtgcccgacggcttcgtgcagtacttcaccaacagattccccagactgctgctgcacacccacagagccatgagaagctgcgccagcgagagcctgttcctgccctactacccccccgacagcgaggccagaagaccctgccccggcgccaccggcagatag

SEQ ID NO: 80351 - DNA, 2625 bp, Artificial Sequence
  Description of Artificial Sequence: Synthetic coding sequence
atggccagcgccgtgagaggcagcagaccctggcccagactgggcctgcagctgcagttcgccgccctgctgctgggcaccctgagcccccaggtgcacaccctgagacccgagaacctgctgctggtgagcaccctggacggcagcctgcacgccctgagcaagcagaccggcgacctgaagtggaccctgagagacgaccccgtgatcgagggccccatgtacgtgaccgagatggccttcctgagcgaccccgccgacggcagcctgtacatcctgggcacccagaagcagcagggcctgatgaagctgcccttcaccatccccgagctggtgcacgccagcccctgcagaagcagcgacggcgtgttctacaccggcagaaagcaggacgcctggttcgtggtggaccccgagagcggcgagacccagatgaccctgaccaccgagggccccagcacccccagactgtacatcggcagaacccagtacaccgtgaccatgcacgaccccagagcccccgccctgagatggaacaccacctacagaagatacagcgccccccccatggacggcagccccggcaagtacatgagccacctggccagctgcggcatgggcctgctgctgaccgtggaccccggcagcggcaccgtgctgtggacccaggacctgggcgtgcccgtgatgggcgtgtacacctggcaccaggacggcctgagacagctgccccacctgaccctggccagagacaccctgcacttcctggccctgagatggggccacatcagactgcccgccagcggccccagagacaccgccaccctgttcagcaccctggacacccagctgctgatgaccctgtacgtgggcaaggacgagaccggcttctacgtgagcaaggccctggtgcacaccggcgtggccctggtgcccagaggcctgaccctggcccccgccgacggccccaccaccgacgaggtgaccctgcaggtgagcggcgagagagagggcagccccagcaccgccgtgagataccccagcggcagcgtggccctgcccagccagtggctgctgatcggccaccacgagctgccccccgtgctgcacaccaccatgctgagagtgcaccccaccctgggcagcggcaccgccgagaccagaccccccgagaacacccaggcccccgccttcttcctggagcagcagccccaggtggtggagaagcagcaggagacccccctggcccccgccgacttcgcccacatcagccaggacgcccagagcctgcacagcggcgccagcagaagaagccagaagagactgcagagccccagcaagcaggcccagcccctggacgaccccgaggccgagcagctgaccgtggtgggcaagatcagcttcaaccccaaggacgtgctgggcagaggcgccggcggcaccttcgtgttcagaggccagttcgagggcagagccgtggccgtgaagagactgctgagagagtgcttcggcctggtgagaagagaggtgcagctgctgcaggagagcgacagacaccccaacgtgctgagatacttctgcaccgagagaggcccccagttccactacatcgccctggagctgtgcagagccagcctgcaggagtacgtggagaaccccgacctggacagaggcggcctggagcccgaggtggtgctgcagcagctgatgagcggcctggcccacctgcacagcctgcacatcgtgcacagagacctgaagcccggcaacatcctgatcaccggccccgacagccagggcctgggcagagtggtgctgagcgacttcggcctgtgcaagaagctgcccgccggcagatgcagcttcagcctgcacagcggcatccccggcaccgagggctggatggcccccgagctgctgcagctgctgccccccgacagccccaccagcgccgtggacatcttcagcgccggctgcgtgttctactacgtgctgagcggcggcagccaccccttcggcgacagcctgtacagacaggccaacatcctgaccggcgccccctgcctggcccacctggaggaggaggtgcacgacaaggtggtggccagagacctggtgggcgccatgctgagccccctgccccagcccagacccagcgccccccaggtgctggcccaccccttcttctggagcagagccaagcagctgcagttcttccaggacgtgagcgactggctggagaaggagagcgagcaggagcccctggtgagagccctggaggccggcggctgcgccgtggtgagagacaactggcacgagcacatcagcatgcccctgcagaccgacctgagaaagttcagaagctacaagggcaccagcgtgagagacctgctgagagccgtgagaaacaagaagcaccactacagagagctgcccgtggaggtgagacaggccctgggccaggtgcccgacggcttcgtgcagtacttcaccaacagattccccagactgctgctgcacacccacagagccatgagaagctgcgccagcgagagcctgttcctgccctactacccccccgacagcgaggccagaagaccctgccccggcgccaccggcagatag

SEQ ID NO: 80352 - DNA, 354 bp, Artificial Sequence
  Description of Artificial Sequence: Synthetic coding sequence
atgagccagaagcaggaggaggagaaccccgccgaggagaccggcgaggagaagcaggacacccaggagaaggagggcatcctgcccgagagagccgaggaggccaagctgaaggccaagtaccccagcctgggccagaagcccggcggcagcgacttcctgatgaagagactgcagaagggccagaagtacttcgacagcggcgactacaacatggccaaggccaagatgaagaacaagcagctgcccagcgccggccccgacaagaacctggtgaccggcgaccacatccccaccccccaggacctgccccagagaaagagcagcctggtgaccagcaagctggccggctag

SEQ ID NO: 80353 - DNA, 414 bp, Artificial Sequence
  Description of Artificial Sequence: Synthetic coding sequence
atgagccagaagcaggaggaggagaaccccgccgaggagaccggcgaggagaagcaggacacccaggagaaggagggcatcctgcccgagagagccgaggaggccaagctgaaggccaagtaccccagcctgggccagaagcccggcggcagcgacttcctgatgaagagactgcagaagggcgactacaagagcctgcactggagcgtgctgctgtgcgccgacgagatgcagaagtacttcgacagcggcgactacaacatggccaaggccaagatgaagaacaagcagctgcccagcgccggccccgacaagaacctggtgaccggcgaccacatccccaccccccaggacctgccccagagaaagagcagcctggtgaccagcaagctggccggcggccaggtggagtag

SEQ ID NO: 80354 - DNA, 423 bp, Artificial Sequence
  Description of Artificial Sequence: Synthetic coding sequence
atgagccagaagcaggaggaggagaaccccgccgaggagaccggcgaggagaagcaggacacccaggagaaggagggcatcctgcccgagagagccgaggaggccaagctgaaggccaagtaccccagcctgggccagaagcccggcggcagcgacttcctgatgaagagactgcagaagggcgtgtggggcatcgtgagctaccccctgagcctggagctgaaggaggtgctgagaatgaagagcgtggagcagaagtacttcgacagcggcgactacaacatggccaaggccaagatgaagaacaagcagctgcccagcgccggccccgacaagaacctggtgaccggcgaccacatccccaccccccaggacctgccccagagaaagagcagcctggtgaccagcaagctggccggctag

SEQ ID NO: 80355 - DNA, 354 bp, Artificial Sequence
  Description of Artificial Sequence: Synthetic coding sequence
atggccggcggcctgggctgcgacgtgtgctactggttcgtggaggacacccaggagaaggagggcatcctgcccgagagagccgaggaggccaagctgaaggccaagtaccccagcctgggccagaagcccggcggcagcgacttcctgatgaagagactgcagaagggccagaagtacttcgacagcggcgactacaacatggccaaggccaagatgaagaacaagcagctgcccagcgccggccccgacaagaacctggtgaccggcgaccacatccccaccccccaggacctgccccagagaaagagcagcctggtgaccagcaagctggccggcggccaggtggagtag

SEQ ID NO: 80356 - DNA, 402 bp, Artificial Sequence
  Description of Artificial Sequence: Synthetic coding sequence
atggccggcggcctgggctgcgacgtgtgctactggttcgtggaggacacccaggagaaggagggcatcctgcccgagagagccgaggaggccaagctgaaggccaagtaccccagcctgggccagaagcccggcggcagcgacttcctgatgaagagactgcagaagggcgactacaagagcctgcactggagcgtgctgctgtgcgccgacgagatgcagaagtacttcgacagcggcgactacaacatggccaaggccaagatgaagaacaagcagctgcccagcgccggccccgacaagaacctggtgaccggcgaccacatccccaccccccaggacctgccccagagaaagagcagcctggtgaccagcaagctggccggcggccaggtggagtag

SEQ ID NO: 80357 - DNA, 318 bp, Artificial Sequence
  Description of Artificial Sequence: Synthetic coding sequence
atgagccagaagcaggaggaggagaaccccgccgaggagaccggcgaggagaagcaggacacccaggagaaggagggcatcctgcccgagagagccgaggaggccaagctgaaggccaagtaccccagcctgggccagaagcccggcggcagcgacttcctgatgaagagactgcagaagggcgtgtggggcatcgtgagctaccccctgagcctggagctgaaggaggtgctgagaatgaagagcgtggaggtgctgctggaccccttcctggaggtgctgctgctgaacagaagcagaggcgagttcgagatctag

SEQ ID NO: 80358 - DNA, 435 bp, Artificial Sequence
  Description of Artificial Sequence: Synthetic coding sequence
atgagccagaagcaggaggaggagaaccccgccgaggagaccggcgaggagaagcaggacacccaggagaaggagggcatcctgcccgagagagccgaggaggccaagctgaaggccaagtaccccagcctgggccagaagcccggcggcagcgacttcctgatgaagagactgcagaagggcgtgtggggcatcgtgagctaccccctgagcctggagctgaaggaggtgctgagaatgaagagcgtggagcagaagtacttcgacagcggcgactacaacatggccaaggccaagatgaagaacaagcagctgcccagcgccggccccgacaagaacctggtgaccggcgaccacatccccaccccccaggacctgccccagagaaagagcagcctggtgaccagcaagctggccggcggccaggtggagtag

SEQ ID NO: 80359 - DNA, 366 bp, Artificial Sequence
  Description of Artificial Sequence: Synthetic coding sequence
atgagccagaagcaggaggaggagaaccccgccgaggagaccggcgaggagaagcaggacacccaggagaaggagggcatcctgcccgagagagccgaggaggccaagctgaaggccaagtaccccagcctgggccagaagcccggcggcagcgacttcctgatgaagagactgcagaagggccagaagtacttcgacagcggcgactacaacatggccaaggccaagatgaagaacaagcagctgcccagcgccggccccgacaagaacctggtgaccggcgaccacatccccaccccccaggacctgccccagagaaagagcagcctggtgaccagcaagctggccggcggccaggtggagtag

SEQ ID NO: 80360 - DNA, 402 bp, Artificial Sequence
  Description of Artificial Sequence: Synthetic coding sequence
atgagccagaagcaggaggaggagaaccccgccgaggagaccggcgaggagaagcaggacacccaggagaaggagggcatcctgcccgagagagccgaggaggccaagctgaaggccaagtaccccagcctgggccagaagcccggcggcagcgacttcctgatgaagagactgcagaagggcgactacaagagcctgcactggagcgtgctgctgtgcgccgacgagatgcagaagtacttcgacagcggcgactacaacatggccaaggccaagatgaagaacaagcagctgcccagcgccggccccgacaagaacctggtgaccggcgaccacatccccaccccccaggacctgccccagagaaagagcagcctggtgaccagcaagctggccggctag

SEQ ID NO: 80361 - DNA, 318 bp, Artificial Sequence; identical to SEQ ID NO: 80357
  Description of Artificial Sequence: Synthetic coding sequence

SEQ ID NO: 80362 - DNA, 342 bp, Artificial Sequence
  Description of Artificial Sequence: Synthetic coding sequence
atggccggcggcctgggctgcgacgtgtgctactggttcgtggaggacacccaggagaaggagggcatcctgcccgagagagccgaggaggccaagctgaaggccaagtaccccagcctgggccagaagcccggcggcagcgacttcctgatgaagagactgcagaagggccagaagtacttcgacagcggcgactacaacatggccaaggccaagatgaagaacaagcagctgcccagcgccggccccgacaagaacctggtgaccggcgaccacatccccaccccccaggacctgccccagagaaagagcagcctggtgaccagcaagctggccggctag

SEQ ID NO: 80363 - DNA, 1173 bp, Artificial Sequence
  Description of Artificial Sequence: Synthetic coding sequence
atgatcagcctgcccggccccctggtgaccaacctgctgagattcctgttcctgggcctgagcgccctggccccccccagcagagcccagctgcagctgcacctgcccgccaacagactgcaggccgtggagggcggcgaggtggtgctgcccgcctggtacaccctgcacggcgaggtgagcagcagccagccctgggaggtgcccttcgtgatgtggttcttcaagcagaaggagaaggaggaccaggtgctgagctacatcaacggcgtgaccaccagcaagcccggcgtgagcctggtgtacagcatgcccagcagaaacctgagcctgagactggagggcctgcaggagaaggacagcggcccctacagctgcagcgtgaacgtgcaggacaagcagggcaagagcagaggccacagcatcaagaccctggagctgaacgtgctggtgccccccgccccccccagctgcagactgcagggcgtgccccacgtgggcgccaacgtgaccctgagctgccagagccccagaagcaagcccgccgtgcagtaccagtgggacagacagctgcccagcttccagaccttcttcgcccccgccctggacgtgatcagaggcagcctgagcctgaccaacctgagcagcagcatggccggcgtgtacgtgtgcaaggcccacaacgaggtgggcaccgcccagtgcaacgtgaccctggaggtgagcaccggccccggcgccgccgtggtggccggcgccgtggtgggcaccctggtgggcctgggcctgctggccggcctggtgctgctgtaccacagaagaggcaaggccctggaggagcccgccaacgacatcaaggaggacgccatcgcccccagaaccctgccctggcccaagagcagcgacaccatcagcaagaacggcaccctgagcagcgtgaccagcgccagagccctgagacccccccacggcccccccagacccggcgccctgacccccacccccagcctgagcagccaggccctgcccagccccagactgcccaccaccgacggcgcccacccccagcccatcagccccatccccggcggcgtgagcagcagcggcctgagcagaatgggcgccgtgcccgtgatggtgcccgcccagagccaggccggcagcctggtgtag

SEQ ID NO: 80364 - DNA, 426 bp, Artificial Sequence
  Description of Artificial Sequence: Synthetic coding sequence
atgatcagcctgcccggccccctggtgaccaacctgctgagattcctgttcctgggcctgagcgccctggacgtgatcagaggcagcctgagcctgaccaacctgagcagcagcatggccggcgtgtacgtgtgcaaggcccacaacgaggtgggcaccgcccagtgcaacgtgaccctggaggtgagcaccggccccggcgccgccgtggtggccggcgccgtggtgggcaccctggtgggcctgggcctgctggccggcctggtgctgctgtaccacagaagaggcaaggccctggaggagcccgccaacgacatcaaggtgagaagccccctgggcctgagcttcagcgcccccaagatggagtggctgtggaagtggagagacgcccacttctacagagacagctacctgagcaagtggtag

SEQ ID NO: 80365 - DNA, 2613 bp, Artificial Sequence
  Description of Artificial Sequence: Synthetic coding sequence
atgaccgccgacaaggagaagaagagaagcagcagcgagagaagaaaggagaagagcagagacgccgccagatgcagaagaagcaaggagaccgaggtgttctacgagctggcccacgagctgcccctgccccacagcgtgagcagccacctggacaaggccagcatcatgagactggccatcagcttcctgagaacccacaagctgctgagcagcgtgtgcagcgagaacgagagcgaggccgaggccgaccagcagatggacaacctgtacctgaaggccctggagggcttcatcgccgtggtgacccaggacggcgacatgatcttcctgagcgagaacatcagcaagttcatgggcctgacccaggtggagctgaccggccacagcatcttcgacttcacccacccctgcgaccacgaggagatcagagagaacctgagcctgaagaacggcagcggcttcggcaagaagagcaaggacatgagcaccgagagagacttcttcatgagaatgaagtgcaccgtgaccaacagaggcagaaccgtgaacctgaagagcgccacctggaaggtgctgcactgcaccggccaggtgaaggtgtacaacaactgccccccccacaacagcctgtgcggctacaaggagcccctgctgagctgcctgatcatcatgtgcgagcccatccagcaccccagccacatggacatccccctggacagcaagaccttcctgagcagacacagcatggacatgaagttcacctactgcgacgacagaatcaccgagctgatcggctaccaccccgaggagctgctgggcagaagcgcctacgagttctaccacgccctggacagcgagaacatgaccaagagccaccagaacctgtgcaccaagggccaggtggtgagcggccagtacagaatgctggccaagcacggcggctacgtgtggctggagacccagggcaccgtgatctacaaccccagaaacctgcagccccagtgcatcatgtgcgtgaactacgtgctgagcgagatcgagaagaacgacgtggtgttcagcatggaccagaccgagagcctgttcaagccccacctgatggccatgaacagcatcttcgacagcagcggcaagggcgccgtgagcgagaagagcaacttcctgttcaccaagctgaaggaggagcccgaggagctggcccagctggcccccacccccggcgacgccatcatcagcctggacttcggcaaccagaacttcgaggagagcagcgcctacggcaaggccatcctgccccccagccagccctgggccaccgagctgagaagccacagcacccagagcgaggccggcagcctgcccgccttcaccgtgccccaggccgccgcccccggcagcaccacccccagcgccaccagcagcagcagcagctgcagcacccccaacagccccgaggactactacaccagcctggacaacgacctgaagatcgaggtgatcgagaagctgttcgccatggacaccgaggccaaggaccagtgcagcacccagaccgacttcaacgagctggacctggagaccctggccccctacatccccatggacggcgaggacttccagctgagccccatctgccccgaggagagactgctggccgagaacccccagagcaccccccagcactgcttcagcgccatgaccaacatcttccagcccctggcccccgtggccccccacagccccttcctgctggacaagttccagcagcagctggagagcaagaagaccgagcccgagcacagacccatgagcagcatcttcttcgacgccggcagcaaggccagcctgcccccctgctgcggccaggccagcacccccctgagcagcatgggcggcagaagcaacacccagtggccccccgacccccccctgcacttcggccccaccaagtgggccgtgggcgaccagagaaccgagttcctgggcgccgcccccctgggcccccccgtgagccccccccacgtgagcaccttcaagaccagaagcgccaagggcttcggcgccagaggccccgacgtgctgagccccgccatggtggccctgagcaacaagctgaagctgaagagacagctggagtacgaggagcaggccttccaggacctgagcggcggcgacccccccggcggcagcaccagccacctgatgtggaagagaatgaagaacctgagaggcggcagctgccccctgatgcccgacaagcccctgagcgccaacgtgcccaacgacaagttcacccagaaccccatgagaggcctgggccaccccctgagacacctgcccctgccccagccccccagcgccatcagccccggcgagaacagcaagagcagattccccccccagtgctacgccacccagtaccaggactacagcctgagcagcgcccacaaggtgagcggcatggccagcagactgctgggccccagcttcgagagctacctgctgcccgagctgaccagatacgactgcgaggtgaacgtgcccgtgctgggcagcagcaccctgctgcagggcggcgacctgctgagagccctggaccaggccacctag

SEQ ID NO: 80366 - DNA, 780 bp, Artificial Sequence
  Description of Artificial Sequence: Synthetic coding sequence
atgaccgccgacaaggagaagaagagaagcagcagcgagagaagaaaggagaagagcagagacgccgccagatgcagaagaagcaaggagaccgaggtgttctacgagctggcccacgagctgcccctgccccacagcgtgagcagccacctggacaaggccagcatcatgagactggccatcagcttcctgagaacccacaagctgctgagcagcgtgtgcagcgagaacgagagcgaggccgaggccgaccagcagatggacaacctgtacctgaaggccctggagggcttcatcgccgtggtgacccaggacggcgacatgatcttcctgagcgagaacatcagcaagttcatgggcctgacccaggtggagctgaccggccacagcatcttcgacttcacccacccctgcgaccacgaggagatcagagagaacctgagcctgaagaacggcagcggcttcggcaagaagagcaaggacatgagcaccgagagagacttcttcatgagaatgaagtgcaccgtgaccaacagaggcagaaccgtgaacctgaagagcgccacctggaaggtgctgcactgcaccggccaggtgaaggtgtacaacaactgccccccccacaacagcctgtgcggctacaaggagcccctgctgagctgcctgatcatcatgtgcgagcccatccagcaccccagccacatggacatccccctggacagcaagaccttcctgagcagacacagcatggacatgaagttcacctactgcgacgactag

SEQ ID NO: 80367 - DNA, 537 bp, Artificial Sequence
  Description of Artificial Sequence: Synthetic coding sequence
atggtgagcgtgcccaccacctggtgcagcgtggccctggccctgctggtggccctgcacgagggcaagggccaggccgccgccaccctggagcagcccgccagcagcagccacgcccagggcacccacctgagactgagaagatgcagctgcagcagctggctggacaaggagtgcgtgtacttctgccacctggacatcatctgggtgaacacccccgagcagaccgccccctacggcctgggcaacccccccagaagaagaagaagaagcctgcccagaagatgccagtgcagcagcgccagagaccccgcctgcgccaccttctgcctgagaagaccctggaccgaggccggcgccgtgcccagcagaaagagccccgccgacgtgttccagaccggcaagaccggcgccaccaccggcgagctgctgcagagactgagagacatcagcaccgtgaagagcctgttcgccaagagacagcaggaggccatgagagagcccagaagcacccacagcagatggagaaagagatag

SEQ ID NO: 80368 - DNA, 660 bp, Artificial Sequence
  Description of Artificial Sequence: Synthetic coding sequence
atggagcccggcctgtggctgctgttcggcctgaccgtgaccagcgccgccggcttcgtgccctgcagccagagcggcgacgccggcagaagaggcgtgagccaggcccccaccgccgccagaagcgagggcgactgcgaggagaccgtggccggccccggcgaggagaccgtggccggccccggcgagggcaccgtggcccccaccgccctgcagggccccagccccggcagccccggccaggagcaggccgccgagggcgcccccgagcaccacagaagcagaagatgcacctgcttcacctacaaggacaaggagtgcgtgtactactgccacctggacatcatctggatcaacacccccgagcagaccgtgccctacggcctgagcaactacagaggcagcttcagaggcaagagaagcgccggccccctgcccggcaacctgcagctgagccacagaccccacctgagatgcgcctgcgtgggcagatacgacaaggcctgcctgcacttctgcacccagaccctggacgtgagcagcaacagcagaaccgccgagaagaccgacaaggaggaggagggcaaggtgagaggcgccaacagaggcctgtgccagagaagactgaagagcagaaccaacaaggccagcagactgtag

SEQ ID NO: 80369 - DNA, 717 bp, Artificial Sequence
  Description of Artificial Sequence: Synthetic coding sequence
atggagcccggcctgtggctgctgttcggcctgaccgtgaccagcgccgccggcttcgtgccctgcagccagagcggcgacgccggcagaagaggcgtgagccaggcccccaccgccgccagaagcgagggcgactgcgaggagaccgtggccggccccggcgaggagaccgtggccggccccggcgagggcaccgtggcccccaccgccctgcagggccccagccccggcagccccggccaggagcaggccgccgagggcgcccccgagcaccacagaagcagaagatgcacctgcttcacctacaaggacaaggagtgcgtgtactactgccacctggacatcatctggatcaacacccccgagcagaccgtgccctacggcctgagcaactacagaggcagcttcagaggcaagagaagcgccggccccctgcccggcaacctgcagctgagccacagaccccacctgagatgcgcctgcgtgggcagatacgacaaggcctgcctgcacttctgcacccagaccctggacgtgagcagcaacagcagaaccgccgagaagaccgacaaggaggaggagggcaaggtggaggtgaaggaccagcagagcaagcaggccctggacctgcaccaccccaagctgatgcccggcagcggcctggccctggcccccagcacctgccccagatgcctgttccaggagggcgccccctag

SEQ ID NO: 80370 - DNA, 579 bp, Artificial Sequence
  Description of Artificial Sequence: Synthetic coding sequence
atggagcccggcctgtggctgctgttcggcctgaccgtgaccagcgccgccggcttcgtgccctgcagccagagcggcgacgccggcagaagaggcgtgagccaggcccccaccgccgccagaagcgagggcgactgcgaggagaccgtggccggccccggcgaggagaccgtggccggccccggcgagggcaccgtggcccccaccgccctgcagggccccagccccggcagccccggccaggagcaggccgccgagggcgcccccgagcaccacagaagcagaagatgcacctgcttcacctacaaggacaaggagtgcgtgtactactgccacctggacatcatctggatcaacacccccgagcagaccgtgccctacggcctgagcaactacagaggcagcttcagaggcaagagaagcgccggccccctgcccggcaacctgcagctgagccacagaccccacctgagatgcgcctgcgtgggcagatacgacaaggcctgcctgcacttctgcacccagaccctggacgtgagcagactgaagagcagaaccaacaaggccagcagactgtag

SEQ ID NO: 80371 - DNA, 717 bp, Artificial Sequence; identical to SEQ ID NO: 80369
  Description of Artificial Sequence: Synthetic coding sequence

SEQ ID NO: 80372 - DNA, 675 bp, Artificial Sequence
  Description of Artificial Sequence: Synthetic coding sequence
atggagcccggcctgtggctgctgttcggcctgaccgtgaccagcgccgccggcttcgtgccctgcagccagagcggcgacgccggcagaagaggcgtgagccaggcccccaccgccgccagaagcgagggcgactgcgaggagaccgtggccggccccggcgaggagaccgtggccggccccggcgagggcaccgtggcccccaccgccctgcagggccccagccccggcagccccggccaggagcaggccgccgagggcgcccccgagcaccacagaagcagaagatgcacctgcttcacctacaaggacaaggagtgcgtgtactactgccacctggacatcatctggatcaacacccccgagcagaccgtgccctacggcctgagcaactacagaggcagcttcagaggcaagagaagcgccggccccctgcccggcaacctgcagctgagccacagaccccacctgagatgcgcctgcgtgggcagatacgacaaggcctgcctgcacttctgcacccagaccctggacgtgagcagacaggtggaggtgaaggaccagcagagcaagcaggccctggacctgcaccaccccaagctgatgcccggcagcggcctggccctggcccccagcacctgccccagatgcctgttccaggagggcgccccctag

SEQ ID NO: 80373 - DNA, 2304 bp, Artificial Sequence
  Description of Artificial Sequence: Synthetic coding sequence
atggaggccctgagagagagcgtgctgcacctggccctgcagatgagcacctacaagagagccaccctggacgaggaggacctggtggacagcctgagcgagggcgacgcctaccccaacggcctgcaggtgaacttccacagccccagaagcggccagagatgctgggccgccagaacccaggtggagaagagactggtggtgctggtggtgctgctggccgccggcctggtggcctgcctggccgccctgggcatccagtaccagaccagaagccccagcgtgtgcctgagcgaggcctgcgtgagcgtgaccagcagcatcctgagcagcatggaccccaccgtggacccctgccacgacttcttcagctacgcctgcggcggctggatcaaggccaaccccgtgcccgacggccacagcagatggggcaccttcagcaacctgtgggagcacaaccaggccatcatcaagcacctgctggagaacagcaccgccagcgtgagcgaggccgagagaaaggcccaggtgtactacagagcctgcatgaacgagaccagaatcgaggagctgagagccaagcccctgatggagctgatcgagagactgggcggctggaacatcaccggcccctgggccaaggacaacttccaggacaccctgcaggtggtgaccgcccactacagaaccagccccttcttcagcgtgtacgtgagcgccgacagcaagaacagcaacagcaacgtgatccaggtggaccagagcggcctgggcctgcccagcagagactactacctgaacaagaccgagaacgagaaggtgctgaccggctacctgaactacatggtgcagctgggcaagctgctgggcggcggcgacgaggaggccatcagaccccagatgcagcagatcctggacttcgagaccgccctggccaacatcaccatcccccaggagaagagaagagacgaggagctgatctaccacaaggtgaccgccgccgagctgcagaccctggcccccgccatcaactggctgcccttcctgaacaccatcttctaccccgtggagatcaacgagagcgagcccatcgtggtgtacgacaaggagtacctggagcagatcagcaccctgatcaacaccaccgacagatgcctgctgaacaactacatgatctggaacctggtgagaaagaccagcagcttcctggaccagagattccaggacgccgacgagaagttcatggaggtgatgtacggcaccaagaagacctgcctgcccagatggaagttctgcgtgagcgacaccgagaacaacctgggcttcgccctgggccccatgttcgtgaaggccaccttcgccgaggacagcaagagcatcgccaccgagatcatcctggagatcaagaaggccttcgaggagagcctgagcaccctgaagtggatggacgaggagaccagaaagagcgccaaggagaaggccgacgccatctacaacatgatcggctaccccaacttcatcatggaccccaaggagctggacaaggtgttcaacgactacaccgccgtgcccgacctgtacttcgagaacgccatgagattcttcaacttcagctggagagtgaccgccgaccagctgagaaaggcccccaacagagaccagtggagcatgaccccccccatggtgaacgcctactacagccccaccaagaacgagatcgtgttccccgccggcatcctgcaggcccccttctacaccagaagcagccccaaggccctgaacttcggcggcatcggcgtggtggtgggccacgagctgacccacgccttcgacgaccagggcagagagtacgacaaggacggcaacctgagaccctggtggaagaacagcagcgtggaggccttcaagagacagaccgagtgcatggtggagcagtacagcaactacagcgtgaacggcgagcccgtgaacggcagacacaccctgggcgagaacatcgccgacaacggcggcctgaaggccgcctacagagcctaccagaactgggtgaagaagaacggcgccgagcacagcctgcccaccctgggcctgaccaacaaccagctgttcttcctgggcttcgcccaggtgtggtgcagcgtgagaacccccgagagcagccacgagggcctgatcaccgacccccacagccccagcagattcagagtgatcggcagcctgagcaacagcaaggagttcagcgagcacttcagatgcccccccggcagccccatgaaccccccccacaagtgcgaggtgtggtag

SEQ ID NO: 80374 - DNA, 2277 bp, Artificial Sequence
  Description of Artificial Sequence: Synthetic coding sequence
atgcccctgcagggcctgggcctgcagagaaaccccttcctgcagggcaagagaggccccggcctgaccagcagcccccccctgctgccccccagcctgcaggtgaacttccacagccccagaagcggccagagatgctgggccgccagaacccaggtggagaagagactggtggtgctggtggtgctgctggccgccggcctggtggcctgcctggccgccctgggcatccagtaccagaccagaagccccagcgtgtgcctgagcgaggcctgcgtgagcgtgaccagcagcatcctgagcagcatggaccccaccgtggacccctgccacgacttcttcagctacgcctgcggcggctggatcaaggccaaccccgtgcccgacggccacagcagatggggcaccttcagcaacctgtgggagcacaaccaggccatcatcaagcacctgctggagaacagcaccgccagcgtgagcgaggccgagagaaaggcccaggtgtactacagagcctgcatgaacgagaccagaatcgaggagctgagagccaagcccctgatggagctgatcgagagactgggcggctggaacatcaccggcccctgggccaaggacaacttccaggacaccctgcaggtggtgaccgcccactacagaaccagccccttcttcagcgtgtacgtgagcgccgacagcaagaacagcaacagcaacgtgatccaggtggaccagagcggcctgggcctgcccagcagagactactacctgaacaagaccgagaacgagaaggtgctgaccggctacctgaactacatggtgcagctgggcaagctgctgggcggcggcgacgaggaggccatcagaccccagatgcagcagatcctggacttcgagaccgccctggccaacatcaccatcccccaggagaagagaagagacgaggagctgatctaccacaaggtgaccgccgccgagctgcagaccctggcccccgccatcaactggctgcccttcctgaacaccatcttctaccccgtggagatcaacgagagcgagcccatcgtggtgtacgacaaggagtacctggagcagatcagcaccctgatcaacaccaccgacagatgcctgctgaacaactacatgatctggaacctggtgagaaagaccagcagcttcctggaccagagattccaggacgccgacgagaagttcatggaggtgatgtacggcaccaagaagacctgcctgcccagatggaagttctgcgtgagcgacaccgagaacaacctgggcttcgccctgggccccatgttcgtgaaggccaccttcgccgaggacagcaagagcatcgccaccgagatcatcctggagatcaagaaggccttcgaggagagcctgagcaccctgaagtggatggacgaggagaccagaaagagcgccaaggagaaggccgacgccatctacaacatgatcggctaccccaacttcatcatggaccccaaggagctggacaaggtgttcaacgactacaccgccgtgcccgacctgtacttcgagaacgccatgagattcttcaacttcagctggagagtgaccgccgaccagctgagaaaggcccccaacagagaccagtggagcatgaccccccccatggtgaacgcctactacagccccaccaagaacgagatcgtgttccccgccggcatcctgcaggcccccttctacaccagaagcagccccaaggccctgaacttcggcggcatcggcgtggtggtgggccacgagctgacccacgccttcgacgaccagggcagagagtacgacaaggacggcaacctgagaccctggtggaagaacagcagcgtggaggccttcaagagacagaccgagtgcatggtggagcagtacagcaactacagcgtgaacggcgagcccgtgaacggcagacacaccctgggcgagaacatcgccgacaacggcggcctgaaggccgcctacagagcctaccagaactgggtgaagaagaacggcgccgagcacagcctgcccaccctgggcctgaccaacaaccagctgttcttcctgggcttcgcccaggtgtggtgcagcgtgagaacccccgagagcagccacgagggcctgatcaccgacccccacagccccagcagattcagagtgatcggcagcctgagcaacagcaaggagttcagcgagcacttcagatgcccccccggcagccccatgaaccccccccacaagtgcgaggtgtggtag

SEQ ID NO: 80375 - DNA, 2313 bp, Artificial Sequence
  Description of Artificial Sequence: Synthetic coding sequence
atgagaggcgtgtggcccccccccgtgagcgccctgctgagcgccctgggcatgagcacctacaagagagccaccctggacgaggaggacctggtggacagcctgagcgagggcgacgcctaccccaacggcctgcaggtgaacttccacagccccagaagcggccagagatgctgggccgccagaacccaggtggagaagagactggtggtgctggtggtgctgctggccgccggcctggtggcctgcctggccgccctgggcatccagtaccagaccagaagccccagcgtgtgcctgagcgaggcctgcgtgagcgtgaccagcagcatcctgagcagcatggaccccaccgtggacccctgccacgacttcttcagctacgcctgcggcggctggatcaaggccaaccccgtgcccgacggccacagcagatggggcaccttcagcaacctgtgggagcacaaccaggccatcatcaagcacctgctggagaacagcaccgccagcgtgagcgaggccgagagaaaggcccaggtgtactacagagcctgcatgaacgagaccagaatcgaggagctgagagccaagcccctgatggagctgatcgagagactgggcggctggaacatcaccggcccctgggccaaggacaacttccaggacaccctgcaggtggtgaccgcccactacagaaccagccccttcttcagcgtgtacgtgagcgccgacagcaagaacagcaacagcaacgtgatccaggtggaccagagcggcctgggcctgcccagcagagactactacctgaacaagaccgagaacgagaaggtgctgaccggctacctgaactacatggtgcagctgggcaagctgctgggcggcggcgacgaggaggccatcagaccccagatgcagcagatcctggacttcgagaccgccctggccaacatcaccatcccccaggagaagagaagagacgaggagctgatctaccacaaggtgaccgccgccgagctgcagaccctggcccccgccatcaactggctgcccttcctgaacaccatcttctaccccgtggagatcaacgagagcgagcccatcgtggtgtacgacaaggagtacctggagcagatcagcaccctgatcaacaccaccgacagatgcctgctgaacaactacatgatctggaacctggtgagaaagaccagcagcttcctggaccagagattccaggacgccgacgagaagttcatggaggtgatgtacggcaccaagaagacctgcctgcccagatggaagttctgcgtgagcgacaccgagaacaacctgggcttcgccctgggccccatgttcgtgaaggccaccttcgccgaggacagcaagagcatcgccaccgagatcatcctggagatcaagaaggccttcgaggagagcctgagcaccctgaagtggatggacgaggagaccagaaagagcgccaaggagaaggccgacgccatctacaacatgatcggctaccccaacttcatcatggaccccaaggagctggacaaggtgttcaacgactacaccgccgtgcccgacctgtacttcgagaacgccatgagattcttcaacttcagctggagagtgaccgccgaccagctgagaaaggcccccaacagagaccagtggagcatgaccccccccatggtgaacgcctactacagccccaccaagaacgagatcgtgttccccgccggcatcctgcaggcccccttctacaccagaagcagccccaaggccctgaacttcggcggcatcggcgtggtggtgggccacgagctgacccacgccttcgacgaccagggcagagagtacgacaaggacggcaacctgagaccctggtggaagaacagcagcgtggaggccttcaagagacagaccgagtgcatggtggagcagtacagcaactacagcgtgaacggcgagcccgtgaacggcagacacaccctgggcgagaacatcgccgacaacggcggcctgaaggccgcctacagagcctaccagaactgggtgaagaagaacggcgccgagcacagcctgcccaccctgggcctgaccaacaaccagctgttcttcctgggcttcgcccaggtgtggtgcagcgtgagaacccccgagagcagccacgagggcctgatcaccgacccccacagccccagcagattcagagtgatcggcagcctgagcaacagcaaggagttcagcgagcacttcagatgcccccccggcagccccatgaaccccccccacaagtgcgaggtgtggtag

SEQ ID NO: 80376 - DNA, 2265 bp, Artificial Sequence
  Description of Artificial Sequence: Synthetic coding sequence
atgatgagcacctacaagagagccaccctggacgaggaggacctggtggacagcctgagcgagggcgacgcctaccccaacggcctgcaggtgaacttccacagccccagaagcggccagagatgctgggccgccagaacccaggtggagaagagactggtggtgctggtggtgctgctggccgccggcctggtggcctgcctggccgccctgggcatccagtaccagaccagaagccccagcgtgtgcctgagcgaggcctgcgtgagcgtgaccagcagcatcctgagcagcatggaccccaccgtggacccctgccacgacttcttcagctacgcctgcggcggctggatcaaggccaaccccgtgcccgacggccacagcagatggggcaccttcagcaacctgtgggagcacaaccaggccatcatcaagcacctgctggagaacagcaccgccagcgtgagcgaggccgagagaaaggcccaggtgtactacagagcctgcatgaacgagaccagaatcgaggagctgagagccaagcccctgatggagctgatcgagagactgggcggctggaacatcaccggcccctgggccaaggacaacttccaggacaccctgcaggtggtgaccgcccactacagaaccagccccttcttcagcgtgtacgtgagcgccgacagcaagaacagcaacagcaacgtgatccaggtggaccagagcggcctgggcctgcccagcagagactactacctgaacaagaccgagaacgagaaggtgctgaccggctacctgaactacatggtgcagctgggcaagctgctgggcggcggcgacgaggaggccatcagaccccagatgcagcagatcctggacttcgagaccgccctggccaacatcaccatcccccaggagaagagaagagacgaggagctgatctaccacaaggtgaccgccgccgagctgcagaccctggcccccgccatcaactggctgcccttcctgaacaccatcttctaccccgtggagatcaacgagagcgagcccatcgtggtgtacgacaaggagtacctggagcagatcagcaccctgatcaacaccaccgacagatgcctgctgaacaactacatgatctggaacctggtgagaaagaccagcagcttcctggaccagagattccaggacgccgacgagaagttcatggaggtgatgtacggcaccaagaagacctgcctgcccagatggaagttctgcgtgagcgacaccgagaacaacctgggcttcgccctgggccccatgttcgtgaaggccaccttcgccgaggacagcaagagcatcgccaccgagatcatcctggagatcaagaaggccttcgaggagagcctgagcaccctgaagtggatggacgaggagaccagaaagagcgccaaggagaaggccgacgccatctacaacatgatcggctaccccaacttcatcatggaccccaaggagctggacaaggtgttcaacgactacaccgccgtgcccgacctgtacttcgagaacgccatgagattcttcaacttcagctggagagtgaccgccgaccagctgagaaaggcccccaacagagaccagtggagcatgaccccccccatggtgaacgcctactacagccccaccaagaacgagatcgtgttccccgccggcatcctgcaggcccccttctacaccagaagcagccccaaggccctgaacttcggcggcatcggcgtggtggtgggccacgagctgacccacgccttcgacgaccagggcagagagtacgacaaggacggcaacctgagaccctggtggaagaacagcagcgtggaggccttcaagagacagaccgagtgcatggtggagcagtacagcaactacagcgtgaacggcgagcccgtgaacggcagacacaccctgggcgagaacatcgccgacaacggcggcctgaaggccgcctacagagcctaccagaactgggtgaagaagaacggcgccgagcacagcctgcccaccctgggcctgaccaacaaccagctgttcttcctgggcttcgcccaggtgtggtgcagcgtgagaacccccgagagcagccacgagggcctgatcaccgacccccacagccccagcagattcagagtgatcggcagcctgagcaacagcaaggagttcagcgagcacttcagatgcccccccggcagccccatgaaccccccccacaagtgcgaggtgtggtag

SEQ ID NO: 80377 - DNA, 2217 bp, Artificial Sequence
  Description of Artificial Sequence: Synthetic coding sequence
atgagaggcgtgtggcccccccccgtgagcgccctgctgagcgccctgggcatgagcacctacaagagagccaccctggacgaggaggacctggtggacagcctgagcgagggcgacgcctaccccaacggcctgcaggtgaacttccacagccccagaagcggccagagatgctgggccgccagaacccaggtggagaagagactggtggtgctggtggtgctgctggccgccggcctggtggcctgcctggccgccctgggcatccagtaccagaccagaagccccagcgtgtgcctgagcgaggcctgcgtgagcgtgaccagcagcatcctgagcagcatggaccccaccgtggacccctgccacgacttcttcagctacgcctgcggcggctggatcaaggccaaccccgtgcccgacggccacagcagatggggcaccttcagcaacctgtgggagcacaaccaggccatcatcaagcacctgctggagaacagcaccgccagcgtgagcgaggccgagagaaaggcccaggtgtactacagagcctgcatgaacgagaccagaatcgaggagctgagagccaagcccctgatggagctgatcgagagactgggcggctggaacatcaccggcccctgggccaaggacaacttccaggacaccctgcaggtggtgaccgcccactacagaaccagccccttcttcagcgtgtacgtgagcgccgacagcaagaacagcaacagcaacgtgatccaggtggaccagagcggcctgggcctgcccagcagagactactacctgaacaagaccgagaacgagaaggtgctgaccggctacctgaactacatggtgcagctgggcaagctgctgggcggcggcgacgaggaggccatcagaccccagatgcagcagatcctggacttcgagaccgccctggccaacatcaccatcccccaggagaagagaagagacgaggagctgatctaccacaaggtgaccgccgccgagctgcagaccctggcccccgccatcaactggctgcccttcctgaacaccatcttctaccccgtggagatcaacgagagcgagcccatcgtggtgtacgacaaggagtacctggagcagatcagcaccctgatcaacaccaccgacagatgcctgctgaacaactacatgatctggaacctggtgagaaagaccagcagcttcctggaccagagattccaggacgccgacgagaagttcatggaggtgatgtacggcaccaagaagacctgcctgcccagatggaagttctgcgtgagcgacaccgagaacaacctgggcttcgccctgggccccatgttcgtgaaggccaccttcgccgaggacagcaagagcatcgccaccgagatcatcctggagatcaagaaggccttcgaggagagcctgagcaccctgaagtggatggacgaggagaccagaaagagcgccaaggagaaggccgacgccatctacaacatgatcggctaccccaacttcatcatggaccccaaggagctggacaaggtgttcaacgactacaccgccgtgcccgacctgtacttcgagaacgccatgagattcttcaacttcagctggagagtgaccgccgaccagctgagaaaggcccccaacagagaccagtggagcatgaccccccccatggtgaacgcctactacagccccaccaagaacgagatcgtgttccccgccggcatcctgcaggcccccttctacaccagaagcagccccaaggccctgaacttcggcggcatcggcgtggtggtgggccacgagctgacccacgccttcgacgaccagggcagagagtacgacaaggacggcaacctgagaccctggtggaagaacagcagcgtggaggccttcaagagacagaccgagtgcatggtggagcagtacagcaactacagcgtgaacggcgagcccgtgaacggcagacacaccctgggcgagaacatcgccgacaacggcggcctgaaggccgcctacagagtgtggtgcagcgtgagaacccccgagagcagccacgagggcctgatcaccgacccccacagccccagcagattcagagtgatcggcagcctgagcaacagcaaggagttcagcgagcacttcagatgcccccccggcagccccatgaaccccccccacaagtgcgaggtgtggtag

SEQ ID NO: 80378 - DNA, 2328 bp, Artificial Sequence
  Description of Artificial Sequence: Synthetic coding sequence
atggagcccccctacagcctgaccgcccactacgacgagttccaggaggtgaagtacgtgagcagatgcggcgccggcggcgccagaggcgccagcctgccccccggcttccccctgggcgccgccagaagcgccaccggcgccagaagcggcctgcccagatggaacagaagagaggtgtgcctgctgagcggcctggtgttcgccgccggcctgtgcgccatcctggccgccatgctggccctgaagtacctgggccccgtggccgccggcggcggcgcctgccccgagggctgccccgagagaaaggccttcgccagagccgccagattcctggccgccaacctggacgccagcatcgacccctgccaggacttctacagcttcgcctgcggcggctggctgagaagacacgccatccccgacgacaagctgacctacggcaccatcgccgccatcggcgagcagaacgaggagagactgagaagactgctggccagacccggcggcggccccggcggcgccgcccagagaaaggtgagagccttcttcagaagctgcctggacatgagagagatcgagagactgggccccagacccatgctggaggtgatcgaggactgcggcggctgggacctgggcggcgccgaggagagacccggcgtggccgccagatgggacctgaacagactgctgtacaaggcccagggcgtgtacagcgccgccgccctgttcagcctgaccgtgagcctggacgacagaaacagcagcagatacgtgatcagaatcgaccaggacggcctgaccctgcccgagagaaccctgtacctggcccaggacgaggacagcgagaagatcctggccgcctacagagtgttcatggagagagtgctgagcctgctgggcgccgacgccgtggagcagaaggcccaggagatcctgcaggtggagcagcagctggccaacatcaccgtgagcgagcacgacgacctgagaagagacgtgagcagcatgtacaacaaggtgaccctgggccagctgcagaagatcaccccccacctgagatggaagtggctgctggaccagatcttccaggaggacttcagcgaggaggaggaggtggtgctgctggccaccgactacatgcagcaggtgagccagctgatcagaagcaccccccacagagtgctgcacaactacctggtgtggagagtggtggtggtgctgagcgagcacctgagcccccccttcagagaggccctgcacgagctggcccaggagatggagggcagcgacaagccccaggagctggccagagtgtgcctgggccaggccaacagacacttcggcatggccctgggcgccctgttcgtgcacgagcacttcagcgccgccagcaaggccaaggtgcagcagctggtggaggacatcaagtacatcctgggccagagactggaggagctggactggatggacgccgagaccagagccgccgccagagccaagctgcagtacatgatggtgatggtgggctaccccgacttcctgctgaagcccgacgccgtggacaaggagtacgagttcgaggtgcacgagaagacctacttcaagaacatcctgaacagcatcagattcagcatccagctgagcgtgaagaagatcagacaggaggtggacaagagcacctggctgctgcccccccaggccctgaacgcctactacctgcccaacaagaaccagatggtgttccccgccggcatcctgcagcccaccctgtacgaccccgacttcccccagagcctgaactacggcggcatcggcaccatcatcggccacgagctgacccacggctacgacgactggggcggccagtacgacagaagcggcaacctgctgcactggtggaccgaggccagctacagcagattcctgagaaaggccgagtgcatcgtgagactgtacgacaacttcaccgtgtacaaccagagagtgaacggcaagcacaccctgggcgagaacatcgccgacatgggcggcctgaagctggcctaccacgcctaccagaagtgggtgagagagcacggccccgagcaccccctgcccagactgaagtacacccacgaccagctgttcttcatcgccttcgcccagaactggtgcatcaagagaagaagccagagcatctacctgcaggtgctgaccgacaagcacgcccccgagcactacagagtgctgggcagcgtgagccagttcgaggagttcggcagagccttccactgccccaaggacagccccatgaaccccgcccacaagtgcagcgtgtggtag

SEQ ID NO: 80379 - DNA, 2322 bp, Artificial Sequence
  Description of Artificial Sequence: Synthetic coding sequence
atggagcccccctacagcctgaccgcccactacgacgagttccaggaggtgaagtacgtgagcagatgcggcgccggcggcgccagaggcgccagcctgccccccggcttccccctgggcgccgccagaagcgccaccggcgccagaagcggcctgcccagatggaacagaagagaggtgtgcctgctgagcggcctggtgttcgccgccggcctgtgcgccatcctggccgccatgctggccctgaagtacctgggccccgtggccgccggcggcggcgcctgccccgagggctgccccgagagaaaggccttcgccagagccgccagattcctggccgccaacctggacgccagcatcgacccctgccaggacttctacagcttcgcctgcggcggctggctgagaagacacgccatccccgacgacaagctgacctacggcaccatcgccgccatcggcgagcagaacgaggagagactgagaagactgctggccagacccggcggcggccccggcggcgccgcccagagaaaggtgagagccttcttcagaagctgcctggacatgagagagatcgagagactgggccccagacccatgctggaggtgatcgaggactgcggcggctgggacctgggcggcgccgaggagagacccggcgtggccgccagatgggacctgaacagactgctgtacaaggcccagggcgtgtacagcgccgccgccctgttcagcctgaccgtgagcctggacgacagaaacagcagcagatacgtgatcagaatcgaccaggacggcctgaccctgcccgagagaaccctgtacctggcccaggacgaggacagcgagaagatcctggccgcctacagagtgttcatggagagagtgctgagcctgctgggcgccgacgccgtggagcagaaggcccaggagatcctgcaggtggagcagcagctggccaacatcaccgtgagcgagcacgacgacctgagaagagacgtgagcagcatgtacaacaaggtgaccctgggccagctgcagaagatcaccccccacctgagatggaagtggctgctggaccagatcttccaggaggacttcagcgaggaggaggaggtggtgctgctggccaccgactacatgcagcaggtgagccagctgatcagaagcaccccccacagagtgctgcacaactacctggtgtggagagtggtggtggtgctgagcgagcacctgagcccccccttcagagaggccctgcacgagctggcccaggagatggagggcagcgacaagccccaggagctggccagagtgtgcctgggccaggccaacagacacttcggcatggccctgggcgccctgttcgtgcacgagcacttcagcgccgccagcaaggccaaggtgcagcagctggtggaggacatcaagtacatcctgggccagagactggaggagctggactggatggacgccgagaccagagccgccgccagagccaagctgcagtacatgatggtgatggtgggctaccccgacttcctgctgaagcccgacgccgtggacaaggagtacgagttcgaggtgcacgagaagacctacttcaagaacatcctgaacagcatcagattcagcatccagctgagcgtgaagaagatcagacaggaggtggacaagtggctgctgcccccccaggccctgaacgcctactacctgcccaacaagaaccagatggtgttccccgccggcatcctgcagcccaccctgtacgaccccgacttcccccagagcctgaactacggcggcatcggcaccatcatcggccacgagctgacccacggctacgacgactggggcggccagtacgacagaagcggcaacctgctgcactggtggaccgaggccagctacagcagattcctgagaaaggccgagtgcatcgtgagactgtacgacaacttcaccgtgtacaaccagagagtgaacggcaagcacaccctgggcgagaacatcgccgacatgggcggcctgaagctggcctaccacgcctaccagaagtgggtgagagagcacggccccgagcaccccctgcccagactgaagtacacccacgaccagctgttcttcatcgccttcgcccagaactggtgcatcaagagaagaagccagagcatctacctgcaggtgctgaccgacaagcacgcccccgagcactacagagtgctgggcagcgtgagccagttcgaggagttcggcagagccttccactgccccaaggacagccccatgaaccccgcccacaagtgcagcgtgtggtag

SEQ ID NO: 80380 - DNA, 1284 bp, Artificial Sequence
  Description of Artificial Sequence: Synthetic coding sequence
atggagaccctgtgcctgagagccagcttctggctggccctggtgggctgcgtgatcagcgacaaccccgagagatacagcaccaacctgagcaaccacgtggacgacttcaccaccttcagaggcaccgagctgagcttcctggtgaccacccaccagcccaccaacctggtgctgcccagcaacggcagcatgcacaactactgcccccagcagaccaagatcaccagcgccttcaagtacatcaacaccgtgatcagctgcaccatcttcatcgtgggcatggtgggcaacgccaccctgctgagaatcatctaccagaacaagtgcatgagaaacggccccaacgccctgatcgccagcctggccctgggcgacctgatctacgtggtgatcgacctgcccatcaacgtgttcaagctgctggccggcagatggcccttcgaccacaacgacttcggcgtgttcctgtgcaagctgttccccttcctgcagaagagcagcgtgggcatcaccgtgctgaacctgtgcgccctgagcgtggacagatacagagccgtggccagctggagcagagtgcagggcatcggcatccccctggtgaccgccatcgagatcgtgagcatctggatcctgagcttcatcctggccatccccgaggccatcggcttcgtgatggtgcccttcgagtacagaggcgagcagcacaagacctgcatgctgaacgccaccagcaagttcatggagttctaccaggacgtgaaggactggtggctgttcggcttctacttctgcatgcccctggtgtgcaccgccatcttctacaccctgatgacctgcgagatgctgaacagaagaaacggcagcctgagaatcgccctgagcgagcacctgaagcagagaagagaggtggccaagaccgtgttctgcctggtggtgatcttcgccctgtgctggttccccctgcacctgagcagaatcctgaagaagaccgtgtacaacgagatggacaagaacagatgcgagctgctgagcttcctgctgctgatggactacatcggcatcaacctggccaccatgaacagctgcatcaaccccatcgccctgtacttcgtgagcaagaagttcaagaactgcttccagagctgcctgtgctgctgctgctaccagagcaagagcctgatgaccagcgtgcccatgaacggcaccagcatccagtggaagaaccacgaccagaacaaccacaacaccgacagaagcagccacaaggacagcatgaactag

SEQ ID NO: 80381 - DNA, 486 bp, Artificial Sequence
  Description of Artificial Sequence: Synthetic coding sequence
atggagaccctgtgcctgagagccagcttctggctggccctggtgggctgcgtgatcagcgacaaccccgagagatacagcaccaacctgagcaaccacgtggacgacttcaccaccttcagaggcaccgagctgagcttcctggtgaccacccaccagcccaccaacctggtgctgcccagcaacggcagcatgcacaactactgcccccagcagaccaagatcaccagcgccttcaagtacatcaacaccgtgatcagctgcaccatcttcatcgtgggcatggtgggcaacgccaccctgctgagaatcatctaccagaacaagtgcatgagaaacggccccaacgccctgatcgccagcctggccctgggcgacctgatctacgtggtgatcgacctgcccatcaacgtgttcaaggtgcagagcagctgcctgctggagagctgcagcggcaactgggacagcttcggcaactgccactag

SEQ ID NO: 80382 - DNA, 957 bp, Artificial Sequence
  Description of Artificial Sequence: Synthetic coding sequence
atggagaccctgtgcctgagagccagcttctggctggccctggtgggctgcgtgatcagcgacaaccccgagagatacagcaccaacctgagcaaccacgtggacgacttcaccaccttcagaggcaccgagctgagcttcctggtgaccacccaccagcccaccaacctggtgctgcccagcaacggcagcatgcacaactactgcccccagcagaccaagatcaccagcgccttcaagtacatcaacaccgtgatcagctgcaccatcttcatcgtgggcatggtgggcaacgccaccctgctgagaatcatctaccagaacaagtgcatgagaaacggccccaacgccctgatcgccagcctggccctgggcgacctgatctacgtggtgatcgacctgcccatcaacgtgttcaagttctaccaggacgtgaaggactggtggctgttcggcttctacttctgcatgcccctggtgtgcaccgccatcttctacaccctgatgacctgcgagatgctgaacagaagaaacggcagcctgagaatcgccctgagcgagcacctgaagcagagaagagaggtggccaagaccgtgttctgcctggtggtgatcttcgccctgtgctggttccccctgcacctgagcagaatcctgaagaagaccgtgtacaacgagatggacaagaacagatgcgagctgctgagcttcctgctgctgatggactacatcggcatcaacctggccaccatgaacagctgcatcaaccccatcgccctgtacttcgtgagcaagaagttcaagaactgcttccagagctgcctgtgctgctgctgctaccagagcaagagcctgatgaccagcgtgcccatgaacggcaccagcatccagtggaagaaccacgaccagaacaaccacaacaccgacagaagcagccacaaggacagcatgaactag

SEQ ID NO: 80383 - DNA, 564 bp, Artificial Sequence
  Description of Artificial Sequence: Synthetic coding sequence
atggagaccctgtgcctgagagccagcttctggctggccctggtgggctgcgtgatcagcgacaaccccgagagatacagcaccaacctgagcaaccacgtggacgacttcaccaccttcagaggcaccgagctgagcttcctggtgaccacccaccagcccaccaacctggtgctgcccagcaacggcagcatgcacaactactgcccccagcagaccaagatcaccagcgccttcaagtacatcaacaccgtgatcagctgcaccatcttcatcgtgggcatggtgggcaacgccaccctgctgagaatcatctaccagaacaagtgcatgagaaacggccccaacgccctgatcgccagcctggccctgggcgacctgatctacgtggtgatcgacctgcccatcaacgtgttcaagctgctggccggcagatggcccttcgaccacaacgacttcggcgtgttcctgtgcaagctgttccccttcctgcagaagagcagcgtgggcatcaccgtgctgaacctgtgcgccctgagcgtggacagaaagaccgagatgtag

SEQ ID NO: 80384 - DNA, 957 bp, Artificial Sequence; identical to SEQ ID NO: 80382
  Description of Artificial Sequence: Synthetic coding sequence

SEQ ID NO: 80385 - DNA, 1179 bp, Artificial Sequence
  Description of Artificial Sequence: Synthetic coding sequence
atggaggagcagcagcccgagcccaagagccagagagacagcgccctgggcgccgccgccgccgccacccccggcggcctgagcctgagcctgagccccggcgccagcggcagcagcggcagcggcagcgacggcgacagcgtgcccgtgagcccccagcccgccccccccagcccccccgccgccccctgcctgccccccctggcccaccacccccacctgcccccccaccccccccccccccccccccagcacctggccgcccccgcccaccagccccagcccgccgcccagctgcacagaaccaccaacttcttcatcgacaacatcctgagacccgacttcggctgcaagaaggagcagccccccccccagctgctggtggccgccgccgccagaggcggcgccggcggcggcggcagagtggagagagacagaggccagaccgccgccggcagagaccccgtgcaccccctgggcaccagagcccccggcgccgccagcctgctgtgcgcccccgacgccaactgcggcccccccgacggcagccagcccgccgccgccggcgccggcgccagcaaggccggcaaccccgccgccgccgccgccgccgccgccgccgccgtggccgccgccgccgccgccgccgccgccaagcccagcgacaccggcggcggcggcagcggcggcggcgccggcagccccggcgcccagggcaccaagtaccccgagcacggcaaccccgccatcctgctgatgggcagcgccaacggcggccccgtggtgaagaccgacagccagcagcccctggtgtggcccgcctgggtgtactgcaccagatacagcgacagacccagcagcggccccagaaccagaaagctgaagaagaagaagaacgagaaggaggacaagagacccagaaccgccttcaccgccgagcagctgcagagactgaaggccgagttccaggccaacagatacatcaccgagcagagaagacagaccctggcccaggagctgagcctgaacgagagccagatcaagatctggttccagaacaagagagccaagatcaagaaggccaccggcatcaagaacggcctggccctgcacctgatggcccagggcctgtacaaccacagcaccaccaccgtgcaggacaaggacgagagcgagtag

SEQ ID NO: 80386 - DNA, 1002 bp, Artificial Sequence
  Description of Artificial Sequence: Synthetic coding sequence
atggaggagaacgaccccaagcccggcgaggccgccgccgccgtggagggccagagacagcccgagagcagccccggcggcggcagcggcggcggcggcggcagcagccccggcgaggccgacaccggcagaagaagagccctgatgctgcccgccgtgctgcaggcccccggcaaccaccagcacccccacagaatcaccaacttcttcatcgacaacatcctgagacccgagttcggcagaagaaaggacgccggcacctgctgcgccggcgccggcggcggcagaggcggcggcgccggcggcgagggcggcgccagcggcgccgagggcggcggcggcgccggcggcagcgagcagctgctgggcagcggcagcagagagcccagacagaaccccccctgcgcccccggcgccggcggccccctgcccgccgccggcagcgacagccccggcgacggcgagggcggcagcaagaccctgagcctgcacggcggcgccaagaagggcggcgaccccggcggccccctggacggcagcctgaaggccagaggcctgggcggcggcgacctgagcgtgagcagcgacagcgacagcagccaggccggcgccaacctgggcgcccagcccatgctgtggcccgcctgggtgtactgcaccagatacagcgacagacccagcagcggccccagaagcagaaagcccaagaagaagaaccccaacaaggaggacaagagacccagaaccgccttcaccgccgagcagctgcagagactgaaggccgagttccagaccaacagatacctgaccgagcagagaagacagagcctggcccaggagctgagcctgaacgagagccagatcaagatctggttccagaacaagagagccaagatcaagaaggccaccggcaacaagaacaccctggccgtgcacctgatggcccagggcctgtacaaccacagcaccaccgccaaggagggcaagagcgacagcgagtag

SEQ ID NO: 80387 - DNA, 2184 bp, Artificial Sequence
  Description of Artificial Sequence: Synthetic coding sequence
atgcccccccccgccgacatcgtgaaggtggccatcgagtggcccggcgcctaccccaagctgatggagatcgaccagaagaagcccctgagcgccatcatcaaggaggtgtgcgacggctggagcctggccaaccacgagtacttcgccctgcagcacgccgacagcagcaacttctacatcaccgagaagaacagaaacgagatcaagaacggcaccatcctgagactgaccaccagccccgcccagaacgcccagcagctgcacgagagaatccagagcagcagcatggacgccaagctggaggccctgaaggacctggccagcctgagcagagacgtgaccttcgcccaggagttcatcaacctggacggcatcagcctgctgacccagatggtggagagcggcaccgagagataccagaagctgcagaagatcatgaagccctgcttcggcgacatgctgagcttcaccctgaccgccttcgtggagctgatggaccacggcatcgtgagctgggacaccttcagcgtggccttcatcaagaagatcgccagcttcgtgaacaagagcgccatcgacatcagcatcctgcagagaagcctggccatcctggagagcatggtgctgaacagccacgacctgtaccagaaggtggcccaggagatcaccatcggccagctgatcccccacctgcagggcagcgaccaggagatccagacctacaccatcgccgtgatcaacgccctgttcctgaaggcccccgacgagagaagacaggagatggccaacatcctggcccagaagcagctgagaagcatcatcctgacccacgtgatcagagcccagagagccatcaacaacgagatggcccaccagctgtacgtgctgcaggtgctgaccttcaacctgctggaggacagaatgatgaccaagatggacccccaggaccaggcccagagagacatcatcttcgagctgagaagaatcgccttcgacgccgagagcgagcccaacaacagcagcggcagcatggagaagagaaagagcatgtacaccagagactacaagaagctgggcttcatcaaccacgtgaaccccgccatggacttcacccagaccccccccggcatgctggccctggacaacatgctgtacttcgccaagcaccaccaggacgcctacatcagaatcgtgctggagaacagcagcagagaggacaagcacgagtgccccttcggcagaagcagcatcgagctgaccaagatgctgtgcgagatcctgaaggtgggcgagctgcccagcgagacctgcaacgacttccaccccatgttcttcacccacgacagaagcttcgaggagttcttctgcatctgcatccagctgctgaacaagacctggaaggagatgagagccaccagcgaggacttcaacaaggtgatgcaggtggtgaaggagcaggtgatgagagccctgaccaccaagcccagcagcctggaccagttcaagagcaagctgcagaacctgagctacaccgagatcctgaagatcagacagagcgagagaatgaaccaggaggacttccagagcagacccatcctggagctgaaggagaagatccagcccgagatcctggagctgatcaagcagcagagactgaacagactggtggagggcacctgcttcagaaagctgaacgccagaagaagacaggacaagttctggtactgcagactgagccccaaccacaaggtgctgcactacggcgacctggaggagagcccccagggcgaggtgccccacgacagcctgcaggacaagctgcccgtggccgacatcaaggccgtggtgaccggcaaggactgcccccacatgaaggagaagggcgccctgaagcagaacaaggaggtgctggagctggccttcagcatcctgtacgacagcaactgccagctgaacttcatcgcccccgacaagcacgagtactgcatctggaccgacggcctgaacgccctgctgggcaaggacatgatgagcgacctgaccagaaacgacctggacaccctgctgagcatggagatcaagctgagactgctggacctggagaacatccagatccccgacgcccccccccccatccccaaggagcccagcaactacgacttcgtgtacgactgcaactag

SEQ ID NO: 80388 - DNA, 1290 bp, Artificial Sequence
  Description of Artificial Sequence: Synthetic coding sequence
atgagcgagcaccagaaggagcagaccctggacacccccagcctgagaaccgtgaccctgaccgtgagagtgcacggcttcatcctggaggtgagcaagaccaagaacccccccatccccgacaccttctggccccccagatgggaccacagacccagccccggcggcgagaccaacgcctactgccagatgaaccacgtgaaccccgccatggacttcacccagaccccccccggcatgctggccctggacaacatgctgtacttcgccaagcaccaccaggacgcctacatcagaatcgtgctggagaacagcagcagagaggacaagcacgagtgccccttcggcagaagcagcatcgagctgaccaagatgctgtgcgagatcctgaaggtgggcgagctgcccagcgagacctgcaacgacttccaccccatgttcttcacccacgacagaagcttcgaggagttcttctgcatctgcatccagctgctgaacaagacctggaaggagatgagagccaccagcgaggacttcaacaaggtgatgcaggtggtgaaggagcaggtgatgagagccctgaccaccaagcccagcagcctggaccagttcaagagcaagctgcagaacctgagctacaccgagatcctgaagatcagacagagcgagagaatgaaccaggaggacttccagagcagacccatcctggagctgaaggagaagatccagcccgagatcctggagctgatcaagcagcagagactgaacagactggtggagggcacctgcttcagaaagctgaacgccagaagaagacaggacaagttctggtactgcagactgagccccaaccacaaggtgctgcactacggcgacctggaggagagcccccagggcgaggtgccccacgacagcctgcaggacaagctgcccgtggccgacatcaaggccgtggtgaccggcaaggactgcccccacatgaaggagaagggcgccctgaagcagaacaaggaggtgctggagctggccttcagcatcctgtacgacagcaactgccagctgaacttcatcgcccccgacaagcacgagtactgcatctggaccgacggcctgaacgccctgctgggcaaggacatgatgagcgacctgaccagaaacgacctggacaccctgctgagcatggagatcaagctgagactgctggacctggagaacatccagatccccgacgcccccccccccatccccaaggagcccagcaactacgacttcgtgtacgactgcaactag

SEQ ID NO: 80389 - DNA, 1896 bp, Artificial Sequence
  Description of Artificial Sequence: Synthetic coding sequence
atggacgccaagctggaggccctgaaggacctggccagcctgagcagagacgtgaccttcgcccaggagttcatcaacctggacggcatcagcctgctgacccagatggtggagagcggcaccgagagataccagaagctgcagaagatcatgaagccctgcttcggcgacatgctgagcttcaccctgaccgccttcgtggagctgatggaccacggcatcgtgagctgggacaccttcagcgtggccttcatcaagaagatcgccagcttcgtgaacaagagcgccatcgacatcagcatcctgcagagaagcctggccatcctggagagcatggtgctgaacagccacgacctgtaccagaaggtggcccaggagatcaccatcggccagctgatcccccacctgcagggcagcgaccaggagatccagacctacaccatcgccgtgatcaacgccctgttcctgaaggcccccgacgagagaagacaggagatggccaacatcctggcccagaagcagctgagaagcatcatcctgacccacgtgatcagagcccagagagccatcaacaacgagatggcccaccagctgtacgtgctgcaggtgctgaccttcaacctgctggaggacagaatgatgaccaagatggacccccaggaccaggcccagagagacatcatcttcgagctgagaagaatcgccttcgacgccgagagcgagcccaacaacagcagcggcagcatggagaagagaaagagcatgtacaccagagactacaagaagctgggcttcatcaaccacgtgaaccccgccatggacttcacccagaccccccccggcatgctggccctggacaacatgctgtacttcgccaagcaccaccaggacgcctacatcagaatcgtgctggagaacagcagcagagaggacaagcacgagtgccccttcggcagaagcagcatcgagctgaccaagatgctgtgcgagatcctgaaggtgggcgagctgcccagcgagacctgcaacgacttccaccccatgttcttcacccacgacagaagcttcgaggagttcttctgcatctgcatccagctgctgaacaagacctggaaggagatgagagccaccagcgaggacttcaacaaggtgatgcaggtggtgaaggagcaggtgatgagagccctgaccaccaagcccagcagcctggaccagttcaagagcaagctgcagaacctgagctacaccgagatcctgaagatcagacagagcgagagaatgaaccaggaggacttccagagcagacccatcctggagctgaaggagaagatccagcccgagatcctggagctgatcaagcagcagagactgaacagactggtggagggcacctgcttcagaaagctgaacgccagaagaagacaggacaagttctggtactgcagactgagccccaaccacaaggtgctgcactacggcgacctggaggagagcccccagggcgaggtgccccacgacagcctgcaggacaagctgcccgtggccgacatcaaggccgtggtgaccggcaaggactgcccccacatgaaggagaagggcgccctgaagcagaacaaggaggtgctggagctggccttcagcatcctgtacgacagcaactgccagctgaacttcatcgcccccgacaagcacgagtactgcatctggaccgacggcctgaacgccctgctgggcaaggacatgatgagcgacctgaccagaaacgacctggacaccctgctgagcatggagatcaagctgagactgctggacctggagaacatccagatccccgacgcccccccccccatccccaaggagcccagcaactacgacttcgtgtacgactgcaactag

SEQ ID NO: 80390 - DNA, 744 bp, Artificial Sequence
  Description of Artificial Sequence: Synthetic coding sequence
atgcaggtggtgaaggagcaggtgatgagagccctgaccaccaagcccagcagcctggaccagttcaagagcaagctgcagaacctgagctacaccgagatcctgaagatcagacagagcgagagaatgaaccaggaggacttccagagcagacccatcctggagctgaaggagaagatccagcccgagatcctggagctgatcaagcagcagagactgaacagactggtggagggcacctgcttcagaaagctgaacgccagaagaagacaggacaagttctggtactgcagactgagccccaaccacaaggtgctgcactacggcgacctggaggagagcccccagggcgaggtgccccacgacagcctgcaggacaagctgcccgtggccgacatcaaggccgtggtgaccggcaaggactgcccccacatgaaggagaagggcgccctgaagcagaacaaggaggtgctggagctggccttcagcatcctgtacgacagcaactgccagctgaacttcatcgcccccgacaagcacgagtactgcatctggaccgacggcctgaacgccctgctgggcaaggacatgatgagcgacctgaccagaaacgacctggacaccctgctgagcatggagatcaagctgagactgctggacctggagaacatccagatccccgacgcccccccccccatccccaaggagcccagcaactacgacttcgtgtacgactgcaactag

SEQ ID NO: 80391 - DNA, 744 bp, Artificial Sequence; identical to SEQ ID NO: 80390
  Description of Artificial Sequence: Synthetic coding sequence

SEQ ID NO: 80392 - DNA, 2184 bp, Artificial Sequence; identical to SEQ ID NO: 80387
  Description of Artificial Sequence: Synthetic coding sequence

SEQ ID NO: 80393 - DNA, 180 bp, Artificial Sequence
  Description of Artificial Sequence: Synthetic coding sequence
atgcccccccccgccgacatcgtgaaggtggccatcgagtggcccggcgcctaccccaagctgatggagatcgaccagaagaagcccctgagcgccatcatcaaggaggtgtgcgacggctggagcctggccaaccacgagtacttcgccctgcagcacgccgacagcagcaacttctag

SEQ ID NO: 80394 - DNA, 2184 bp, Artificial Sequence; identical to SEQ ID NO: 80387
  Description of Artificial Sequence: Synthetic coding sequence

SEQ ID NO: 80395 - DNA, 246 bp, Artificial Sequence
  Description of Artificial Sequence: Synthetic coding sequence
atgcccccccccgccgacatcgtgaaggtggccatcgagtggcccggcgcctaccccaagctgatggagatcgaccagaagaagcccctgagcgccatcatcaaggaggtgtgcgacggctggagcctggccaaccacgagtacttcgccctgcagcacgccgacagcagcaacttctacatcaccgagaagaacagaaacgagatcaagaacggcaccatcctgagactgaccaccagcccctag

SEQ ID NO: 80396 - DNA, 450 bp, Artificial Sequence
  Description of Artificial Sequence: Synthetic coding sequence
atgcccccccccgccgacatcgtgaaggtggccatcgagtggcccggcgcctaccccaagctgatggagatcgaccagaagaagcccctgagcgccatcatcaaggaggtgtgcgacggctggagcctggccaaccacgagtacttcgccctgcagcacgccgacagcagcaacttctacatcaccgagaagaacagaaacgagatcaagaacggcaccatcctgagactgaccaccagccccgcccagaacgcccagcagctgcacgagagaatccagagcagcagcatggacgccaagctggaggccctgaaggacctggccagcctgagcagagacgtgaccttcgcccaggagttcatcaacctggacggcatcagcctgctgacccagatggtggagagcggcaccgagagataccagaagctgcagaagatcatgaagccctag

SEQ ID NO: 80397 - DNA, 2163 bp, Artificial Sequence
  Description of Artificial Sequence: Synthetic coding sequence
atgcccccccccagcgacatcgtgaaggtggccatcgagtggcccggcgccaacgcccagctgctggagatcgaccagaagagacccctggccagcatcatcaaggaggtgtgcgacggctggagcctgcccaaccccgagtactacaccctgagatacgccgacggcccccagctgtacatcaccgagcagaccagaagcgacatcaagaacggcaccatcctgcagctggccatcagccccagcagagccgccagacagctgatggagagaacccagagcagcaacatggagaccagactggacgccatgaaggagctggccaagctgagcgccgacgtgaccttcgccaccgagttcatcaacatggacggcatcatcgtgctgaccagactggtggagagcggcaccaagctgctgagccactacagcgagatgctggccttcaccctgaccgccttcctggagctgatggaccacggcatcgtgagctgggacatggtgagcatcaccttcatcaagcagatcgccggctacgtgagccagcccatggtggacgtgagcatcctgcagagaagcctggccatcctggagagcatggtgctgaacagccagagcctgtaccagaagatcgccgaggagatcaccgtgggccagctgatcagccacctgcaggtgagcaaccaggagatccagacctacgccatcgccctgatcaacgccctgttcctgaaggcccccgaggacaagagacaggacatggccaacgccttcgcccagaagcacctgagaagcatcatcctgaaccacgtgatcagaggcaacagacccatcaagaccgagatggcccaccagctgtacgtgctgcaggtgctgaccttcaacctgctggaggagagaatgatgaccaagatggaccccaacgaccaggcccagagagacatcatcttcgagctgagaagaatcgccttcgacgccgagagcgaccccagcaacgcccccggcagcggcaccgagaagagaaaggccatgtacaccaaggactacaagatgctgggcttcaccaaccacatcaaccccgccatggacttcacccagaccccccccggcatgctggccctggacaacatgctgtacctggccaaggtgcaccaggacacctacatcagaatcgtgctggagaacagcagcagagaggacaagcacgagtgccccttcggcagaagcgccatcgagctgaccaagatgctgtgcgagatcctgcaggtgggcgagctgcccaacgagggcagaaacgactaccaccccatgttcttcacccacgacagagccttcgaggagctgttcggcatctgcatccagctgctgaacaagacctggaaggagatgagagccaccgccgaggacttcaacaaggtgatgcaggtggtgagagagcagatcaccagagccctgcccagcaagcccaacagcctggaccagttcaagagcaagctgagaagcctgagctacagcgagatcctgagactgagacagagcgagagaatgagccaggacgacttccagagcccccccatcgtggagctgagagagaagatccagcccgagatcctggagctgatcaagcagcagagactgaacagactgtgcgagggcagcagcttcagaaagatcggcaacagaagaagacaggagagattctggtactgcagactggccctgaaccacaaggtgctgcactacggcgacctggacgacaacccccagggcgaggtgaccttcgagagcctgcaggagaagatccccgtggccgacatcaaggccatcgtgaccggcaaggactgcccccacatgaaggagaagagcgccctgaagcagaacaaggaggtgctggagctggccttcagcatcctgtacgaccccgacgagaccctgaacttcatcgcccccaacaagtacgagtactgcatctggatcgacggcctgagcgccctgctgggcaaggacatgagcagcgagctgaccaagagcgacctggacaccctgctgagcatggagatgaagctgagactgctggacctggagaacatccagatccccgaggcccccccccccatccccaaggagcccagcagctacgacttcgtgtaccactacggctag

SEQ ID NO: 80398 - DNA, 2157 bp, Artificial Sequence
  Description of Artificial Sequence: Synthetic coding sequence
atgcccccccccagcgacatcgtgaaggtggccatcgagtggcccggcgccaacgcccagctgctggagatcgaccagaagagacccctggccagcatcatcaaggaggtgtgcgacggctggagcctgcccaaccccgagtactacaccctgagatacgccgacggcccccagctgtacatcaccgagcagaccagaagcgacatcaagaacggcaccatcctgcagctggccatcagccccagcagagccgccagacagctgatggagagaacccagagcagcaacatggagaccagactggacgccatgaaggagctggccaagctgagcgccgacgtgaccttcgccaccgagttcatcaacatggacggcatcatcgtgctgaccagactggtggagagcggcaccaagctgctgagccacgagatgctggccttcaccctgaccgccttcctggagctgatggaccacggcatcgtgagctgggacatggtgagcatcaccttcatcaagcagatcgccggctacgtgagccagcccatggtggacgtgagcatcctgcagagaagcctggccatcctggagagcatggtgctgaacagccagagcctgtaccagaagatcgccgaggagatcaccgtgggccagctgatcagccacctgcaggtgagcaaccaggagatccagacctacgccatcgccctgatcaacgccctgttcctgaaggcccccgaggacaagagacaggacatggccaacgccttcgcccagaagcacctgagaagcatcatcctgaaccacgtgatcagaggcaacagacccatcaagaccgagatggcccaccagctgtacgtgctgcaggtgctgaccttcaacctgctggaggagagaatgatgaccaagatggaccccaacgaccaggcccagagagacatcatcttcgagctgagaagaatcgccttcgacgccgagagcgaccccagcaacgcccccggcagcggcaccgagaagagaaaggccatgtacaccaaggactacaagatgctgggcttcaccaaccacatcaaccccgccatggacttcacccagaccccccccggcatgctggccctggacaacatgctgtacctggccaaggtgcaccaggacacctacatcagaatcgtgctggagaacagcagcagagaggacaagcacgagtgccccttcggcagaagcgccatcgagctgaccaagatgctgtgcgagatcctgcaggtgggcgagctgcccaacgagggcagaaacgactaccaccccatgttcttcacccacgacagagccttcgaggagctgttcggcatctgcatccagctgctgaacaagacctggaaggagatgagagccaccgccgaggacttcaacaaggtgatgcaggtggtgagagagcagatcaccagagccctgcccagcaagcccaacagcctggaccagttcaagagcaagctgagaagcctgagctacagcgagatcctgagactgagacagagcgagagaatgagccaggacgacttccagagcccccccatcgtggagctgagagagaagatccagcccgagatcctggagctgatcaagcagcagagactgaacagactgtgcgagggcagcagcttcagaaagatcggcaacagaagaagacaggagagattctggtactgcagactggccctgaaccacaaggtgctgcactacggcgacctggacgacaacccccagggcgaggtgaccttcgagagcctgcaggagaagatccccgtggccgacatcaaggccatcgtgaccggcaaggactgcccccacatgaaggagaagagcgccctgaagcagaacaaggaggtgctggagctggccttcagcatcctgtacgaccccgacgagaccctgaacttcatcgcccccaacaagtacgagtactgcatctggatcgacggcctgagcgccctgctgggcaaggacatgagcagcgagctgaccaagagcgacctggacaccctgctgagcatggagatgaagctgagactgctggacctggagaacatccagatccccgaggcccccccccccatccccaaggagcccagcagctacgacttcgtgtaccactacggctag

SEQ ID NO: 80399 - DNA, 1899 bp, Artificial Sequence
  Description of Artificial Sequence: Synthetic coding sequence
atggagagaacccagagcagcaacatggagaccagactggacgccatgaaggagctggccaagctgagcgccgacgtgaccttcgccaccgagttcatcaacatggacggcatcatcgtgctgaccagactggtggagagcggcaccaagctgctgagccactacagcgagatgctggccttcaccctgaccgccttcctggagctgatggaccacggcatcgtgagctgggacatggtgagcatcaccttcatcaagcagatcgccggctacgtgagccagcccatggtggacgtgagcatcctgcagagaagcctggccatcctggagagcatggtgctgaacagccagagcctgtaccagaagatcgccgaggagatcaccgtgggccagctgatcagccacctgcaggtgagcaaccaggagatccagacctacgccatcgccctgatcaacgccctgttcctgaaggcccccgaggacaagagacaggacatggccaacgccttcgcccagaagcacctgagaagcatcatcctgaaccacgtgatcagaggcaacagacccatcaagaccgagatggcccaccagctgtacgtgctgcaggtgctgaccttcaacctgctggaggagagaatgatgaccaagatggaccccaacgaccaggcccagagagacatcatcttcgagctgagaagaatcgccttcgacgccgagagcgaccccagcaacgcccccggcagcggcaccgagaagagaaaggccatgtacaccaaggactacaagatgctgggcttcaccaaccacatcaaccccgccatggacttcacccagaccccccccggcatgctggccctggacaacatgctgtacctggccaaggtgcaccaggacacctacatcagaatcgtgctggagaacagcagcagagaggacaagcacgagtgccccttcggcagaagcgccatcgagctgaccaagatgctgtgcgagatcctgcaggtgggcgagctgcccaacgagggcagaaacgactaccaccccatgttcttcacccacgacagagccttcgaggagctgttcggcatctgcatccagctgctgaacaagacctggaaggagatgagagccaccgccgaggacttcaacaaggtgatgcaggtggtgagagagcagatcaccagagccctgcccagcaagcccaacagcctggaccagttcaagagcaagctgagaagcctgagctacagcgagatcctgagactgagacagagcgagagaatgagccaggacgacttccagagcccccccatcgtggagctgagagagaagatccagcccgagatcctggagctgatcaagcagcagagactgaacagactgtgcgagggcagcagcttcagaaagatcggcaacagaagaagacaggagagattctggtactgcagactggccctgaaccacaaggtgctgcactacggcgacctggacgacaacccccagggcgaggtgaccttcgagagcctgcaggagaagatccccgtggccgacatcaaggccatcgtgaccggcaaggactgcccccacatgaaggagaagagcgccctgaagcagaacaaggaggtgctggagctggccttcagcatcctgtacgaccccgacgagaccctgaacttcatcgcccccaacaagtacgagtactgcatctggatcgacggcctgagcgccctgctgggcaaggacatgagcagcgagctgaccaagagcgacctggacaccctgctgagcatggagatgaagctgagactgctggacctggagaacatccagatccccgaggcccccccccccatccccaaggagcccagcagctacgacttcgtgtaccactacggctag

SEQ ID NO: 80400 - DNA, 2163 bp, Artificial Sequence; identical to SEQ ID NO: 80397
  Description of Artificial Sequence: Synthetic coding sequence

SEQ ID NO: 80401 - DNA, 804 bp, Artificial Sequence
  Description of Artificial Sequence: Synthetic coding sequence
gaggagatcaccgtgggccagctgatcagccacctgcaggtgagcaaccaggagatccagacctacgccatcgccctgatcaacgccctgttcctgaaggcccccgaggacaagagacaggacatggccaacgccttcgcccagaagcacctgagaagcatcatcctgaaccacgtgatcagaggcaacagacccatcaagaccgagatggcccaccagctgtacgtgctgcaggtgctgaccttcaacctgctggaggagagaatgatgaccaagatggaccccaacgaccaggcccagagagacatcatcttcgagctgagaagaatcgccttcgacgccgagagcgaccccagcaacgcccccggcagcggcaccgagaagagaaaggccatgtacaccaaggactacaagatgctgggcttcaccaaccacatcaaccccgccatggacttcacccagaccccccccggcatgctggccctggacaacatgctgtacctggccaaggtgcaccaggacacctacatcagaatcgtgctggagaacagcagcagagaggacaagcacgagtgccccttcggcagaagcgccatcgagctgaccaagatgctgtgcgagatcctgcaggtgggcgagctgcccaacgagggcagaaacgactaccaccccatgttcttcacccacgacagagccttcgaggagctgttcggcatctgcatccagctgctgaacaagacctggaaggagatgagagccaccgccgaggacttcaacaaggtgagcgtgagcggcctgctgtag

SEQ ID NO: 80402 - DNA, 2199 bp, Artificial Sequence
  Description of Artificial Sequence: Synthetic coding sequence
atgcccccccccagcgacatcgtgaaggtggccatcgagtggcccggcgccaacgcccagctgctggagatcgaccagaagagacccctggccagcatcatcaaggaggtgtgcgacggctggagcctgcccaaccccgagtactacaccctgagatacgccgacggcccccagctgtacatcaccgagcagaccagaagcgacatcaagaacggcaccatcctgcagctggccatcagccccagcagagccgccagacagctgatggagagaacccagagcagcaacatggagaccagactggacgccatgaaggagctggccaagctgagcgccgacgtgaccttcgccaccgagttcatcaacatggacggcatcatcgtgctgaccagactggtggagagcggcaccaagctgctgagccactacagcgagatgctggccttcaccctgaccgccttcctggagctgatggaccacggcatcgtgagctgggacatggtgagcatcaccttcatcaagcagatcgccggctacgtgagccagcccatggtggacgtgagcatcctgcagagaagcctggccatcctggagagcatggtgctgaacagccagagcctgtaccagaagatcgccgaggagatcaccgtgggccagctgatcagccacctgcaggtgagcaaccaggagatccagacctacgccatcgccctgatcaacgccctgttcctgaaggcccccgaggacaagagacaggacaagcacctgaaccccctggacctgcccgtgaccgacatggccaacgccttcgcccagaagcacctgagaagcatcatcctgaaccacgtgatcagaggcaacagacccatcaagaccgagatggcccaccagctgtacgtgctgcaggtgctgaccttcaacctgctggaggagagaatgatgaccaagatggaccccaacgaccaggcccagagagacatcatcttcgagctgagaagaatcgccttcgacgccgagagcgaccccagcaacgcccccggcagcggcaccgagaagagaaaggccatgtacaccaaggactacaagatgctgggcttcaccaaccacatcaaccccgccatggacttcacccagaccccccccggcatgctggccctggacaacatgctgtacctggccaaggtgcaccaggacacctacatcagaatcgtgctggagaacagcagcagagaggacaagcacgagtgccccttcggcagaagcgccatcgagctgaccaagatgctgtgcgagatcctgcaggtgggcgagctgcccaacgagggcagaaacgactaccaccccatgttcttcacccacgacagagccttcgaggagctgttcggcatctgcatccagctgctgaacaagacctggaaggagatgagagccaccgccgaggacttcaacaaggtgatgcaggtggtgagagagcagatcaccagagccctgcccagcaagcccaacagcctggaccagttcaagagcaagctgagaagcctgagctacagcgagatcctgagactgagacagagcgagagaatgagccaggacgacttccagagcccccccatcgtggagctgagagagaagatccagcccgagatcctggagctgatcaagcagcagagactgaacagactgtgcgagggcagcagcttcagaaagatcggcaacagaagaagacaggagagattctggtactgcagactggccctgaaccacaaggtgctgcactacggcgacctggacgacaacccccagggcgaggtgaccttcgagagcctgcaggagaagatccccgtggccgacatcaaggccatcgtgaccggcaaggactgcccccacatgaaggagaagagcgccctgaagcagaacaaggaggtgctggagctggccttcagcatcctgtacgaccccgacgagaccctgaacttcatcgcccccaacaagtacgagtactgcatctggatcgacggcctgagcgccctgctgggcaaggacatgagcagcgagctgaccaagagcgacctggacaccctgctgagcatggagatgaagctgagactgctggacctggagaacatccagatccccgaggcccccccccccatccccaaggagcccagcagctacgacttcgtgtaccactacggctag

SEQ ID NO: 80403 - DNA, 1614 bp, Artificial Sequence
  Description of Artificial Sequence: Synthetic coding sequence
atggtggacgtgagcatcctgcagagaagcctggccatcctggagagcatggtgctgaacagccagagcctgtaccagaagatcgccgaggagatcaccgtgggccagctgatcagccacctgcaggtgagcaaccaggagatccagacctacgccatcgccctgatcaacgccctgttcctgaaggcccccgaggacaagagacaggacatggccaacgccttcgcccagaagcacctgagaagcatcatcctgaaccacgtgatcagaggcaacagacccatcaagaccgagatggcccaccagctgtacgtgctgcaggtgctgaccttcaacctgctggaggagagaatgatgaccaagatggaccccaacgaccaggcccagagagacatcatcttcgagctgagaagaatcgccttcgacgccgagagcgaccccagcaacgcccccggcagcggcaccgagaagagaaaggccatgtacaccaaggactacaagatgctgggcttcaccaaccacatcaaccccgccatggacttcacccagaccccccccggcatgctggccctggacaacatgctgtacctggccaaggtgcaccaggacacctacatcagaatcgtgctggagaacagcagcagagaggacaagcacgagtgccccttcggcagaagcgccatcgagctgaccaagatgctgtgcgagatcctgcaggtgggcgagctgcccaacgagggcagaaacgactaccaccccatgttcttcacccacgacagagccttcgaggagctgttcggcatctgcatccagctgctgaacaagacctggaaggagatgagagccaccgccgaggacttcaacaaggtgatgcaggtggtgagagagcagatcaccagagccctgcccagcaagcccaacagcctggaccagttcaagagcaagctgagaagcctgagctacagcgagatcctgagactgagacagagcgagagaatgagccaggacgacttccagagcccccccatcgtggagctgagagagaagatccagcccgagatcctggagctgatcaagcagcagagactgaacagactgtgcgagggcagcagcttcagaaagatcggcaacagaagaagacaggagagattctggtactgcagactggccctgaaccacaaggtgctgcactacggcgacctggacgacaacccccagggcgaggtgaccttcgagagcctgcaggagaagatccccgtggccgacatcaaggccatcgtgaccggcaaggactgcccccacatgaaggagaagagcgccctgaagcagaacaaggaggtgctggagctggccttcagcatcctgtacgaccccgacgagaccctgaacttcatcgcccccaacaagtacgagtactgcatctggatcgacggcctgagcgccctgctgggcaaggacatgagcagcgagctgaccaagagcgacctggacaccctgctgagcatggagatgaagctgagactgctggacctggagaacatccagatccccgaggcccccccccccatccccaaggagcccagcagctacgacttcgtgtaccactacggctag

SEQ ID NO: 80404 - DNA, 1017 bp, Artificial Sequence
  Description of Artificial Sequence: Synthetic coding sequence
atgcccccccccagcgacatcgtgaaggtggccatcgagtggcccggcgccaacgcccagctgctggagatcgaccagaagagacccctggccagcatcatcaaggaggtgtgcgacggctggagcctgcccaaccccgagtactacaccctgagatacgccgacggcccccagctgtacatcaccgagcagaccagaagcgacatcaagaacggcaccatcctgcagctggccatcagccccagcagagccgccagacagctgatggagagaacccagagcagcaacatggagaccagactggacgccatgaaggagctggccaagctgagcgccgacgtgaccttcgccaccgagttcatcaacatggacggcatcatcgtgctgaccagactggtggagagcggcaccaagctgctgagccactacagcgagatgctggccttcaccctgaccgccttcctggagctgatggaccacggcatcgtgagctgggacatggtgagcatcaccttcatcaagcagatcgccggctacgtgagccagcccatggtggacgtgagcatcctgcagagaagcctggccatcctggagagcatggtgctgaacagccagagcctgtaccagaagatcgccgaggagatcaccgtgggccagctgatcagccacctgcaggtgagcaaccaggagatccagacctacgccatcgccctgatcaacgccctgttcctgaaggcccccgaggacaagagacaggacatggccaacgccttcgcccagaagcacctgagaagcatcatcctgaaccacgtgatcagaggcaacagacccatcaagaccgagatggcccaccagctgtacgtgctgcaggtgctgaccttcaacctgctggaggagagaatgatgaccaagatggaccccaacgaccaggcccagagagacatcatcttcgagctgagaagaatcgccttcgacgccgagagcgaccccagcaacgcccccggcagcggcacctag

SEQ ID NO: 80405 - DNA, 852 bp, Artificial Sequence
  Description of Artificial Sequence: Synthetic coding sequence
taccaccccatgttcttcacccacgacagagccttcgaggagctgttcggcatctgcatccagctgctgaacaagacctggaaggagatgagagccaccgccgaggacttcaacaaggtgatgcaggtggtgagagagcagatcaccagagccctgcccagcaagcccaacagcctggaccagttcaagagcaagctgagaagcctgagctacagcgagatcctgagactgagacagagcgagagaatgagccaggacgacttccagagcccccccatcgtggagctgagagagaagatccagcccgagatcctggagctgatcaagcagcagagactgaacagactgtgcgagggcagcagcttcagaaagatcggcaacagaagaagacaggagagattctggtactgcagactggccctgaaccacaaggtgctgcactacggcgacctggacgacaacccccagggcgaggtgaccttcgagagcctgcaggagaagaacatcaaggccatcgtgaccggcaaggactgcccccacatgaaggagaagagcgccctgaagcagaacaaggaggtgctggagctggccttcagcatcctgtacgaccccgacgagaccctgaacttcatcgcccccaacaagtacgagtactgcatctggatcgacggcctgagcgccctgctgggcaaggacatgagcagcgagctgaccaagagcgacctggacaccctgctgagcatggagatgaagctgagactgctggacctggagaacatccagatccccgaggcccccccccccatccccaaggagcccagcagctacgacttcgtgtaccactacggctag

SEQ ID NO: 80406 - DNA, 1359 bp, Artificial Sequence
  Description of Artificial Sequence: Synthetic coding sequence
atgcacgtgatcagaggcaacagacccatcaagaccgagatggcccaccagctgtacgtgctgcaggtgctgaccttcaacctgctggaggagagaatgatgaccaagatggaccccaacgaccaggcccagagagacatcatcttcgagctgagaagaatcgccttcgacgccgagagcgaccccagcaacgcccccggcagcggcaccgagaagagaaaggccatgtacaccaaggactacaagatgctgggcttcaccaaccacatcaaccccgccatggacttcacccagaccccccccggcatgctggccctggacaacatgctgtacctggccaaggtgcaccaggacacctacatcagaatcgtgctggagaacagcagcagagaggacaagcacgagtgccccttcggcagaagcgccatcgagctgaccaagatgctgtgcgagatcctgcaggtgggcgagctgcccaacgagggcagaaacgactaccaccccatgttcttcacccacgacagagccttcgaggagctgttcggcatctgcatccagctgctgaacaagacctggaaggagatgagagccaccgccgaggacttcaacaaggtgatgcaggtggtgagagagcagatcaccagagccctgcccagcaagcccaacagcctggaccagttcaagagcaagctgagaagcctgagctacagcgagatcctgagactgagacagagcgagagaatgagccaggacgacttccagagcccccccatcgtggagctgagagagaagatccagcccgagatcctggagctgatcaagcagcagagactgaacagactgtgcgagggcagcagcttcagaaagatcggcaacagaagaagacaggagagattctggtactgcagactggccctgaaccacaaggtgctgcactacggcgacctggacgacaacccccagggcgaggtgaccttcgagagcctgcaggagaagatccccgtggccgacatcaaggccatcgtgaccggcaaggactgcccccacatgaaggagaagagcgccctgaagcagaacaaggaggtgctggagctggccttcagcatcctgtacgaccccgacgagaccctgaacttcatcgcccccaacaagtacgagtactgcatctggatcgacggcctgagcgccctgctgggcaaggacatgagcagcgagctgaccaagagcgacctggacaccctgctgagcatggagatgaagctgagactgctggacctggagaacatccagatccccgaggcccccccccccatccccaaggagcccagcagctacgacttcgtgtaccactacggctag

SEQ ID NO: 80407 - DNA, 2322 bp, Artificial Sequence
  Description of Artificial Sequence: Synthetic coding sequence
atggccagaagcagcagcctgggcagagagtgcggcacccccagaagcggcctgggcaagggcggcccccccagaccccagggcccccaggccagatgcaccctgggcagaagatgcaccgtgagcggcaagtgcagaagacccagacccagctggaccatggccccccccagaaacgtggtgaagatcgccatcaagatgagagacgccatcccccagctgatccagctggaccaggccaagcccctggccgccgtgctgaaggaggtgtgcgacgcctggagcctgacccacagcgagagatacgccctgcagttcgccgacggccacagaagatacatcaccgagaacaacagagccgagatcaagaacggcagcatcctgtgcctgagcaccgcccccgacctggaggccgagcagctgctgggcggcctgcagagcaacagccccgagggcagaagagaggccctgagaagactggtgcccctggccagcgacatgatcttcgccagagaggtgatcagcagaaacggcctgcagatcctgggcaccatcatcgaggacggcgacgacctgggcgaggtgctggccctgagcctgagagccttcagcgagctgatggagcacggcgtggtgagctgggagaccctgagcatccccttcgtgagaaaggtggtgtgctacgtgaacatgaacctgatggacgccagcgtgccccccctggccctgggcctgctggagagcgtgaccctgagcagccccgccctgggccagctggtgaagagcgaggtgcccctggacagactgctggtgcacctgcaggtgatgaaccagcagctgcagaccaaggccatggccctgctgaccgccctgctgcagggcgccagccccgtggagagaaagcacatgctggactacctgtggcagagaaacctgagacagttcatctacaagaacatcatccacagcgccgcccccatgggcgacgagatggcccaccacctgtacgtgctgcaggccctgatgctgggcctgctggagcccagaatgagaacccccctggacccctacagccaggagcagagagagcagctgcaggtgctgagacaggccgccttcgaggtggagggcgagagcagcggcgccggcctgagcgccgacagaagaagaagcctgtgcgccagagagttcagaaagctgggcttcagcaacagcaaccccgcccaggacctggagagagtgccccccggcctgctggccctggacaacatgctgtacttcagcagaaacgcccccagcgcctacagcagattcgtgctggagaacagcagcagagaggacaagcacgagtgccccttcgccagaggcagcatccagctgaccgtgctgctgtgcgagctgctgagagtgggcgagccctgcagcgagaccgcccaggacttcagccccatgttcttcggccaggaccagagcttccacgagctgttctgcgtgggcatccagctgctgaacaagacctggaaggagatgagagccacccaggaggacttcgacaaggtgatgcaggtggtgagagagcagctggccagaaccctggccctgaagcccaccagcctggagctgttcagaaccaaggtgaacgccctgacctacggcgaggtgctgagactgagacagaccgagagactgcaccaggagggcaccctggccccccccatcctggagctgagagagaagctgaagcccgagctgatgggcctgatcagacagcagagactgctgagactgtgcgagggcaccctgttcagaaagatcagcagcagaagaagacaggacaagctgtggttctgctgcctgagccccaaccacaagctgctgcagtacggcgacatggaggagggcgccagcccccccaccctggagagcctgcccgagcagctgcccgtggccgacatgagagccctgctgaccggcaaggactgcccccacgtgagagagaagggcagcggcaagcagaacaaggacctgtacgagctggccttcagcatcagctacgacagaggcgaggaggaggcctacctgaacttcatcgcccccagcaagagagagttctacctgtggaccgacggcctgagcgccctgctgggcagccccatgggcagcgagcagaccagactggacctggagcagctgctgaccatggagaccaagctgagactgctggagctggagaacgtgcccatccccgagagacccccccccgtgccccccccccccaccaacttcaacttctgctacgactgcagcatcgccgagccctag

SEQ ID NO: 80408 - DNA, 2511 bp, Artificial Sequence
  Description of Artificial Sequence: Synthetic coding sequence
atgagcaagctgagcttcagagccagagccctggacgccagcaagcccctgcccgtgttcagatgcgaggacctgcccgacctgcacgagtacgccagcatcaacagagccgtgccccagatgcccaccggcatggagaaggaggaggagagcgagcaccacctgcagagagccatcagcgcccagcaggtgtacggcgagaagagagacaacatggtgatccccgtgcccgaggccgagagcaacatcgcctactacgagagcatctaccccggcgagttcaagatgcccaagcagctgatccacatccagcccttcagcctggacgccgagcagcccgactacgacctggacagcgaggacgaggtgttcgtgaacaagctgaagaagaagatggacatctgccccctgcagttcgaggagatgatcgacagactggagaagggcagcggccagcagcccgtgagcctgcaggaggccaagctgctgctgaaggaggacgacgagctgatcagagaggtgtacgagtactggatcaagaagagaaagaactgcagaggccccagcctgatccccagcgtgaagcaggagaagagagacggcagcagcaccaacgacccctacgtggccttcagaagaagaaccgagaagatgcagaccagaaagaacagaaagaacgacgaggccagctacgagaagatgctgaagctgagaagagacctgagcagagccgtgaccatcctggagatgatcaagagaagagagaagagcaagagagagctgctgcacctgaccctggagatcatggagaagagatacaacctgggcgactacaacggcgagatcatgagcgaggtgatggcccagagacagcccatgaagcccacctacgccatccccatcatccccatcaccaacagcagccagttcaagcaccaggaggccatggacgtgaaggagttcaaggtgaacaagcaggacaaggccgacctgatcagacccaagagaaagtacgagaagaagcccaaggtgctgcccagcagcgccgccgccaccccccagcagaccagccccgccgccctgcccgtgttcaacgccaaggacctgaaccagtacgacttccccagcagcgacgaggagcccctgagccaggtgctgagcggcagcagcgaggccgaggaggacaacgaccccgacggccccttcgccttcagaagaaaggccggctgccagtactacgccccccacctggaccagaccggcaactggccctggaccagccccaaggacggcggcctgggcgacgtgagatacagatactgcctgaccaccctgaccgtgccccagagatgcatcggcttcgccagaagaagagtgggcagaggcggcagagtgctgctggacagagcccacagcgactacgacagcgtgttccaccacctggacctggagatgctgagcagcccccagcacagccccgtgaaccagttcgccaacaccagcgagaccaacaccagcgacaagagcttcagcaaggacctgagccagatcctggtgaacatcaagagctgcagatggagacacttcagacccagaacccccagcctgcacgacagcgacaacgacgagctgagctgcagaaagctgtacagaagcatcaacagaaccggcaccgcccagcccggcacccagacctgcagcaccagcacccagagcaagagcagcagcggcagcgcccacttcgccttcaccgccgagcagtaccagcagcaccagcagcagctggccctgatgcagaagcagcagctggcccagatccagcagcagcaggccaacagcaacagcagcaccaacaccagccagaacctggccagcaaccagcagaagagcggcttcagactgaacatccagggcctggagagaaccctgcagggcttcgtgagcaagaccctggacagcgccagcgcccagttcgccgccagcgccctggtgaccagcgagcagctgatgggcttcaagatgaaggacgacgtggtgctgggcatcggcgtgaacggcgtgctgcccgccagcggcgtgtacaagggcctgcacctgagcagcaccacccccaccgccctggtgcacaccagccccagcaccgccggcagcgccctgctgcagcccagcaacatcacccagaccagcagcagccacagcgccctgagccaccaggtgaccgccgccaacagcgccaccacccaggtgctgatcggcaacaacatcagactgaccgtgcccagcagcgtggccaccgtgaacagcatcgcccccatcaacgccagacacatccccagaaccctgagcgccgtgcccagcagcgccctgaagctggccgccgccgccaactgccaggtgagcaaggtgcccagcagcagcagcgtggacagcgtgcccagagagaaccacgagagcgagaagcccgccctgaacaacatcgccgacaacaccgtggccatggaggtgacctag

SEQ ID NO: 80409 - DNA, 2442 bp, Artificial Sequence
  Description of Artificial Sequence: Synthetic coding sequence
atgagcaagctgagcttcagagccagagccctggacgccagcaagcccctgcccgtgttcagatgcgaggacctgcccgacctgcacgagtacgccagcatcaacagagccgtgccccagatgcccaccggcatggagaaggaggaggagagcgagcaccacctgcagagagccatcagcgcccagcaggtgtacggcgagaagagagacaacatggtgatccccgtgcccgaggccgagagcaacatcgcctactacgagagcatctaccccggcgagttcaagatgcccaagcagctgatccacatccagcccttcagcctggacgccgagcagcccgactacgacctggacagcgaggacgaggtgttcgtgaacaagctgaagaagaagatggacatctgccccctgcagttcgaggagatgatcgacagactggagaagggcagcggccagcagcccgtgagcctgcaggaggccaagctgctgctgaaggaggacgacgagctgatcagagaggtgtacgagtactggatcaagaagagaaagaactgcagaggccccagcctgatccccagcgtgaagcaggagaagagagacggcagcagcaccaacgacccctacgtggccttcagaagaagaaccgagaagatgcagaccagaaagaacagaaagaacgacgaggccagctacgagaagatgctgaagctgagaagagacctgagcagagccgtgaccatcctggagatgatcaagagaagagagaagagcaagagagagctgctgcacctgaccctggagatcatggagaagagatacaacctgggcgactacaacggcgagatcatgagcgaggtgatggcccagagacagcccatgaagcccacctacgccatccccatcatccccatcaccaacagcagccagttcaagcaccaggaggccatggacgtgaaggagttcaaggtgaacaagcaggacaaggccgacctgatcagacccaagagaaagtacgagaagaagcccaaggtgctgcccagcagcgccgccgccaccccccagcagaccagccccgccgccctgcccgtgttcaacgccaaggacctgaaccagtacgacttccccagcagcgacgaggagcccctgagccaggtgctgagcggcagcagcgaggccgaggaggacaacgaccccgacggccccttcgccttcagaagaaaggccggctgccagtactacgccccccacctggaccagaccggcaactggccctggaccagccccaaggacggcggcctgggcgacgtgagatacagatactgcctgaccaccctgaccgtgccccagagatgcatcggcttcgccagaagaagagtgggcagaggcggcagagtgctgctggacagagcccacagcgactacgacagcgtgttccaccacctggacctggagatgctgagcagcccccagcacagccccgtgaaccagttcgccaacaccagcgagaccaacaccagcgacaagagcttcagcaaggacctgagccagatcctggtgaacatcaagagctgcagatggagacacttcagacccagaacccccagcctgcacgacagcgacaacgacgagctgagctgcagaaagctgtacagaagcatcaacagaaccggcaccgcccagcccggcacccagacctgcagcaccagcacccagagcaagagcagcagcggcagcgcccacttcgccttcaccgccgagcagtaccagcagcaccagcagcagctggccctgatgcagaagcagcagctggcccagatccagcagcagcaggccaacagcaacagcagcaccaacaccagccagggcttcgtgagcaagaccctggacagcgccagcgcccagttcgccgccagcgccctggtgaccagcgagcagctgatgggcttcaagatgaaggacgacgtggtgctgggcatcggcgtgaacggcgtgctgcccgccagcggcgtgtacaagggcctgcacctgagcagcaccacccccaccgccctggtgcacaccagccccagcaccgccggcagcgccctgctgcagcccagcaacatcacccagaccagcagcagccacagcgccctgagccaccaggtgaccgccgccaacagcgccaccacccaggtgctgatcggcaacaacatcagactgaccgtgcccagcagcgtggccaccgtgaacagcatcgcccccatcaacgccagacacatccccagaaccctgagcgccgtgcccagcagcgccctgaagctggccgccgccgccaactgccaggtgagcaaggtgcccagcagcagcagcgtggacagcgtgcccagagagaaccacgagagcgagaagcccgccctgaacaacatcgccgacaacaccgtggccatggaggtgacctag

SEQ ID NO: 80410 - DNA, 2292 bp, Artificial Sequence
  Description of Artificial Sequence: Synthetic coding sequence
atggagcaccacctgcagagagccatcagcgcccagcaggtgtacggcgagaagagagacaacatggtgatccccgtgcccgaggccgagagcaacatcgcctactacgagagcatctaccccggcgagttcaagatgcccaagcagctgatccacatccagcccttcagcctggacgccgagcagcccgactacgacctggacagcgaggacgaggtgttcgtgaacaagctgaagaagaagatggacatctgccccctgcagttcgaggagatgatcgacagactggagaagggcagcggccagcagcccgtgagcctgcaggaggccaagctgctgctgaaggaggacgacgagctgatcagagaggtgtacgagtactggatcaagaagagaaagaactgcagaggccccagcctgatccccagcgtgaagcaggagaagagagacggcagcagcaccaacgacccctacgtggccttcagaagaagaaccgagaagatgcagaccagaaagaacagaaagaacgacgaggccagctacgagaagatgctgaagctgagaagagacctgagcagagccgtgaccatcctggagatgatcaagagaagagagaagagcaagagagagctgctgcacctgaccctggagatcatggagaagagatacaacctgggcgactacaacggcgagatcatgagcgaggtgatggcccagagacagcccatgaagcccacctacgccatccccatcatccccatcaccaacagcagccagttcaagcaccaggaggccatggacgtgaaggagttcaaggtgaacaagcaggacaaggccgacctgatcagacccaagagaaagtacgagaagaagcccaaggtgctgcccagcagcgccgccgccaccccccagcagaccagccccgccgccctgcccgtgttcaacgccaaggacctgaaccagtacgacttccccagcagcgacgaggagcccctgagccaggtgctgagcggcagcagcgaggccgaggaggacaacgaccccgacggccccttcgccttcagaagaaaggccggctgccagtactacgccccccacctggaccagaccggcaactggccctggaccagccccaaggacggcggcctgggcgacgtgagatacagatactgcctgaccaccctgaccgtgccccagagatgcatcggcttcgccagaagaagagtgggcagaggcggcagagtgctgctggacagagcccacagcgactacgacagcgtgttccaccacctggacctggagatgctgagcagcccccagcacagccccgtgaaccagttcgccaacaccagcgagaccaacaccagcgacaagagcttcagcaaggacctgagccagatcctggtgaacatcaagagctgcagatggagacacttcagacccagaacccccagcctgcacgacagcgacaacgacgagctgagctgcagaaagctgtacagaagcatcaacagaaccggcaccgcccagcccggcacccagacctgcagcaccagcacccagagcaagagcagcagcggcagcgcccacttcgccttcaccgccgagcagtaccagcagcaccagcagcagctggccctgatgcagaagcagcagctggcccagatccagcagcagcaggccaacagcaacagcagcaccaacaccagccagggcttcgtgagcaagaccctggacagcgccagcgcccagttcgccgccagcgccctggtgaccagcgagcagctgatgggcttcaagatgaaggacgacgtggtgctgggcatcggcgtgaacggcgtgctgcccgccagcggcgtgtacaagggcctgcacctgagcagcaccacccccaccgccctggtgcacaccagccccagcaccgccggcagcgccctgctgcagcccagcaacatcacccagaccagcagcagccacagcgccctgagccaccaggtgaccgccgccaacagcgccaccacccaggtgctgatcggcaacaacatcagactgaccgtgcccagcagcgtggccaccgtgaacagcatcgcccccatcaacgccagacacatccccagaaccctgagcgccgtgcccagcagcgccctgaagctggccgccgccgccaactgccaggtgagcaaggtgcccagcagcagcagcgtggacagcgtgcccagagagaaccacgagagcgagaagcccgccctgaacaacatcgccgacaacaccgtggccatggaggtgacctag

SEQ ID NO: 80411 - DNA, 2424 bp, Artificial Sequence
  Description of Artificial Sequence: Synthetic coding sequence
atgagcaagctgagcttcagagccagagccctggacgccgccaagcccctgcccatctacagaggcaaggacatgcccgacctgaacgactgcgtgagcatcaacagagccgtgccccagatgcccaccggcatggagaaggaggaggagagcgagcaccacctgcagagagccatcagcgcccagcaggtgttcagagagaagaaggagagcatggtgatccccgtgcccgaggccgagagcaacgtgaactactacaacagactgtacaagggcgagttcaagcagcccaagcagttcatccacatccagcccttcaacctggacaacgagcagcccgactacgacatggacagcgaggacgagaccctgctgaacagactgaacagaaagatggagatcaagcccctgcagttcgagatcatgatcgacagactggagaaggccagcagcaaccagctggtgaccctgcaggaggccaagctgctgctgaacgaggacgactacctgatcaaggccgtgtacgactactgggtgagaaagagaaagaactgcagaggccccagcctgatcccccagatcaagcaggagaagagagacggcagcaccaacaacgacccctacgtggccttcagaagaagaaccgagaagatgcagaccagaaagaacagaaagaacgacgaggccagctacgagaagatgctgaagctgagaagagagttcagcagagccatcaccatcctggagatgatcaagagaagagagaagaccaagagagagctgctgcacctgaccctggaggtggtggagaagagataccacctgggcgactacggcggcgagatcctgaacgaggtgaagatcagcagaagcgagaaggagctgtacgccacccccgccaccctgcacaacggcaaccaccacaaggtgcaggagtgcaagaccaagcacccccaccacctgagcctgaaggaggaggccagcgacgtggtgagacagaagaagaagtaccccaagaagcccaaggccgaggccctgatcaccagccagcagcccacccccgagaccctgcccgtgatcaacaagagcgacatcaagcagtacgacttccacagcagcgacgaggacgagttcccccaggtgctgagccccgtgagcgagcccgaggaggagaacgaccccgacggcccctgcgccttcagaagaagagccggctgccagtactacgcccccagactggaccaggccaaccacagctgcgagaacagcgagctggccgacctggacaagctgagatacagacactgcctgaccaccctgaccgtgcccagaagatgcatcggcttcgccagaagaagaatcggcagaggcggcagagtgatcatggacagaatcagcaccgagcacgaccccgtgctgaagcagatcgaccccgagatgctgaacagcttcagcagcagcagccagaccatcgacttcagcagcaacttcagcagaaccaacgccagcagcaagcactgcgagaacagactgagcctgagcgagatcctgagcaacatcagaagctgcagactgcagtgcttccagcccagactgctgaacctgcaggacagcgacagcgaggagtgcaccagcagaaagcccggccagaccgtgaacaacaagagagtgagcgccgccagcgtggccctgctgaacaccagcaagaacggcatcagcgtgaccggcggcatcaccgaggagcagttccagacccaccagcagcagctggtgcagatgcagagacagcagctggcccagctgcagcagaagcagcagagccagcacagcagccagcagacccaccccaaggcccagggcagcagcaccagcgactgcatgagcaagaccctggacagcgccagcgcccacttcgccgccagcgccgtggtgagcgcccccgtgcccagcagaagcgaggtggccaaggagcagaacaccggccacaacaacatcaacggcgtggtgcagcccagcggcaccagcaagaccctgtacagcaccaacatggccctgagcagcagccccggcatcagcgccgtgcagctggtgagaaccgtgggccacaccaccaccaaccacctgatccccgccctgtgcaccagcagcccccagaccctgcccatgaacaacagctgcctgaccaacgccgtgcacctgaacaacgtgagcgtggtgagccccgtgaacgtgcacatcaacaccagaaccagcgcccccagccccaccgccctgaagctggccaccgtggccgccagcatggacagagtgcccaaggtgacccccagcagcgccatcagcagcatcgccagagagaaccacgagcccgagagactgggcctgaacggcatcgccgagaccaccgtggccatggaggtgacctag

SEQ ID NO: 80412 - DNA, 315 bp, Artificial Sequence
  Description of Artificial Sequence: Synthetic coding sequence
atgagccacaccatcctgctggtgcagcccaccaagagacccgagggcagaacctacgccgactacgagagcgtgaacgagtgcatggagggcgtgtgcaagatgtacgaggagcacctgaagagaatgaaccccaacagccccagcatcacctacgacatcagccagctgttcgacttcatcgacgacctggccgacctgagctgcctggtgtacagagccgacacccagacctaccagccctacaacaaggactggatcaaggagaagatctacgtgctgctgagaagacaggcccagcaggccggcaagtag

SEQ ID NO: 80413 - DNA, 2253 bp, Artificial Sequence
  Description of Artificial Sequence: Synthetic coding sequence
tacagcaagatggagatccccaacccccccaccagcaagtgcatcacctactggaagagaaaggtgaagagcgagtacatgagactgagacagctgaagagactgcaggccaacatgggcgccaaggccctgtacgtggccaacttcgccaaggtgcaggagaagacccagatcctgaacgaggagtggaagaagctgagagtgcagcccgtgcagagcatgaagcccgtgagcggccaccccttcctgaagaagtgcaccatcgagagcatcttccccggcttcgccagccagcacatgctgatgagaagcctgaacaccgtggccctggtgcccatcatgtacagctggagccccctgcagcagaacttcatggtggaggacgagaccgtgctgtgcaacatcccctacatgggcgacgaggtgaaggaggaggacgagaccttcatcgaggagctgatcaacaactacgacggcaaggtgcacggcgaggaggagatgatccccggcagcgtgctgatcagcgacgccgtgttcctggagctggtggacgccctgaaccagtacagcgacgaggaggaggagggccacaacgacaccagcgacggcaagcaggacgacagcaaggaggacctgcccgtgaccagaaagagaaagagacacgccatcgagggcaacaagaagagcagcaagaagcagttccccaacgacatgatcttcagcgccatcgccagcatgttccccgagaacggcgtgcccgacgacatgaaggagagatacagagagctgaccgagatgagcgaccccaacgccctgcccccccagtgcacccccaacatcgacggccccaacgccaagagcgtgcagagagagcagagcctgcacagcttccacaccctgttctgcagaagatgcttcaagtacgactgcttcctgcaccccttccacgccacccccaacgtgtacaagagaaagaacaaggagatcaagatcgagcccgagccctgcggcaccgactgcttcctgctgctggagggcgccaaggagtacgccatgctgcacaaccccagaagcaagtgcagcggcagaagaagaagaagacaccacatcgtgagcgccagctgcagcaacgccagcgccagcgccgtggccgagaccaaggagggcgacagcgacagagacaccggcaacgactgggccagcagcagcagcgaggccaacagcagatgccagacccccaccaagcagaaggccagccccgcccccccccagctgtgcgtggtggaggcccccagcgagcccgtggagtggaccggcgccgaggagagcctgttcagagtgttccacggcacctacttcaacaacttctgcagcatcgccagactgctgggcaccaagacctgcaagcaggtgttccagttcgccgtgaaggagagcctgatcctgaagctgcccaccgacgagctgatgaaccccagccagaagaagaagagaaagcacagactgtgggccgcccactgcagaaagatccagctgaagaaggacaacagcagcacccaggtgtacaactaccagccctgcgaccaccccgacagaccctgcgacagcacctgcccctgcatcatgacccagaacttctgcgagaagttctgccagtgcaaccccgactgccagaacagattccccggctgcagatgcaagacccagtgcaacaccaagcagtgcccctgctacctggccgtgagagagtgcgaccccgacctgtgcctgacctgcggcgccagcgagcactgggactgcaaggtggtgagctgcaagaactgcagcatccagagaggcctgaagaagcacctgctgctggcccccagcgacgtggccggctggggcaccttcatcaaggagagcgtgcagaagaacgagttcatcagcgagtactgcggcgagctgatcagccaggacgaggccgacagaagaggcaaggtgtacgacaagtacatgagcagcttcctgttcaacctgaacaacgacttcgtggtggacgccaccagaaagggcaacaagatcagattcgccaaccacagcgtgaaccccaactgctacgccaaggtggtgatggtgaacggcgaccacagaatcggcatcttcgccaagagagccatccaggccggcgaggagctgttcttcgactacagatacagccaggccgacgccctgaagtacgtgggcatcgagagagagaccgacgtgctgtag

SEQ ID NO: 80414 - DNA, 2124 bp, Artificial Sequence
  Description of Artificial Sequence: Synthetic coding sequence
atggagatccccaacccccccaccagcaagtgcatcacctactggaagagaaaggtgaagagcgagtacatgagactgagacagctgaagagactgcaggccaacatgggcgccaaggccctgtacgtggccaacttcgccaaggtgcaggagaagacccagatcctgaacgaggagtggaagaagctgagagtgcagcccgtgcagagcatgaagcccgtgagcggccaccccttcctgaagaaggtggaggacgagaccgtgctgtgcaacatcccctacatgggcgacgaggtgaaggaggaggacgagaccttcatcgaggagctgatcaacaactacgacggcaaggtgcacggcgaggaggagatgatccccggcagcgtgctgatcagcgacgccgtgttcctggagctggtggacgccctgaaccagtacagcgacgaggaggaggagggccacaacgacaccagcgacggcaagcaggacgacagcaaggaggacctgcccgtgaccagaaagagaaagagacacgccatcgagggcaacaagaagagcagcaagaagcagttccccaacgacatgatcttcagcgccatcgccagcatgttccccgagaacggcgtgcccgacgacatgaaggagagatacagagagctgaccgagatgagcgaccccaacgccctgcccccccagtgcacccccaacatcgacggccccaacgccaagagcgtgcagagagagcagagcctgcacagcttccacaccctgttctgcagaagatgcttcaagtacgactgcttcctgcaccccttccacgccacccccaacgtgtacaagagaaagaacaaggagatcaagatcgagcccgagccctgcggcaccgactgcttcctgctgctggagggcgccaaggagtacgccatgctgcacaaccccagaagcaagtgcagcggcagaagaagaagaagacaccacatcgtgagcgccagctgcagcaacgccagcgccagcgccgtggccgagaccaaggagggcgacagcgacagagacaccggcaacgactgggccagcagcagcagcgaggccaacagcagatgccagacccccaccaagcagaaggccagccccgcccccccccagctgtgcgtggtggaggcccccagcgagcccgtggagtggaccggcgccgaggagagcctgttcagagtgttccacggcacctacttcaacaacttctgcagcatcgccagactgctgggcaccaagacctgcaagcaggtgttccagttcgccgtgaaggagagcctgatcctgaagctgcccaccgacgagctgatgaaccccagccagaagaagaagagaaagcacagactgtgggccgcccactgcagaaagatccagctgaagaaggacaacagcagcacccaggtgtacaactaccagccctgcgaccaccccgacagaccctgcgacagcacctgcccctgcatcatgacccagaacttctgcgagaagttctgccagtgcaaccccgactgccagaacagattccccggctgcagatgcaagacccagtgcaacaccaagcagtgcccctgctacctggccgtgagagagtgcgaccccgacctgtgcctgacctgcggcgccagcgagcactgggactgcaaggtggtgagctgcaagaactgcagcatccagagaggcctgaagaagcacctgctgctggcccccagcgacgtggccggctggggcaccttcatcaaggagagcgtgcagaagaacgagttcatcagcgagtactgcggcgagctgatcagccaggacgaggccgacagaagaggcaaggtgtacgacaagtacatgagcagcttcctgttcaacctgaacaacgacttcgtggtggacgccaccagaaagggcaacaagatcagattcgccaaccacagcgtgaaccccaactgctacgccaaggtggtgatggtgaacggcgaccacagaatcggcatcttcgccaagagagccatccaggccggcgaggagctgttcttcgactacagatacagccaggccgacgccctgaagtacgtgggcatcgagagagagaccgacgtgctgtag

SEQ ID NO: 80415 - DNA, 2244 bp, Artificial Sequence
  Description of Artificial Sequence: Synthetic coding sequence
atggagatccccaacccccccaccagcaagtgcatcacctactggaagagaaaggtgaagagcgagtacatgagactgagacagctgaagagactgcaggccaacatgggcgccaaggccctgtacgtggccaacttcgccaaggtgcaggagaagacccagatcctgaacgaggagtggaagaagctgagagtgcagcccgtgcagagcatgaagcccgtgagcggccaccccttcctgaagaagtgcaccatcgagagcatcttccccggcttcgccagccagcacatgctgatgagaagcctgaacaccgtggccctggtgcccatcatgtacagctggagccccctgcagcagaacttcatggtggaggacgagaccgtgctgtgcaacatcccctacatgggcgacgaggtgaaggaggaggacgagaccttcatcgaggagctgatcaacaactacgacggcaaggtgcacggcgaggaggagatgatccccggcagcgtgctgatcagcgacgccgtgttcctggagctggtggacgccctgaaccagtacagcgacgaggaggaggagggccacaacgacaccagcgacggcaagcaggacgacagcaaggaggacctgcccgtgaccagaaagagaaagagacacgccatcgagggcaacaagaagagcagcaagaagcagttccccaacgacatgatcttcagcgccatcgccagcatgttccccgagaacggcgtgcccgacgacatgaaggagagatacagagagctgaccgagatgagcgaccccaacgccctgcccccccagtgcacccccaacatcgacggccccaacgccaagagcgtgcagagagagcagagcctgcacagcttccacaccctgttctgcagaagatgcttcaagtacgactgcttcctgcaccccttccacgccacccccaacgtgtacaagagaaagaacaaggagatcaagatcgagcccgagccctgcggcaccgactgcttcctgctgctggagggcgccaaggagtacgccatgctgcacaaccccagaagcaagtgcagcggcagaagaagaagaagacaccacatcgtgagcgccagctgcagcaacgccagcgccagcgccgtggccgagaccaaggagggcgacagcgacagagacaccggcaacgactgggccagcagcagcagcgaggccaacagcagatgccagacccccaccaagcagaaggccagccccgcccccccccagctgtgcgtggtggaggcccccagcgagcccgtggagtggaccggcgccgaggagagcctgttcagagtgttccacggcacctacttcaacaacttctgcagcatcgccagactgctgggcaccaagacctgcaagcaggtgttccagttcgccgtgaaggagagcctgatcctgaagctgcccaccgacgagctgatgaaccccagccagaagaagaagagaaagcacagactgtgggccgcccactgcagaaagatccagctgaagaaggacaacagcagcacccaggtgtacaactaccagccctgcgaccaccccgacagaccctgcgacagcacctgcccctgcatcatgacccagaacttctgcgagaagttctgccagtgcaaccccgactgccagaacagattccccggctgcagatgcaagacccagtgcaacaccaagcagtgcccctgctacctggccgtgagagagtgcgaccccgacctgtgcctgacctgcggcgccagcgagcactgggactgcaaggtggtgagctgcaagaactgcagcatccagagaggcctgaagaagcacctgctgctggcccccagcgacgtggccggctggggcaccttcatcaaggagagcgtgcagaagaacgagttcatcagcgagtactgcggcgagctgatcagccaggacgaggccgacagaagaggcaaggtgtacgacaagtacatgagcagcttcctgttcaacctgaacaacgacttcgtggtggacgccaccagaaagggcaacaagatcagattcgccaaccacagcgtgaaccccaactgctacgccaaggtggtgatggtgaacggcgaccacagaatcggcatcttcgccaagagagccatccaggccggcgaggagctgttcttcgactacagatacagccaggccgacgccctgaagtacgtgggcatcgagagagagaccgacgtgctgtag

SEQ ID NO: 80416 - DNA, 1827 bp, Artificial Sequence
  Description of Artificial Sequence: Synthetic coding sequence
atggaggaggccagctgccccacctgcagcgtgaacgaggcctgcgagtggacccccttcagccagaaggagatgatccccggcagcgtgctgatcagcgacgccgtgttcctggagctggtggacgccctgaaccagtacagcgacgaggaggaggagggccacaacgacaccagcgacggcaagcaggacgacagcaaggaggacctgcccgtgaccagaaagagaaagagacacgccatcgagggcaacaagaagagcagcaagaagcagttccccaacgacatgatcttcagcgccatcgccagcatgttccccgagaacggcgtgcccgacgacatgaaggagagatacagagagctgaccgagatgagcgaccccaacgccctgcccccccagtgcacccccaacatcgacggccccaacgccaagagcgtgcagagagagcagagcctgcacagcttccacaccctgttctgcagaagatgcttcaagtacgactgcttcctgcaccccttccacgccacccccaacgtgtacaagagaaagaacaaggagatcaagatcgagcccgagccctgcggcaccgactgcttcctgctgctggagggcgccaaggagtacgccatgctgcacaaccccagaagcaagtgcagcggcagaagaagaagaagacaccacatcgtgagcgccagctgcagcaacgccagcgccagcgccgtggccgagaccaaggagggcgacagcgacagagacaccggcaacgactgggccagcagcagcagcgaggccaacagcagatgccagacccccaccaagcagaaggccagccccgcccccccccagctgtgcgtggtggaggcccccagcgagcccgtggagtggaccggcgccgaggagagcctgttcagagtgttccacggcacctacttcaacaacttctgcagcatcgccagactgctgggcaccaagacctgcaagcaggtgttccagttcgccgtgaaggagagcctgatcctgaagctgcccaccgacgagctgatgaaccccagccagaagaagaagagaaagcacagactgtgggccgcccactgcagaaagatccagctgaagaaggacaacagcagcacccaggtgtacaactaccagccctgcgaccaccccgacagaccctgcgacagcacctgcccctgcatcatgacccagaacttctgcgagaagttctgccagtgcaaccccgactgccagaacagattccccggctgcagatgcaagacccagtgcaacaccaagcagtgcccctgctacctggccgtgagagagtgcgaccccgacctgtgcctgacctgcggcgccagcgagcactgggactgcaaggtggtgagctgcaagaactgcagcatccagagaggcctgaagaagcacctgctgctggcccccagcgacgtggccggctggggcaccttcatcaaggagagcgtgcagaagaacgagttcatcagcgagtactgcggcgagctgatcagccaggacgaggccgacagaagaggcaaggtgtacgacaagtacatgagcagcttcctgttcaacctgaacaacgacttcgtggtggacgccaccagaaagggcaacaagatcagattcgccaaccacagcgtgaaccccaactgctacgccaaggtggtgatggtgaacggcgaccacagaatcggcatcttcgccaagagagccatccaggccggcgaggagctgttcttcgactacagatacagccaggccgacgccctgaagtacgtgggcatcgagagagagaccgacgtgctgtag

SEQ ID NO: 80417 - DNA, 2256 bp, Artificial Sequence
  Description of Artificial Sequence: Synthetic coding sequence
atgggccagaccggcaagaagagcgagaagggccccgtgtgctggagaaagagagtgaagagcgagtacatgagactgagacagctgaagagattcagaagagccgacgaggtgaagagcatgttcagcagcaacagacagaagatcctggagagaaccgagatcctgaaccaggagtggaagcagagaagaatccagcccgtgcacatcctgaccagcgtgagcagcctgagaggcaccagagagtgcagcgtgaccagcgacctggacttccccacccaggtgatccccctgaagaccctgaacgccgtggccagcgtgcccatcatgtacagctggagccccctgcagcagaacttcatggtggaggacgagaccgtgctgcacaacatcccctacatgggcgacgaggtgctggaccaggacggcaccttcatcgaggagctgatcaagaactacgacggcaaggtgcacggcgacagagagtgcggcttcatcaacgacgagatcttcgtggagctggtgaacgccctgggccagtacaacgacgacgacgacgacgacgacggcgacgaccccgaggagagagaggagaagcagaaggacctggaggaccacagagacgacaaggagagcagaccccccagaaagttccccagcgacaagatcttcgaggccatcagcagcatgttccccgacaagggcaccgccgaggagctgaaggagaagtacaaggagctgaccgagcagcagctgcccggcgccctgccccccgagtgcacccccaacatcgacggccccaacgccaagagcgtgcagagagagcagagcctgcacagcttccacaccctgttctgcagaagatgcttcaagtacgactgcttcctgcacagaaagtgcaactacagcttccacgccacccccaacacctacaagagaaagaacaccgagaccgccctggacaacaagccctgcggcccccagtgctaccagcacctggagggcgccaaggagttcgccgccgccctgaccgccgagagaatcaagaccccccccaagagacccggcggcagaagaagaggcagactgcccaacaacagcagcagacccagcacccccaccatcaacgtgctggagagcaaggacaccgacagcgacagagaggccggcaccgagaccggcggcgagaacaacgacaaggaggaggaggagaagaaggacgagaccagcagcagcagcgaggccaacagcagatgccagacccccatcaagatgaagcccaacatcgagccccccgagaacgtggagtggagcggcgccgaggccagcatgttcagagtgctgatcggcacctactacgacaacttctgcgccatcgccagactgatcggcaccaagacctgcagacaggtgtacgagttcagagtgaaggagagcagcatcatcgcccccgcccccgccgaggacgtggacaccccccccagaaagaagaagagaaagcacagactgtgggccgcccactgcagaaagatccagctgaagaaggacggcagcagcaaccacgtgtacaactaccagccctgcgaccaccccagacagccctgcgacagcagctgcccctgcgtgatcgcccagaacttctgcgagaagttctgccagtgcagcagcgagtgccagaacagattccccggctgcagatgcaaggcccagtgcaacaccaagcagtgcccctgctacctggccgtgagagagtgcgaccccgacctgtgcctgacctgcggcgccgccgaccactgggacagcaagaacgtgagctgcaagaactgcagcatccagagaggcagcaagaagcacctgctgctggcccccagcgacgtggccggctggggcatcttcatcaaggaccccgtgcagaagaacgagttcatcagcgagtactgcggcgagatcatcagccaggacgaggccgacagaagaggcaaggtgtacgacaagtacatgtgcagcttcctgttcaacctgaacaacgacttcgtggtggacgccaccagaaagggcaacaagatcagattcgccaaccacagcgtgaaccccaactgctacgccaaggtgatgatggtgaacggcgaccacagaatcggcatcttcgccaagagagccatccagaccggcgaggagctgttcttcgactacagatacagccaggccgacgccctgaagtacgtgggcatcgagagagagatggagatcccctag

SEQ ID NO: 80418 - DNA, 2124 bp, Artificial Sequence
  Description of Artificial Sequence: Synthetic coding sequence
atgggccagaccggcaagaagagcgagaagggccccgtgtgctggagaaagagagtgaagagcgagtacatgagactgagacagctgaagagattcagaagagccgacgaggtgaagagcatgttcagcagcaacagacagaagatcctggagagaaccgagatcctgaaccaggagtggaagcagagaagaatccagcccgtgcacatcctgaccagcgtgagcagcctgagaggcaccagagaggtggaggacgagaccgtgctgcacaacatcccctacatgggcgacgaggtgctggaccaggacggcaccttcatcgaggagctgatcaagaactacgacggcaaggtgcacggcgacagagagtgcggcttcatcaacgacgagatcttcgtggagctggtgaacgccctgggccagtacaacgacgacgacgacgacgacgacggcgacgaccccgaggagagagaggagaagcagaaggacctggaggaccacagagacgacaaggagagcagaccccccagaaagttccccagcgacaagatcttcgaggccatcagcagcatgttccccgacaagggcaccgccgaggagctgaaggagaagtacaaggagctgaccgagcagcagctgcccggcgccctgccccccgagtgcacccccaacatcgacggccccaacgccaagagcgtgcagagagagcagagcctgcacagcttccacaccctgttctgcagaagatgcttcaagtacgactgcttcctgcaccccttccacgccacccccaacacctacaagagaaagaacaccgagaccgccctggacaacaagccctgcggcccccagtgctaccagcacctggagggcgccaaggagttcgccgccgccctgaccgccgagagaatcaagaccccccccaagagacccggcggcagaagaagaggcagactgcccaacaacagcagcagacccagcacccccaccatcaacgtgctggagagcaaggacaccgacagcgacagagaggccggcaccgagaccggcggcgagaacaacgacaaggaggaggaggagaagaaggacgagaccagcagcagcagcgaggccaacagcagatgccagacccccatcaagatgaagcccaacatcgagccccccgagaacgtggagtggagcggcgccgaggccagcatgttcagagtgctgatcggcacctactacgacaacttctgcgccatcgccagactgatcggcaccaagacctgcagacaggtgtacgagttcagagtgaaggagagcagcatcatcgcccccgcccccgccgaggacgtggacaccccccccagaaagaagaagagaaagcacagactgtgggccgcccactgcagaaagatccagctgaagaaggacggcagcagcaaccacgtgtacaactaccagccctgcgaccaccccagacagccctgcgacagcagctgcccctgcgtgatcgcccagaacttctgcgagaagttctgccagtgcagcagcgagtgccagaacagattccccggctgcagatgcaaggcccagtgcaacaccaagcagtgcccctgctacctggccgtgagagagtgcgaccccgacctgtgcctgacctgcggcgccgccgaccactgggacagcaagaacgtgagctgcaagaactgcagcatccagagaggcagcaagaagcacctgctgctggcccccagcgacgtggccggctggggcatcttcatcaaggaccccgtgcagaagaacgagttcatcagcgagtactgcggcgagatcatcagccaggacgaggccgacagaagaggcaaggtgtacgacaagtacatgtgcagcttcctgttcaacctgaacaacgacttcgtggtggacgccaccagaaagggcaacaagatcagattcgccaaccacagcgtgaaccccaactgctacgccaaggtgatgatggtgaacggcgaccacagaatcggcatcttcgccaagagagccatccagaccggcgaggagctgttcttcgactacagatacagccaggccgacgccctgaagtacgtgggcatcgagagagagatggagatcccctag

SEQ ID NO: 80419 - DNA, 2241 bp, Artificial Sequence
  Description of Artificial Sequence: Synthetic coding sequence
atgggccagaccggcaagaagagcgagaagggccccgtgtgctggagaaagagagtgaagagcgagtacatgagactgagacagctgaagagattcagaagagccgacgaggtgaagagcatgttcagcagcaacagacagaagatcctggagagaaccgagatcctgaaccaggagtggaagcagagaagaatccagcccgtgcacatcctgaccagcgtgagcagcctgagaggcaccagagagtgcagcgtgaccagcgacctggacttccccacccaggtgatccccctgaagaccctgaacgccgtggccagcgtgcccatcatgtacagctggagccccctgcagcagaacttcatggtggaggacgagaccgtgctgcacaacatcccctacatgggcgacgaggtgctggaccaggacggcaccttcatcgaggagctgatcaagaactacgacggcaaggtgcacggcgacagagagtgcggcttcatcaacgacgagatcttcgtggagctggtgaacgccctgggccagtacaacgacgacgacgacgacgacgacggcgacgaccccgaggagagagaggagaagcagaaggacctggaggaccacagagacgacaaggagagcagaccccccagaaagttccccagcgacaagatcttcgaggccatcagcagcatgttccccgacaagggcaccgccgaggagctgaaggagaagtacaaggagctgaccgagcagcagctgcccggcgccctgccccccgagtgcacccccaacatcgacggccccaacgccaagagcgtgcagagagagcagagcctgcacagcttccacaccctgttctgcagaagatgcttcaagtacgactgcttcctgcaccccttccacgccacccccaacacctacaagagaaagaacaccgagaccgccctggacaacaagccctgcggcccccagtgctaccagcacctggagggcgccaaggagttcgccgccgccctgaccgccgagagaatcaagaccccccccaagagacccggcggcagaagaagaggcagactgcccaacaacagcagcagacccagcacccccaccatcaacgtgctggagagcaaggacaccgacagcgacagagaggccggcaccgagaccggcggcgagaacaacgacaaggaggaggaggagaagaaggacgagaccagcagcagcagcgaggccaacagcagatgccagacccccatcaagatgaagcccaacatcgagccccccgagaacgtggagtggagcggcgccgaggccagcatgttcagagtgctgatcggcacctactacgacaacttctgcgccatcgccagactgatcggcaccaagacctgcagacaggtgtacgagttcagagtgaaggagagcagcatcatcgcccccgcccccgccgaggacgtggacaccccccccagaaagaagaagagaaagcacagactgtgggccgcccactgcagaaagatccagctgaagaaggacggcagcagcaaccacgtgtacaactaccagccctgcgaccaccccagacagccctgcgacagcagctgcccctgcgtgatcgcccagaacttctgcgagaagttctgccagtgcagcagcgagtgccagaacagattccccggctgcagatgcaaggcccagtgcaacaccaagcagtgcccctgctacctggccgtgagagagtgcgaccccgacctgtgcctgacctgcggcgccgccgaccactgggacagcaagaacgtgagctgcaagaactgcagcatccagagaggcagcaagaagcacctgctgctggcccccagcgacgtggccggctggggcatcttcatcaaggaccccgtgcagaagaacgagttcatcagcgagtactgcggcgagatcatcagccaggacgaggccgacagaagaggcaaggtgtacgacaagtacatgtgcagcttcctgttcaacctgaacaacgacttcgtggtggacgccaccagaaagggcaacaagatcagattcgccaaccacagcgtgaaccccaactgctacgccaaggtgatgatggtgaacggcgaccacagaatcggcatcttcgccaagagagccatccagaccggcgaggagctgttcttcgactacagatacagccaggccgacgccctgaagtacgtgggcatcgagagagagatggagatcccctag

SEQ ID NO: 80420 - DNA, 678 bp, Artificial Sequence
  Description of Artificial Sequence: Synthetic coding sequence
atgtacagctggagccccctgcagcagaacttcatggtggaggacgagaccgtgctgcacaacatcccctacatgggcgacgaggtgctggaccaggacggcaccttcatcgaggagctgatcaagaactacgacggcaaggtgcacggcgacagagagtgcggcttcatcaacgacgagatcttcgtggagctggtgaacgccctgggccagtacaacgacgacgacgacgacgacgacggcgacgaccccgaggagagagaggagaagcagaaggacctggaggaccacagagacgacaaggagagcagaccccccagaaagttccccagcgacaagatcttcgaggccatcagcagcatgttccccgacaagggcaccgccgaggagctgaaggagaagtacaaggagctgaccgagcagcagctgcccggcgccctgccccccgagtgcacccccaacatcgacggccccaacgccaagagcgtgcagagagagcagagcctgcacagcttccacaccctgttctgcagaagatgcttcaagtacgactgcttcctgcaccccttccacgccacccccaacacctacaagagaaagaacaccgagaccgccctggacaacaagccctgcggcccccagtgctaccagcacctgcccctgctgcccagaaactag

SEQ ID NO: 80421 - DNA, 2088 bp, Artificial Sequence
  Description of Artificial Sequence: Synthetic coding sequence
atgggccagaccggcaagaagagcgagaagggccccgtgtgctggagaaagagagtgaagagcgagtacatgagactgagacagctgaagagattcagaagagccgacgaggtgaagagcatgttcagcagcaacagacagaagatcctggagagaaccgagatcctgaaccaggagtggaagcagagaagaatccagcccgtgcacatcctgaccagctgcagcgtgaccagcgacctggacttccccacccaggtgatccccctgaagaccctgaacgccgtggccagcgtgcccatcatgtacagctggagccccctgcagcagaacttcatggtggaggacgagaccgtgctgcacaacatcccctacatgggcgacgaggtgctggaccaggacggcaccttcatcgaggagctgatcaagaactacgacggcaaggtgcacggcgacagagagtgcggcttcatcaacgacgagatcttcgtggagctggtgaacgccctgggccagtacaacgacgacgacgacgacgacgacggcgacgaccccgaggagagagaggagaagcagaaggacctggaggaccacagagacgacaaggagagcagaccccccagaaagttccccagcgacaagatcttcgaggccatcagcagcatgttccccgacaagggcaccgccgaggagctgaaggagaagtacaaggagctgaccgagcagcagctgcccggcgccctgccccccgagtgcacccccaacatcgacggccccaacgccaagagcgtgcagagagagcagagcctgcacagcttccacaccctgttctgcagaagatgcttcaagtacgactgcttcctgcaccccttccacgccacccccaacacctacaagagaaagaacaccgagaccgccctggacaacaagccctgcggcccccagtgctaccagcacctggagggcgccaaggagttcgccgccgccctgaccgccgagagaatcaagaccccccccaagagacccggcggcagaagaagaggcagactgcccaacaacagcagcagacccagcacccccaccatcaacgtgctggagagcaaggacaccgacagcgacagagaggccggcaccgagaccggcggcgagaacaacgacaaggaggaggaggagaagaaggacgagaccagcagcagcagcgaggccaacagcagatgccagacccccatcaagatgaagcccaacatcgagccccccgagaacgtggagtggagcggcgccgaggccagcatgttcagagtgctgatcggcacctactacgacaacttctgcgccatcgccagactgatcggcaccaagacctgcagacaggtgtacgagttcagagtgaaggagagcagcatcatcgcccccgcccccgccgaggacgtggacaccccccccagaaagaagaagagaaagcacagactgtgggccgcccactgcagaaagatccagctgaagaagggccagaacagattccccggctgcagatgcaaggcccagtgcaacaccaagcagtgcccctgctacctggccgtgagagagtgcgaccccgacctgtgcctgacctgcggcgccgccgaccactgggacagcaagaacgtgagctgcaagaactgcagcatccagagaggcagcaagaagcacctgctgctggcccccagcgacgtggccggctggggcatcttcatcaaggaccccgtgcagaagaacgagttcatcagcgagtactgcggcgagatcatcagccaggacgaggccgacagaagaggcaaggtgtacgacaagtacatgtgcagcttcctgttcaacctgaacaacgacttcgtggtggacgccaccagaaagggcaacaagatcagattcgccaaccacagcgtgaaccccaactgctacgccaaggtgatgatggtgaacggcgaccacagaatcggcatcttcgccaagagagccatccagaccggcgaggagctgttcttcgactacagatacagccaggccgacgccctgaagtacgtgggcatcgagagagagatggagatcccctag

SEQ ID NO: 80422 - DNA, 2088 bp, Artificial Sequence; identical to SEQ ID NO: 80421
  Description of Artificial Sequence: Synthetic coding sequence

SEQ ID NO: 80423 - DNA, 2214 bp, Artificial Sequence
  Description of Artificial Sequence: Synthetic coding sequence
atgggccagaccggcaagaagagcgagaagggccccgtgtgctggagaaagagagtgaagagcgagtacatgagactgagacagctgaagagattcagaagagccgacgaggtgaagagcatgttcagcagcaacagacagaagatcctggagagaaccgagatcctgaaccaggagtggaagcagagaagaatccagcccgtgcacatcctgaccagctgcagcgtgaccagcgacctggacttccccacccaggtgatccccctgaagaccctgaacgccgtggccagcgtgcccatcatgtacagctggagccccctgcagcagaacttcatggtggaggacgagaccgtgctgcacaacatcccctacatgggcgacgaggtgctggaccaggacggcaccttcatcgaggagctgatcaagaactacgacggcaaggtgcacggcgacagagagtgcggcttcatcaacgacgagatcttcgtggagctggtgaacgccctgggccagtacaacgacgacgacgacgacgacgacggcgacgaccccgaggagagagaggagaagcagaaggacctggaggaccacagagacgacaaggagagcagaccccccagaaagttccccagcgacaagatcttcgaggccatcagcagcatgttccccgacaagggcaccgccgaggagctgaaggagaagtacaaggagctgaccgagcagcagctgcccggcgccctgccccccgagtgcacccccaacatcgacggccccaacgccaagagcgtgcagagagagcagagcctgcacagcttccacaccctgttctgcagaagatgcttcaagtacgactgcttcctgcaccccttccacgccacccccaacacctacaagagaaagaacaccgagaccgccctggacaacaagccctgcggcccccagtgctaccagcacctggagggcgccaaggagttcgccgccgccctgaccgccgagagaatcaagaccccccccaagagacccggcggcagaagaagaggcagactgcccaacaacagcagcagacccagcacccccaccatcaacgtgctggagagcaaggacaccgacagcgacagagaggccggcaccgagaccggcggcgagaacaacgacaaggaggaggaggagaagaaggacgagaccagcagcagcagcgaggccaacagcagatgccagacccccatcaagatgaagcccaacatcgagccccccgagaacgtggagtggagcggcgccgaggccagcatgttcagagtgctgatcggcacctactacgacaacttctgcgccatcgccagactgatcggcaccaagacctgcagacaggtgtacgagttcagagtgaaggagagcagcatcatcgcccccgcccccgccgaggacgtggacaccccccccagaaagaagaagagaaagcacagactgtgggccgcccactgcagaaagatccagctgaagaaggacggcagcagcaaccacgtgtacaactaccagccctgcgaccaccccagacagccctgcgacagcagctgcccctgcgtgatcgcccagaacttctgcgagaagttctgccagtgcagcagcgagtgccagaacagattccccggctgcagatgcaaggcccagtgcaacaccaagcagtgcccctgctacctggccgtgagagagtgcgaccccgacctgtgcctgacctgcggcgccgccgaccactgggacagcaagaacgtgagctgcaagaactgcagcatccagagaggcagcaagaagcacctgctgctggcccccagcgacgtggccggctggggcatcttcatcaaggaccccgtgcagaagaacgagttcatcagcgagtactgcggcgagatcatcagccaggacgaggccgacagaagaggcaaggtgtacgacaagtacatgtgcagcttcctgttcaacctgaacaacgacttcgtggtggacgccaccagaaagggcaacaagatcagattcgccaaccacagcgtgaaccccaactgctacgccaaggtgatgatggtgaacggcgaccacagaatcggcatcttcgccaagagagccatccagaccggcgaggagctgttcttcgactacagatacagccaggccgacgccctgaagtacgtgggcatcgagagagagatggagatcccctag

SEQ ID NO: 80424 - DNA, 939 bp, Artificial Sequence
  Description of Artificial Sequence: Synthetic coding sequence
atggccgccctgtacgcctgcaccaagtgccaccagagattccccttcgaggccctgagccagggccagcagctgtgcaaggagtgcagaatcgcccaccccgtggtgaagtgcacctactgcagaaccgagtaccagcaggagagactggagtgcaacggcaccatcagcgcccactgcaacctgcacctgcccggcagcagcgacagccccgccagcagcagcagagtggccggcatcaccggcatcaagaccaacaccatctgcaagaagtgcgcccagaacgtgcagctgtacggcacccccaagccctgccagtactgcaacatcatcgccgccttcatcggcaacaagtgccagagatgcaccaacagcgagaagaagtacggccccccctacagctgcgagcagtgcaagcagcagtgcgccttcgacagaaaggacgacagaaagaaggtggacggcaagctgctgtgctggctgtgcaccctgagctacaagagagtgctgcagaagaccaaggagcagagaaagcacctgagcagcagcagcagagccggccaccaggagaaggagcagtacagcagactgagcggcggcggccactacaacagcttcagccccgacctggccctggacagccccggcaccgaccacttcgtgatcatcgcccagctgaaggaggaggtggccaccctgaagaagatgctgcaccagaaggaccagatgatcctggagaaggagaagaagatcaccgagctgaaggccgacttccagtaccaggagagccagatgagagccaagatgaaccagatggagaagacccacaaggaggtgaccgagcagctgcaggccaagaacagagagctgctgaagcaggccgccgccctgagcaagagcaagaagagcgagaagagcggcgccatcaccagcccctag

SEQ ID NO: 80425 - DNA, 861 bp, Artificial Sequence
  Description of Artificial Sequence: Synthetic coding sequence
atggccgaggacggcgaggaggccgagttccacttcgccgccctgtacatcagcggccagtggcccagactgagagccgacaccgacctgcagagactgggcagcagcgccatggcccccagcagaaagttcttcgtgggcggcaactggaagatgaacggcagaaagcagagcctgggcgagctgatcggcaccctgaacgccgccaaggtgcccgccgacaccgaggtggtgtgcgccccccccaccgcctacatcgacttcgccagacagaagctggaccccaagatcgccgtggccgcccagaactgctacaaggtgaccaacggcgccttcaccggcgagatcagccccggcatgatcaaggactgcggcgccacctgggtggtgctgggccacagcgagagaagacacgtgttcggcgagagcgacgagctgatcggccagaaggtggcccacgccctggccgagggcctgggcgtgatcgcctgcatcggcgagaagctggacgagagagaggccggcatcaccgagaaggtggtgttcgagcagaccaaggtgatcgccgacaacgtgaaggactggagcaaggtggtgctggcctacgagcccgtgtgggccatcggcaccggcaagaccgccaccccccagcaggcccaggaggtgcacgagaagctgagaggctggctgaagagcaacgtgagcgacgccgtggcccagagcaccagaatcatctacggcggcagcgtgaccggcgccacctgcaaggagctggccagccagcccgacgtggacggcttcctggtgggcggcgccagcctgaagcccgagttcgtggacatcatcaacgccaagcagtag

SEQ ID NO: 80426 - DNA, 1305 bp, Artificial Sequence; identical to SEQ ID NO: 73914
  Description of Artificial Sequence: Synthetic coding sequence

SEQ ID NO: 80427 - DNA, 1176 bp, Artificial Sequence
  Description of Artificial Sequence: Synthetic coding sequence
atgagcatcgagaagatctgggccagagagatcctggacagcagaggcaaccccaccgtggaggtggacctgtacaccgccaagggcctgttcagagccgccgtgcccagcggcgccagcaccggcatctacgaggccctggagctgagagacggcgacaagcagagatacctgggcaaggccaagttcggcgccaacgccatcctgggcgtgagcctggccgtgtgcaaggccggcgccgccgagagagagctgcccctgtacagacacatcgcccagctggccggcaacagcgacctgatcctgcccgtgcccgccttcaacgtgatcaacggcggcagccacgccggcaacaagctggccatgcaggagttcatgatcctgcccgtgggcgccgagagcttcagagacgccatgagactgggcgccgaggtgtaccacaccctgaagggcgtgatcaaggacaagtacggcaaggacgccaccaacgtgggcgacgagggcggcttcgcccccaacatcctggagaacagcgaggccctggagctggtgaaggaggccatcgacaaggccggctacaccgagaagatcgtgatcggcatggacgtggccgccagcgagttctacagagacggcaagtacgacctggacttcaagagccccaccgaccccagcagatacatcaccggcgaccagctgggcgccctgtaccaggacttcgtgagagactaccccgtggtgagcatcgaggaccccttcgaccaggacgactgggccgcctggagcaagttcaccgccaacgtgggcatccagatcgtgggcgacgacctgaccgtgaccaaccccaagagaatcgagagagccgtggaggagaaggcctgcaactgcctgctgctgaaggtgaaccagatcggcagcgtgaccgaggccatccaggcctgcaagctggcccaggagaacggctggggcgtgatggtgagccacagaagcggcgagaccgaggacaccttcatcgccgacctggtggtgggcctgtgcaccggccagatcaagaccggcgccccctgcagaagcgagagactggccaagtacaaccagctgatgagaatcgaggaggagctgggcgacgaggccagattcgccggccacaacttcagaaaccccagcgtgctgtag

SEQ ID NO: 80428 - DNA, 1305 bp, Artificial Sequence; identical to SEQ ID NO: 73914
  Description of Artificial Sequence: Synthetic coding sequence

SEQ ID NO: 80429 - DNA, 1176 bp, Artificial Sequence; identical to SEQ ID NO: 80427
  Description of Artificial Sequence: Synthetic coding sequence

SEQ ID NO: 80430 - DNA, 1176 bp, Artificial Sequence
  Description of Artificial Sequence: Synthetic coding sequence
atggccatgcagaagatcttcgccagagagatcctggacagcagaggcaaccccaccgtggaggtggacctgcacaccgccaagggcagattcagagccgccgtgcccagcggcgccagcaccggcatctacgaggccctggagctgagagacggcgacaagggcagatacctgggcaaggccaagttcggcgccaacgccatcctgggcgtgagcctggccgtgtgcaaggccggcgccgccgagaagggcgtgcccctgtacagacacatcgccgacctggccggcaaccccgacctgatcctgcccgtgcccgccttcaacgtgatcaacggcggcagccacgccggcaacaagctggccatgcaggagttcatgatcctgcccgtgggcgccagcagcttcaaggaggccatgagaatcggcgccgaggtgtaccaccacctgaagggcgtgatcaaggccaagtacggcaaggacgccaccaacgtgggcgacgagggcggcttcgcccccaacatcctggagaacaacgaggccctggagctgctgaagaccgccatccaggccgccggctaccccgacaaggtggtgatcggcatggacgtggccgccagcgagttctacagaaacggcaagtacgacctggacttcaagagccccgacgaccccgccagacacatcaccggcgagaagctgggcgagctgtacaagagcttcatcaagaactaccccgtggtgagcatcgaggaccccttcgaccaggacgactgggccacctggaccagcttcctgagcggcgtgaacatccagatcgtgggcgacgacctgaccgtgaccaaccccaagagaatcgcccaggccgtggagaagaaggcctgcaactgcctgctgctgaaggtgaaccagatcggcagcgtgaccgagagcatccaggcctgcaagctggcccagagcaacggctggggcgtgatggtgagccacagaagcggcgagaccgaggacaccttcatcgccgacctggtggtgggcctgtgcaccggccagatcaagaccggcgccccctgcagaagcgagagactggccaagtacaaccagctgatgagaatcgaggaggccctgggcgacaaggccatcttcgccggcagaaagttcagaaaccccaaggccaagtag

SEQ ID NO: 80431 - DNA, 1305 bp, Artificial Sequence
  Description of Artificial Sequence: Synthetic coding sequence
atggccatgcagaagatcttcgccagagagatcctggacagcagaggcaaccccaccgtggaggtggacctgcacaccgccaagggcagattcagagccgccgtgcccagcggcgccagcaccggcatctacgaggccctggagctgagagacggcgacaagggcagatacctgggcaagggcgtgctgaaggccgtggagaacatcaacaacaccctgggccccgccctgctgcagaagaagctgagcgtggtggaccaggagaaggtggacaagttcatgatcgagctggacggcaccgagaacaagagcaagttcggcgccaacgccatcctgggcgtgagcctggccgtgtgcaaggccggcgccgccgagaagggcgtgcccctgtacagacacatcgccgacctggccggcaaccccgacctgatcctgcccgtgcccgccttcaacgtgatcaacggcggcagccacgccggcaacaagctggccatgcaggagttcatgatcctgcccgtgggcgccagcagcttcaaggaggccatgagaatcggcgccgaggtgtaccaccacctgaagggcgtgatcaaggccaagtacggcaaggacgccaccaacgtgggcgacgagggcggcttcgcccccaacatcctggagaacaacgaggccctggagctgctgaagaccgccatccaggccgccggctaccccgacaaggtggtgatcggcatggacgtggccgccagcgagttctacagaaacggcaagtacgacctggacttcaagagccccgacgaccccgccagacacatcaccggcgagaagctgggcgagctgtacaagagcttcatcaagaactaccccgtggtgagcatcgaggaccccttcgaccaggacgactgggccacctggaccagcttcctgagcggcgtgaacatccagatcgtgggcgacgacctgaccgtgaccaaccccaagagaatcgcccaggccgtggagaagaaggcctgcaactgcctgctgctgaaggtgaaccagatcggcagcgtgaccgagagcatccaggcctgcaagctggcccagagcaacggctggggcgtgatggtgagccacagaagcggcgagaccgaggacaccttcatcgccgacctggtggtgggcctgtgcaccggccagatcaagaccggcgccccctgcagaagcgagagactggccaagtacaaccagctgatgagaatcgaggaggccctgggcgacaaggccatcttcgccggcagaaagttcagaaaccccaaggccaagtag

SEQ ID NO: 80432 - DNA, 1305 bp, Artificial Sequence; identical to SEQ ID NO: 80431
  Description of Artificial Sequence: Synthetic coding sequence

SEQ ID NO: 80433 - DNA, 852 bp, Artificial Sequence
  Description of Artificial Sequence: Synthetic coding sequence
atggccatgcagaagatcttcgccagagagatcctggacagcagaggcaaccccaccgtggaggtggacctgcacaccgccaagggcagattcagagccgccgtgcccagcggcgccagcaccggcatctacgaggccctggagctgagagacggcgacaagggcagatacctgggcaagggcgtgctgaaggccgtggagaacatcaacaacaccctgggccccgccctgctgcagaagaagctgagcgtggtggaccaggagaaggtggacaagttcatgatcgagctggacggcaccgagaacaagagcaagttcggcgccaacgccatcctgggcgtgagcctggccgtgtgcaaggccggcgccgccgagaagggcgtgcccctgtacagacacatcgccgacctggccggcaaccccgacctgatcctgcccgtgcccgccttcaacgtgatcaacggcggcagccacgccggcaacaagctggccatgcaggagttcatgatcctgcccgtgggcgccagcagcttcaaggaggccatgagaatcggcgccgaggtgtaccaccacctgaagggcgtgatcaaggccaagtacggcaaggacgccaccaacgtgggcgacgagggcggcttcgcccccaacatcctggagaacaacgaggccctggagctgctgaagaccgccatccaggccgccggctaccccgacaaggtggtgatcggcatggacgtggccgccagcgagttctacagaaacggcaagtacgacctggacttcaagagccccgacgaccccgccagacacatcaccggcgagaagctgggcgagctgtacaagagcttctag

SEQ ID NO: 80434 - DNA, 465 bp, Artificial Sequence
  Description of Artificial Sequence: Synthetic coding sequence
atggccatgcagaagatcttcgccagagagatcctggacagcagaggcaaccccaccgtggaggtggacctgcacaccgccaagggcagattcagagccgccgtgcccagcggcgccagcaccggcatctacgaggccctggagctgagagacggcgacaagggcagatacctgggcaagggcgtgctgaaggccgtggagaacatcaacaacaccctgggccccgccctgctgcagaagaagctgagcgtggtggaccaggagaaggtggacaagttcatgatcgagctggacggcaccgagaacaagagcaagttcggcgccaacgccatcctgggcgtgagcctggccgtgtgcaaggccggcgccgccgagaagggcgtgcccctgtacagacacatcgccgacctggccggcaaccccgacctgatcctgcccgtgcccgccttcaacgtgatcaactag

SEQ ID NO: 80435 - DNA, 447 bp, Artificial Sequence
  Description of Artificial Sequence: Synthetic coding sequence
atggccatgcagaagatcttcgccagagagatcctggacagcagaggcaaccccaccgtggaggtggacctgcacaccgccaagggcagattcagagccgccgtgcccagcggcgccagcaccggcatctacgaggccctggagctgagagacggcgacaagggcagatacctgggcaagggcgtgctgaaggccgtggagaacatcaacaacaccctgggccccgccctgctgcagaagaagctgagcgtggtggaccaggagaaggtggacaagttcatgatcgagctggacggcaccgagaacaagagcaagttcggcgccaacgccatcctgggcgtgagcctggccgtgtgcaaggccggcgccgccgagaagggcgtgcccctgtacagacacatcgccgacctggccggcaaccccgacctgatcctgcccgtgccctag

SEQ ID NO: 80436 - DNA, 1332 bp, Artificial Sequence
  Description of Artificial Sequence: Synthetic coding sequence
atggtgagaggcagaatcagcagactgagcgtgagagacgtgagattccccaccagcctgggcggccacggcgccgacgccatgcacaccgaccccgactacagcgccgcctacgtggtgatcgagaccgacgccgaggacggcatcaagggctgcggcatcaccttcaccctgggcaagggcaccgaggtggtggtgtgcgccgtgaacgccctggcccaccacgtgctgaacaaggacctgaaggacatcgtgggcgacttcagaggcttctacagacagctgaccagcgacggccagctgagatggatcggccccgagaagggcgtggtgcacctggccaccgccgccgtgctgaacgccgtgtgggacctgtgggccaagcaggagggcaagcccgtgtggaagctgctggtggacatggaccccagaatgctggtgagctgcatcgacttcagatacatcaccgacgtgctgaccgaggaggacgccctggagatcctgcagaagggccagatcggcaagaaggagagagagaagcagatgctggcccagggctaccccgcctacaccaccagctgcgcctggctgggctacagcgacgacaccctgaagcagctgtgcgcccaggccctgaaggacggctggaccagattcaaggtgaaggtgggcgccgacctgcaggacgacatgagaagatgccagatcatcagagacatgatcggccccgagaagaccctgatgatggacgccaaccagagatgggacgtgcccgaggccgtggagtggatgagcaagctggccaagttcaagcccctgtggatcgaggagcccaccagccccgacgacatcctgggccacgccaccatcagcaaggccctggtgcccctgggcatcggcatcgccaccggcgagcagtgccacaacagagtgatcttcaagcagctgctgcaggccaaggccctgcagttcctgcagatcgacagctgcagactgggcagcgtgaacgagaacctgagcgtgctgctgatggccaagaagttcgagatccccgtgtgcccccacgccggcggcgtgggcctgtgcgagctggtgcagcacctgatcatcttcgactacatcagcgtgagcgccagcctggagaacagagtgtgcgagtacgtggaccacctgcacgagcacttcaagtaccccgtgatgatccagagagccagctacatgccccccaaggaccccggctacagcaccgagatgaaggaggagagcgtgaagaagcaccagtaccccgacggcgaggtgtggaagaagctgctgcccgcccaggagaactag

SEQ ID NO: 80437 - DNA, 642 bp, Artificial Sequence
  Description of Artificial Sequence: Synthetic coding sequence
atgagaagatgccagatcatcagagacatgatcggccccgagaagaccctgatgatggacgccaaccagagatgggacgtgcccgaggccgtggagtggatgagcaagctggccaagttcaagcccctgtggatcgaggagcccaccagccccgacgacatcctgggccacgccaccatcagcaaggccctggtgcccctgggcatcggcatcgccaccggcgagcagtgccacaacagagtgatcttcaagcagctgctgcaggccaaggccctgcagttcctgcagatcgacagctgcagactgggcagcgtgaacgagaacctgagcgtgctgctgatggccaagaagttcgagatccccgtgtgcccccacgccggcggcgtgggcctgtgcgagctggtgcagcacctgatcatcttcgactacatcagcgtgagcgccagcctggagaacagagtgtgcgagtacgtggaccacctgcacgagcacttcaagtaccccgtgatgatccagagagccagctacatgccccccaaggaccccggctacagcaccgagatgaaggaggagagcgtgaagaagcaccagtaccccgacggcgaggtgtggaagaagctgctgcccgcccaggagaactag

SEQ ID NO: 80438 - DNA, 1353 bp, Artificial Sequence
  Description of Artificial Sequence: Synthetic coding sequence
atggtgagcgccgacgccatggtgagcgccgacgccatggtgagcgccgacgccatggtgagcgccgacgccatggtgagcgccgacgccatggtgagcgccgacgccatggtgagcgccgacgccatggtgagcgccgacgccatgcacaccgaccccgactacagcgccgcctacgtggtgatcgagaccgacgccgaggacggcatcaagggctgcggcatcaccttcaccctgggcaagggcaccgaggtggtggtgtgcgccgtgaacgccctggcccaccacgtgctgaacaaggacctgaaggacatcgtgggcgacttcagaggcttctacagacagctgaccagcgacggccagctgagatggatcggccccgagaagggcgtggtgcacctggccaccgccgccgtgctgaacgccgtgtgggacctgtgggccaagcaggagggcaagcccgtgtggaagctgctggtggacatggaccccagaatgctggtgagctgcatcgacttcagatacatcaccgacgtgctgaccgaggaggacgccctggagatcctgcagaagggccagatcggcaagaaggagagagagaagcagatgctggcccagggctaccccgcctacaccaccagctgcgcctggctgggctacagcgacgacaccctgaagcagctgtgcgcccaggccctgaaggacggctggaccagattcaaggtgaaggtgggcgccgacctgcaggacgacatgagaagatgccagatcatcagagacatgatcggccccgagaagaccctgatgatggacgccaaccagagatgggacgtgcccgaggccgtggagtggatgagcaagctggccaagttcaagcccctgtggatcgaggagcccaccagccccgacgacatcctgggccacgccaccatcagcaagtgccacaacagagtgatcttcaagcagctgctgcaggccaaggccctgcagttcctgcagatcgacagctgcagactgggcagcgtgaacgagaacctgagcgtgctgctgatggccaagaagttcgagatccccgtgtgcccccacgccggcggcgtgggcctgtgcgagctggtgcagcacctgatcatcttcgactacatcagcgtgagcgccagcctggagaacagagtgtgcgagtacgtggaccacctgcacgagcacttcaagtaccccgtgatgatccagagagccagctacatgccccccaaggaccccggctacagcaccgagatgaaggaggagagcgtgaagaagcaccagtaccccgacggcgaggtgtggaagaagctgctgcccgcccaggagaactag

SEQ ID NO: 80439 - DNA, 1086 bp, Artificial Sequence
  Description of Artificial Sequence: Synthetic coding sequence
atgcagaagatggagagcagaggcgtggagctgcccagcctgtgggagaaggccctgaagctgatcggccccgagaagggcgtggtgcacctggccaccgccgccgtgctgaacgccgtgtgggacctgtgggccaagcaggagggcaagcccgtgtggaagctgctggtggacatggaccccagaatgctggtgagctgcatcgacttcagatacatcaccgacgtgctgaccgaggaggacgccctggagatcctgcagaagggccagatcggcaagaaggagagagagaagcagatgctggcccagggctaccccgcctacaccaccagctgcgcctggctgggctacagcgacgacaccctgaagcagctgtgcgcccaggccctgaaggacggctggaccagattcaaggtgaaggtgggcgccgacctgcaggacgacatgagaagatgccagatcatcagagacatgatcggccccgagaagaccctgatgatggacgccaaccagagatgggacgtgcccgaggccgtggagtggatgagcaagctggccaagttcaagcccctgtggatcgaggagcccaccagccccgacgacatcctgggccacgccaccatcagcaaggccctggtgcccctgggcatcggcatcgccaccggcgagcagtgccacaacagagtgatcttcaagcagctgctgcaggccaaggccctgcagttcctgcagatcgacagctgcagactgggcagcgtgaacgagaacctgagcgtgctgctgatggccaagaagttcgagatccccgtgtgcccccacgccggcggcgtgggcctgtgcgagctggtgcagcacctgatcatcttcgactacatcagcgtgagcgccagcctggagaacagagtgtgcgagtacgtggaccacctgcacgagcacttcaagtaccccgtgatgatccagagagccagctacatgccccccaaggaccccggctacagcaccgagatgaaggaggagagcgtgaagaagcaccagtaccccgacggcgaggtgtggaagaagctgctgcccgcccaggagaactag

SEQ ID NO: 80440 - DNA, 429 bp, Artificial Sequence
  Description of Artificial Sequence: Synthetic coding sequence
atggtgagaggcagaatcagcagactgagcgtgagagacgtgagattccccaccagcctgggcggccacggcgccgacgccatgcacaccgaccccgactacagcgccgcctacgtggtgatcgagaccgacgccgaggacggcatcaagggctgcggcatcaccttcaccctgggcaagggcaccgaggtggtggtgtgcgccgtgaacgccctggcccaccacgtgctgaacaaggacctgaaggacatcgtgggcgacttcagaggcttctacagacagctgaccagcgacggccagctgagatggatcggccccgagaagggcgtggtgcacctggccaccgccgccgtgctgaacgccgtgtgggacctgtgggccaagcaggagggcaagcccgtgtggaagctgctggtggacatgggctag

SEQ ID NO: 80441 - DNA, 1392 bp, Artificial Sequence
  Description of Artificial Sequence: Synthetic coding sequence
atggccaccgtgaccgccaccaccaaggtgcccgagatcagagacgtgaccagaatcgagagaatcggcgcccacagccacatcagaggcctgggcctggacgacgccctggagcccagacaggccagccagggcatggtgggccagctggccgccagaagagccgccggcgtggtgctggagatgatcagagagggcaagatcgccggcagagccgtgctgatcgccggccagcccggcaccggcaagaccgccatcgccatgggcatggcccaggccctgggccccgacacccccttcaccgccatcgccggcagcgagatcttcagcctggagatgagcaagaccgaggccctgacccaggccttcagaagaagcatcggcgtgagaatcaaggaggagaccgagatcatcgagggcgaggtggtggagatccagatcgacagacccgccaccggcaccggcagcaaggtgggcaagctgaccctgaagaccaccgagatggagaccatctacgacctgggcaccaagatgatcgagagcctgaccaaggacaaggtgcaggccggcgacgtgatcaccatcgacaaggccaccggcaagatcagcaagctgggcagaagcttcaccagagccagagactacgacgccatgggcagccagaccaagttcgtgcagtgccccgacggcgagctgcagaagagaaaggaggtggtgcacaccgtgagcctgcacgagatcgacgtgatcaacagcagaacccagggcttcctggccctgttcagcggcgacaccggcgagatcaagagcgaggtgagagagcagatcaacgccaaggtggccgagtggagagaggagggcaaggccgagatcatccccggcgtgctgttcatcgacgaggtgcacatgctggacatcgagagcttcagcttcctgaacagagccctggagagcgacatggcccccgtgctgatcatggccaccaacagaggcatcaccagaatcagaggcaccagctaccagagcccccacggcatccccatcgacctgctggacagactgctgatcgtgagcaccaccccctacagcgagaaggacaccaagcagatcctgagaatcagatgcgaggaggaggacgtggagatgagcgaggacgcctacaccgtgctgaccagaatcggcctggagaccagcctgagatacgccatccagctgatcaccgccgccagcctggtgtgcagaaagagaaagggcaccgaggtgcaggtggacgacatcaagagagtgtacagcctgttcctggacgagagcagaagcacccagtacatgaaggagtaccaggacgccttcctgttcaacgagctgaagggcgagaccatggacaccagctag

SEQ ID NO: 80442 - DNA, 855 bp, Artificial Sequence
  Description of Artificial Sequence: Synthetic coding sequence
atggccaagagcctgctgaagaccgccagcctgagcggcagaaccaagctgctgcaccagaccggcctgagcctgtacagcaccagccacggcttctacgaggaggaggtgaagaagaccctgcagcagttccccggcggcagcatcgacctgcagaaggaggacaacggcatcggcatcctgaccctgaacaaccccagcagaatgaacgccttcagcggcgtgatgatgctgcagctgctggagaaggtgatcgagctggagaactggaccgagggcaagggcctgatcgtgagaggcgccaagaacaccttcagcagcggcagcgacctgaacgccgtgaagagcctgggcctgcagagaagactgcccctgatcagcgtggccctggtgcagggctgggccctgggcggcggcgccgagttcaccaccgcctgcgacttcagactgatgacccccgagagcaagatcagattcgtgcacaaggagatgggcatcatccccagctggggcggcaccaccagactggtggagatcatcggcagcagacaggccctgaaggtgctgagcggcgccctgaagctggacagcaagaacgccctgaacatcggcatggtggaggaggtgctgcagagcagcgacgagaccaagagcctggaggaggcccaggagtggctgaagcagttcatccagggcccccccgaggtgatcagagccctgaagaagagcgtgtgcagcggcagagagctgtacctggaggaggccctgcagaacgagagagacctgctgggcaccgtgtggggcggccccgccaacctggaggccatcgccaagaagggcaagttcaacaagtag

SEQ ID NO: 80443 - DNA, 438 bp, Artificial Sequence
  Description of Artificial Sequence: Synthetic coding sequence
atggccaagagcctgctgaagaccgccagcctgagcggcagaaccaagctgctgcaccagaccggcctgagcctgtacagcaccagccacggcttctacgaggaggaggtgaagaagaccctgcagcagttccccggcggcagcatcgacctgcagaaggaggacaacggcatcggcatcctgaccctgaacaaccccagcagaatgaacgccttcagcggcgtgatgatgctgcagctgctggagaaggtgatcgagctggagaactggaccgagggcaagggcctgatcgtgagaggcgccaagaacaccttcagcagcggcagcgacctgaacgccgtgaagagcctgggcacccccgagaccagcttcaacaagtgctgcgccggcagcagactgggcatcggctggagaagcagaatctactacagcatgtag

SEQ ID NO: 80444 - DNA, 441 bp, Artificial Sequence
  Description of Artificial Sequence: Synthetic coding sequence
atggccaagagcctgctgaagaccgccagcctgagcggcagaaccaagctgctgcaccagaccggcctgagcctgtacagcaccagccacggcttctacgaggaggaggtgaagaagaccctgcagcagttccccggcggcagcatcgacctgcagaaggaggacaacggcatcggcatcctgaccctgaacaaccccagcagaatgaacgccttcagcggcgtgatgatgctgcagctgctggagaaggtgatcgagctggagaactggaccgagggcaagggcctgatcgtgagaggcgccaagaacaccttcagcagcggcagcgacctgaacgccgtgaagagcctgggcacccccgaggagaccagcttcaacaagtgctgcgccggcagcagactgggcatcggctggagaagcagaatctactacagcatgtag

SEQ ID NO: 80445 - DNA, 438 bp, Artificial Sequence; identical to SEQ ID NO: 80443
  Description of Artificial Sequence: Synthetic coding sequence

SEQ ID NO: 80446 - DNA, 642 bp, Artificial Sequence
  Description of Artificial Sequence: Synthetic coding sequence
atgaacgccttcagcggcgtgatgatgctgcagctgctggagaaggtgatcgagctggagaactggaccgagggcaagggcctgatcgtgagaggcgccaagaacaccttcagcagcggcagcgacctgaacgccgtgaagagcctgggcacccccgaggagagctgcagatggaacaccgagttcctgtacaccctgcaccccgtgagccccttcatcaacatcctgtacagctacggctggaacggcagaatgcacgtgcacgccaagcacctgaacaagatctacgaggtgaagaagcagagaggcaagatcctgctgggcctgagcagactgcccctgatcagcgtggccctggtgcagggctgggccctgggcggcggcgccgagttcaccaccgcctgcgacttcagactgatgacccccgagagcaagatcagattcgtgcacaaggagatgggcatcatccccagctggggcggcaccaccagactggtggagatcatcggcagcagacaggccctgaaggtgctgagcggcgccctgaagctggacagcaagaacgccctgaacatcggcatggtggaggaggtgctgcagagcagcgacgagaccaagagcctggaggaggcccaggagtag

SEQ ID NO: 80447 - DNA, 906 bp, Artificial Sequence
  Description of Artificial Sequence: Synthetic coding sequence
atggccaagagcctgctgaagaccgccagcctgagcggcagaaccaagctgctgcaccagaccggcctgagcctgtacagcaccagccacggcttctacgaggaggaggtgaagaagaccctgcagcagttccccggcggcagcatcgacctgcagaaggaggacaacggcatcggcatcctgaccctgaacaaccccagcagaatgaacgccttcagcggcgtgatgatgctgcagctgctggagaaggtgatcgagctggagaactggaccgagggcaagggcctgatcgtgagaggcgccaagaacaccttcagcagcggcagcgacctgaacgccgtgaagagcctgggcacccccgaggacggcatggccgtgtgcatgttcatgcagaacaccctgaccagattcatgagactgcccctgatcagcgtggccctggtgcagggctgggccctgggcggcggcgccgagttcaccaccgcctgcgacttcagactgatgacccccgagagcaagatcagattcgtgcacaaggagatgggcatcatccccagctggggcggcaccaccagactggtggagatcatcggcagcagacaggccctgaaggtgctgagcggcgccctgaagctggacagcaagaacgccctgaacatcggcatggtggaggaggtgctgcagagcagcgacgagaccaagagcctggaggaggcccaggagtggctgaagcagttcatccagggcccccccgaggtgatcagagccctgaagaagagcgtgtgcagcggcagagagctgtacctggaggaggccctgcagaacgagagagacctgctgggcaccgtgtggggcggccccgccaacctggaggccatcgccaagaagggcaagttcaacaagtag

SEQ ID NO: 80448 - DNA, 681 bp, Artificial Sequence
  Description of Artificial Sequence: Synthetic coding sequence
atgatgctgcagctgctggagaaggtgatcgagctggagaactggaccgagggcaagggcctgatcgtgagaggcgccaagaacaccttcagcagcggcagcgacctgaacgccgtgaagagcctgggcacccccgaggacggcatggccgtgtgcatgttcatgcagaacaccctgaccagattcatgagactgcccctgatcagcgtggccctggtgcagggctgggccctgggcggcggcgccgagttcaccaccgcctgcgacttcagactgatgacccccgagagcaagatcagattcgtgcacaaggagatgggcatcatccccagctggggcggcaccaccagactggtggagatcatcggcagcagacaggccctgaaggtgctgagcggcgccctgaagctggacagcaagaacgccctgaacatcggcatggtggaggaggtgctgcagagcagcgacgagaccaagagcctggaggaggcccaggagtggctgaagcagttcatccagggcccccccgaggtgatcagagccctgaagaagagcgtgtgcagcggcagagagctgtacctggaggaggccctgcagaacgagagagacctgctgggcaccgtgtggggcggccccgccaacctggaggccatcgccaagaagggcaagttcaacaagtag

SEQ ID NO: 80449 - DNA, 906 bp, Artificial Sequence; identical to SEQ ID NO: 80447
  Description of Artificial Sequence: Synthetic coding sequence

SEQ ID NO: 80450 - DNA, 906 bp, Artificial Sequence; identical to SEQ ID NO: 80447
  Description of Artificial Sequence: Synthetic coding sequence

SEQ ID NO: 80451 - DNA, 408 bp, Artificial Sequence
  Description of Artificial Sequence: Synthetic coding sequence
atggccaagagcctgctgaagaccgccagcctgagcggcagaaccaagctgctgcaccagaccggcctgagcctgtacagcaccagccacggcttctacgaggaggaggtgaagaagaccctgcagcagttccccggcggcagcatcgacctgcagaaggaggacaacggcatcggcatcctgaccctgaacaaccccagcagaatgaacgccttcagcggcgtgatgatgctgcagctgctggagaaggtgatcgagctggagaactggaccgagggcaagggcctgatcgtgagaggcgccaagaacaccttcagcagcggcagcgacctgaacgccgtgaagagcctgggcacccccgaggacggcatggccgtgtgcatgttcatgcagaacaccctgacctag

SEQ ID NO: 80452 - DNA, 924 bp, Artificial Sequence
  Description of Artificial Sequence: Synthetic coding sequence
atggccctgaagcaggagatggccaagagcctgctgaagaccgccagcctgagcggcagaaccaagctgctgcaccagaccggcctgagcctgtacagcaccagccacggcttctacgaggaggaggtgaagaagaccctgcagcagttccccggcggcagcatcgacctgcagaaggaggacaacggcatcggcatcctgaccctgaacaaccccagcagaatgaacgccttcagcggcgtgatgatgctgcagctgctggagaaggtgatcgagctggagaactggaccgagggcaagggcctgatcgtgagaggcgccaagaacaccttcagcagcggcagcgacctgaacgccgtgaagagcctgggcacccccgaggacggcatggccgtgtgcatgttcatgcagaacaccctgaccagattcatgagactgcccctgatcagcgtggccctggtgcagggctgggccctgggcggcggcgccgagttcaccaccgcctgcgacttcagactgatgacccccgagagcaagatcagattcgtgcacaaggagatgggcatcatccccagctggggcggcaccaccagactggtggagatcatcggcagcagacaggccctgaaggtgctgagcggcgccctgaagctggacagcaagaacgccctgaacatcggcatggtggaggaggtgctgcagagcagcgacgagaccaagagcctggaggaggcccaggagtggctgaagcagttcatccagggcccccccgaggtgatcagagccctgaagaagagcgtgtgcagcggcagagagctgtacctggaggaggccctgcagaacgagagagacctgctgggcaccgtgtggggcggccccgccaacctggaggccatcgccaagaagggcaagttcaacaagtag

SEQ ID NO: 80453 - DNA, 456 bp, Artificial Sequence
  Description of Artificial Sequence: Synthetic coding sequence
atggccaagagcctgctgaagaccgccagcctgagcggcagaaccaagctgctgcaccagaccggcctgagcctgtacagcaccagccacggcttctacgaggaggaggtgaagaagaccctgcagcagttccccggcggcagcatcgacctgcagaaggaggacaacggcatcggcatcctgaccctgaacaaccccagcagaatgaacgccttcagcggcgtgatgatgctgcagctgctggagaaggtgatcgagctggagaactggaccgagggcaagggcctgatcgtgagaggcgccaagaacaccttcagcagcggcagcgacctgaacgccgtgaagagcctgggcacccccgaggacggcatggccgtgtgcatgttcatgcagaacaccctgaccagattcatgagactgcccctgatcagcgtggccctggtgcagggctggtag

SEQ ID NO: 80454 - DNA, 378 bp, Artificial Sequence
  Description of Artificial Sequence: Synthetic coding sequence
atggccaagagcctgctgaagaccgccagcctgagcggcagaaccaagctgctgcaccagaccggcctgagcctgtacagcaccagccacggcttctacgaggaggaggtgaagaagaccctgcagcagttccccggcggcagcatcgacctgcagaaggaggacaacggcatcggcatcctgaccctgaacaaccccagcagaatgaacgccttcagcggcgtgatgatgctgcagctgctggagaaggtgatcgagctggagaactggaccgagggcaagggcctgatcgtgagaggcgccaagaacaccttcagcagcggcagcgacctgaacgccgtgaagagcctgggcacccccgaggccaacttcctgtag

SEQ ID NO: 80455 - DNA, 213 bp, Artificial Sequence
  Description of Artificial Sequence: Synthetic coding sequence
atgatgctgcagctgctggagaaggtgatcgagctggagaactggaccgagggcaagggcctgatcgtgagaggcgccaagaacaccttcagcagcggcagcgacctgaacgccgtgaagagcctgggcacccccgagaccagcttcaacaagtgctgcgccggcagcagactgggcatcggctggagaagcagaatctactacagcatgtag

SEQ ID NO: 80456 - DNA, 873 bp, Artificial Sequence
  Description of Artificial Sequence: Synthetic coding sequence
atggccgccctgagagtgctgctgagctgcgtgagaggccccctgagaccccccgtgagatgccccgcctggagacccttcgccagcggcgccaacttcgagtacatcatcgccgagaagagaggcaagaacaacaccgtgggcctgatccagctgaacagacccaaggccctgaacgccctgtgcgacggcctgatcgacgagctgaaccaggccctgaagaccttcgaggaggaccccgccgtgggcgccatcgtgctgaccggcggcgacaaggccttcgccgccggcgccgacatcaaggagatgcagaacctgagcttccaggactgctacagcagcaagttcctgaagcactgggaccacctgacccaggtgaagaagcccgtgatcgccgccgtgaacggctacgccttcggcggcggctgcgagctggccatgatgtgcgacatcatctacgccggcgagaaggcccagttcgcccagcccgagatcctgatcggcaccatccccggcgccggcggcacccagagactgaccagagccgtgggcaagagcctggccatggagatggtgctgaccggcgacagaatcagcgcccaggacgccaagcaggccggcctggtgagcaagatctgccccgtggagaccctggtggaggaggccatccagtgcgccgagaagatcgccagcaacagcaagatcgtggtggccatggccaaggagagcgtgaacgccgccttcgagatgaccctgaccgagggcagcaagctggagaagaagctgttctacagcaccttcgccaccgacgacagaaaggagggcatgaccgccttcgtggagaagagaaaggccaacttcaaggaccagtag

SEQ ID NO: 80457 - DNA, 2271 bp, Artificial Sequence
  Description of Artificial Sequence: Synthetic coding sequence
atgagcttcgtggccggcgtgatcagaagactggacgagaccgtggtgaacagaatcgccgccggcgaggtgatccagagacccgccaacgccatcaaggagatgatcgagaactgcctggacgccaagagcaccagcatccaggtgatcgtgaaggagggcggcctgaagctgatccagatccaggacaacggcaccggcatcagaaaggaggacctggacatcgtgtgcgagagattcaccaccagcaagctgcagagcttcgaggacctggccagcatcagcacctacggcttcagaggcgaggccctggccagcatcagccacgtggcccacgtgaccatcaccaccaagaccgccgacggcaagtgcgcctacagagccagctacagcgacggcaagctgaaggccccccccaagccctgcgccggcaaccagggcacccagatcaccgtggaggacctgttctacaacatcgccaccagaagaaaggccctgaagaaccccagcgaggagtacggcaagatcctggaggtggtgggcagatacagcgtgcacaacgccggcatcagcttcagcgtgaagaagcagggcgagaccgtggccgacgtgagaaccctgcccaacgccagcaccgtggacaacatcagaagcatcttcggcaacgccgtgagcagagagctgatcgagatcggctgcgaggacaagaccctggccttcaagatgaacggctacatcagcaacgccaactacagcgtgaagaagtgcatcttcctgctgttcatcaaccacagactggtggagagcaccagcctgagaaaggccatcgagaccgtgtacgccgcctacctgcccaagaacacccaccccttcctgtacctgagcctggagatcagcccccagaacgtggacgtgaacgtgcaccccaccaagcacgaggtgcacttcctgcacgaggagagcatcctggagagagtgcagcagcacatcgagagcaagctgctgggcagcaacagcagcagaatgtacttcacccagaccctgctgcccggcctggccggccccagcggcgagatggtgaagagcaccaccagcctgaccagcagcagcaccagcggcagcagcgacaaggtgtacgcccaccagatggtgagaaccgacagcagagagcagaagctggacgccttcctgcagcccctgagcaagcccctgagcagccagccccaggccatcgtgaccgaggacaagaccgacatcagcagcggcagagccagacagcaggacgaggagatgctggagctgcccgcccccgccgaggtggccgccaagaaccagagcctggagggcgacaccaccaagggcaccagcgagatgagcgagaagagaggccccaccagcagcaaccccagaaagagacacagagaggacagcgacgtggagatggtggaggacgacagcagaaaggagatgaccgccgcctgcacccccagaagaagaatcatcaacctgaccagcgtgctgagcctgcaggaggagatcaacgagcagggccacgaggtgctgagagagatgctgcacaaccacagcttcgtgggctgcgtgaacccccagtgggccctggcccagcaccagaccaagctgtacctgctgaacaccaccaagctgagcgaggagctgttctaccagatcctgatctacgacttcgccaacttcggcgtgctgagactgagcgagcccgcccccctgttcgacctggccatgctggccctggacagccccgagagcggctggaccgaggaggacggccccaaggagggcctggccgagtacatcgtggagttcctgaagaagaaggccgagatgctggccgactacttcagcctggagatcgacgaggagggcaacctgatcggcctgcccctgctgatcgacaactacgtgccccccctggagggcctgcccatcttcatcctgagactggccaccgaggtgaactgggacgaggagaaggagtgcttcgagagcctgagcaaggagtgcgccatgttctacagcatcagaaagcagtacatcagcgaggagagcaccctgagcggccagcagagcgaggtgcccggcagcatccccaacagctggaagtggaccgtggagcacatcgtgtacaaggccctgagaagccacatcctgccccccaagcacttcaccgaggacggcaacatcctgcagctggccaacctgcccgacctgtacaaggtgttcgagagatgctag

SEQ ID NO: 80458 - DNA, 1884 bp, Artificial Sequence
  Description of Artificial Sequence: Synthetic coding sequence
atggccttcggcggcggcctggagctggccctgggctgccactacagaatcgcccacgccgaggcccaggtgggcctgcccgaggtgaccctgggcctgctgcccggcgccagaggcacccagctgctgcccagactgaccggcgtgcccgccgccctggacctgatcaccagcggcagaagaatcctggccgacgaggccctgaagctgggcatcctggacaaggtggtgaacagcgaccccgtggaggaggccatcagattcgcccagagagtgagcgaccagcccctggagagcagaagactgtgcaacaagcccatccagagcctgcccaacatggacagcatcttcagcgaggccctgctgaagatgagaagacagcaccccggctgcctggcccaggaggcctgcgtgagagccgtgcaggccgccgtgcagtacccctacgaggtgggcatcaagaaggaggaggagctgttcctgtacctgctgcagagcggccaggccagagccctgcagtacgccttcttcgccgagagaaaggccaacaagtggagcacccccagcggcgccagctggaagaccgccagcgccagacccgtgagcagcgtgggcgtggtgggcctgggcaccatgggcagaggcatcgtgatcagcttcgccagagccagaatccccgtgatcgccgtggacagcgacaagaaccagctggccaccgccaacaagatgatcaccagcgtgctggagaaggaggccagcaagatgcagcagagcggccacccctggagcggccccaagcccagactgaccagcagcgtgaaggagctgggcggcgtggacctggtgatcgaggccgtgttcgaggagatgagcctgaagaagcaggtgttcgccgagctgagcgccgtgtgcaagcccgaggccttcctgtgcaccaacaccagcgccctggacgtggacgagatcgccagcagcaccgacagaccccacctggtgatcggcacccacttcttcagccccgcccacgtgatgaagctgctggaggtgatccccagccagtacagcagccccaccaccatcgccaccgtgatgaacctgagcaagaagatcaagaagatcggcgtggtggtgggcaactgcttcggcttcgtgggcaacagaatgctgaacccctactacaaccaggcctacttcctgctggaggagggcagcaagcccgaggaggtggaccaggtgctggaggagttcggcttcaagatgggccccttcagagtgagcgacctggccggcctggacgtgggctggaagagcagaaagggccagggcctgaccggccccaccctgctgcccggcacccccgccagaaagagaggcaacagaagatactgccccatccccgacgtgctgtgcgagctgggcagattcggccagaagaccggcaagggctggtaccagtacgacaagcccctgggcagaatccacaagcccgacccctggctgagcaagttcctgagcagatacagaaagacccaccacatcgagcccagaaccatcagccaggacgagatcctggagagatgcctgtacagcctgatcaacgaggccttcagaatcctgggcgagggcatcgccgccagccccgagcacatcgacgtggtgtacctgcacggctacggctggcccagacacaagggcggccccatgttctacgccagcaccgtgggcctgcccaccgtgctggagaagctgcagaagtactacagacagaaccccgacatcccccagctggagcccagcgactacctgaagaagctggccagccagggcaacccccccctgaaggagtggcagagcctggccggcagccccagcagcaagctgtag

SEQ ID NO: 80459 - DNA, 1464 bp, Artificial Sequence
  Description of Artificial Sequence: Synthetic coding sequence
atggccgagtacaccagactgcacaacgccctggccctgatcagactgagaaacccccccgtgaacgccatcagcaccaccctgctgagagacatcaaggagggcctgcagaaggccgtgatcgaccacaccatcaaggccatcgtgatctgcggcgccgagggcaagttcagcgccggcgccgacatcagaggcttcagcgcccccagaaccttcggcctgaccctgggccacgtggtggacgagatccagagaaacgagaagcccgtggtggccgccatccagggcatggccttcggcggcggcctggagctggccctgggctgccactacagaatcgcccacgccgaggcccaggtgggcctgcccgaggtgaccctgggcctgctgcccggcgccagaggcacccagctgctgcccagactgaccggcgtgcccgccgccctggacctgatcaccagcggcagaagaatcctggccgacgaggccctgaagctgggcatcctggacaaggtggtgaacagcgaccccgtggaggaggccatcagattcgcccagagagtgagcgaccagcccctggagagcagaagactgtgcaacaagcccatccagagcctgcccaacatggacagcatcttcagcgaggccctgctgaagatgagaagacagcaccccggctgcctggcccaggaggcctgcgtgagagccgtgcaggccgccgtgcagtacccctacgaggtgggcatcaagaaggaggaggagctgttcctgtacctgctgcagagcggccaggccagagccctgcagtacgccttcttcgccgagagaaaggccaacaagtggagcacccccagcggcgccagctggaagaccgccagcgccagacccgtgagcagcgtgggcgtggtgggcctgggcaccatgggcagaggcatcgtgatcagcttcgccagagccagaatccccgtgatcgccgtggacagcgacaagaaccagctggccaccgccaacaagatgatcaccagcgtgctggagaaggaggccagcaagatgcagcagagcggccacccctggagcggccccaagcccagactgaccagcagcgtgaaggagctgggcggcgtggacctggtgatcgaggccgtgttcgaggagatgagcctgaagaagcaggtgttcgccgagctgagcgccgtgtgcaagcccgaggccttcctgtgcaccaacaccagcgccctggacgtggacgagatcgccagcagcaccgacagaccccacctggtgatcggcacccacttcttcagccccgcccacgtgatgaagctgctggaggtgatccccagccagtacagcagccccaccaccatcgccaccgtgatgaacctgagcaagaagatcaagaagatcggcgtggtggtgggcaactacagcgtgagcaagaagaagaagaagaagaagaagtag

SEQ ID NO: 80460 - DNA, 6102 bp, Artificial Sequence
  Description of Artificial Sequence: Synthetic coding sequence
atgttcaagggcctgagcaagggcagccagggcaagggcagccccaagggcagccccgccaagggcagccccaagggcagccccagcagacacagcagagccgccacccaggagctggccctgctgatcagcagaatgcaggccaacgccgaccaggtggagagagacatcctggagacccagaagagactgcagcaggacagactgaacagcgagcagagccaggccctgcagcaccagcaggagaccggcagaagcctgaaggaggccgaggtgctgctgaaggacctgttcctggacgtggacaaggccagaagactgaagcacccccaggccgaggagatcgagaaggacatcaagcagctgcacgagagagtgacccaggagtgcgccgagtacagagccctgtacgagaagatggtgctgccccccgacgtgggccccagagtggactgggccagagtgctggagcagaagcagaagcaggtgtgcgccggccagtacggccccggcatggccgagctggagcagcagatcgccgagcacaacatcctgcagaaggagatcgacgcctacggccagcagctgagaagcctggtgggccccgacgccgccaccatcagaagccagtacagagacctgctgaaggccgccagctggagaggccagagcctgggcagcctgtacacccacctgcagggctgcaccagacagctgagcgccctggccgagcagcagagaagaatcctgcagcaggactggagcgacctgatggccgaccccgccggcgtgagaagagagtacgagcacttcaagcagcacgagctgctgagccaggagcagagcgtgaaccagctggaggacgacggcgagagaatggtggagctgagacaccccgccgtgggccccatccaggcccaccaggaggccctgaagatggagtggcagaacttcctgaacctgtgcatctgccaggagacccagctgcagcacgtggaggactacagaagattccaggaggaggccgacagcgtgagccagaccctggccaagctgaacagcaacctggacgccaagtacagccccgcccccggcggcccccccggcgcccccaccgagctgctgcagcagctggaggccgaggagaagagactggccgtgaccgagagagccaccggcgacctgcagagaagaagcagagacgtggcccccctgccccagagaagaaaccccccccagcagcccctgcacgtggacagcatctgcgactgggacagcggcgaggtgcagctgctgcagggcgagagatacaagctggtggacaacaccgacccccacgcctgggtggtgcagggccccggcggcgagaccaagagagcccccgccgcctgcttctgcatccccgcccccgaccccgacgccgtggccagagccagcagactggccagcgagctgcaggccctgaagcagaagctggccaccgtgcagagcagactgaaggccagcgccgtggagagcctgagacccagccagcaggcccccagcggcagcgacctggccaacccccaggcccagaagctgctgacccagatgaccagactggacggcgacctgggccagatcgagagacaggtgctggcctgggccagagcccccctgagcagacccacccccctggaggacctggagggcagaatccacagccacgagggcaccgcccagagactgcagagcctgggcaccgagaaggagaccgcccagaaggagtgcgaggccttcctgagcaccagacccgtgggccccgccgccctgcagctgcccgtggccctgaacagcgtgaagaacaagttcagcgacgtgcaggtgctgtgcagcctgtacggcgagaaggccaaggccgccctggacctggagagacagatccaggacgccgacagagtgatcagaggcttcgaggccaccctggtgcaggaggcccccatccccgccgagcccggcgccctgcaggagagagtgagcgagctgcagagacagagaagagagctgctggagcagcagacctgcgtgctgagactgcacagagccctgaaggccagcgagcacgcctgcgccgccctgcagaacaacttccaggagttctgccaggacctgcccagacagcagagacaggtgagagccctgaccgacagataccacgccgtgggcgaccagctggacctgagagagaaggtggtgcaggacgccgccctgacctaccagcagttcaagaactgcaaggacaacctgagcagctggctggagcacctgcccagaagccaggtgagacccagcgacggccccagccagatcgcctacaagctgcaggcccagaagagactgacccaggagatccagagcagagagagagacagagccaccgccagccacctgagccaggccctgcaggccgccctgcaggactacgagctgcaggccgacacctacagatgcagcctggagcccaccctggccgtgagcgcccccaagagacccagagtggcccccctgcaggagagcatccaggcccaggagaagaacctggccaaggcctacaccgaggtggccgccgcccagcagcagctgctgcagcagctggagttcgccagaaagatgctggagaagaaggagctgagcgaggacatcagaagaacccacgacgccaagcagggcagcgagagccccgcccaggccggcagagagagcgaggccctgaaggcccagctggaggaggagagaaagagagtggccagagtgcagcacgagctggaggcccagagaagccagctgctgcagctgagaacccagagacccctggagagactggaggagaaggaggtggtggagttctacagagacccccagctggagggcagcctgagcagagtgaaggcccaggtggaggaggagggcaagagaagagccggcctgcaggccgacctggaggtggccgcccagaaggtggtgcagctggagagcaagagaaagaccatgcagccccacctgctgaccaaggaggtgacccaggtggagagagaccccggcctggacagccaggccgcccagctgagaatccagatccagcagctgagaggcgaggacgccgtgatcagcgccagactggagggcctgaagaaggagctgctggccctggagaagagagaggtggacgtgaaggagaaggtggtggtgaaggaggtggtgaaggtggagaagaacctggagatggtgaaggccgcccaggccctgagactgcagatggaggaggacgccgccagaagaaagcaggccgaggaggccgtggccaagctgcaggccagaatcgaggacctggagagagccatcagcagcgtggagcccaaggtgatcgtgaaggaggtgaagaaggtggagcaggaccccggcctgctgcaggagagcagcagactgagaagcctgctggaggaggagagaaccaagaacgccaccctggccagagagctgagcgacctgcacagcaagtacagcgtggtggagaagcagagacccaaggtgcagctgcaggagagagtgcacgagatcttccaggtggaccccgagaccgagcaggagatcaccagactgaaggccaagctgcaggagatggccggcaagagaagcggcgtggagaaggaggtggagaagctgctgcccgacctggaggtgctgagagcccagaagcccaccgtggagtacaaggaggtgacccaggaggtggtgagacacgagagaagccccgaggtgctgagagagatcgacagactgaaggcccagctgaacgagctggtgaacagccacggcagaagccaggagcagctgatcagactgcagggcgagagagacgagtggagaagagagagagccaaggtggagaccaagaccgtgagcaaggaggtggtgagacacgagaaggaccccgtgctggagaaggaggccgagagactgagacaggaggtgagagaggccgcccagaagagaagagccgccgaggacgccgtgtacgagctgcagagcaagagactgctgctggagagaagaaagcccgaggagaaggtggtggtgcaggaggtggtggtgacccagaaggaccccaagctgagagaggagcacagcagactgagcggcagcctggacgaggaggtgggcagaagaagacagctggagctggaggtgcagcagctgagagccggcgtggaggagcaggagggcctgctgagcttccaggaggacagaagcaagaagctggccgtggagagagagctgagacagctgaccctgagaatccaggagctggagaagagaccccccaccgtgcaggagaagatcatcatggaggaggtggtgaagctggagaaggaccccgacctggagaagagcaccgaggccctgagatgggacctggaccaggagaagacccaggtgaccgagctgaacagagagtgcaagaacctgcaggtgcagatcgacgtgctgcagaaggccaagagccaggagaagaccatctacaaggaggtgatcagagtgcagaaggacagagtgctggaggacgagagagccagagtgtgggagatgctgaacagagagagaaccgccagacaggccagagaggaggaggccagaagactgagagagagaatcgacagagccgagaccctgggcagaacctggagcagagaggagagcgagctgcagagagccagagaccaggccgaccaggagtgcggcagactgcagcaggagctgagagccctggagagacagaagcagcagcagaccctgcagctgcaggaggagagcaagctgctgagccagaagaccgagagcgagagacagaaggccgcccagagaggccaggagctgagcagactggaggccgccatcctgagagagaaggaccagatctacgagaaggagagaaccctgagagacctgcacgccaaggtgagcagagaggagctgagccaggagacccagaccagagagaccaacctgagcaccaagatcagcatcctggagcccgagaccggcaaggacatgagcccctacgaggcctacaagagaggcatcatcgacagaggccagtacctgcagctgcaggagctggagtgcgactgggaggaggtgaccaccagcggcccctgcggcgaggagagcgtgctgctggacagaaagagcggcaagcagtacagcatcgaggccgccctgagatgcagaagaatcagcaaggaggagtaccacctgtacaaggacggccacctgcccatcagcgagttcgccctgctggtggccggcgagaccaagcccagcagcagcctgagcatcggcagcatcatcagcaagagccccctggccagccccgccccccagagcaccagcttcttcagccccagcttcagcctgggcctgggcgacgacagcttccccatcgccggcatctacgacaccaccaccgacaacaagtgcagcatcaagaccgccgtggccaagaacatgctggaccccatcaccggccagaagctgctggaggcccaggccgccaccggcggcatcgtggacctgctgagcagagagagatacagcgtgcacaaggccatggagagaggcctgatcgagaacaccagcacccagagactgctgaacgcccagaaggccttcaccggcatcgaggaccccgtgaccaagaagagactgagcgtgggcgaggccgtgcagaagggctggatgcccagagagagcgtgctgccccacctgcaggtgcagcacctgaccggcggcctgatcgaccccaagagaaccggcagaatccccatccagcaggccctgctgagcggcatgatcagcgaggagctggcccagctgctgcaggacgagagcagctacgagaaggacctgaccgaccccatcagcaaggagagactgagctacaaggaggccatgggcagatgcagaaaggaccccctgagcggcctgctgctgctgcccgccgccctggagggctacagatgctacagaagcgccagccccaccgtgcccagaagcctgagatag

SEQ ID NO: 80461 - DNA, 2061 bp, Artificial Sequence
  Description of Artificial Sequence: Synthetic coding sequence
atgcagctgggcgagcagctgctggtgagcagcgtgaacctgcccggcgcccacttctaccccctggagagcgccagaggcggcagcggcggcagcgccggccacctgcccagcgccgcccccagcccccagaagctggacctggacaaggccagcaagaagttcagcggcagcctgagctgcgaggccgtgagcggcgagcccgccgccgccagcgccggcgcccccgccgccatgctgagcgacaccgacgccggcgacgccttcgccagcgccgccgccgtggccaagcccggcccccccgacggcagaaagggcagcccctgcggcgaggaggagctgcccagcgccgccgccgccgccgccgccgccgccgccgccgccgccgccaccgccagatacagcatggacagcctgagcagcgagagatactacctgcagagccccggcccccagggcagcgagctggccgccccctgcagcctgttcccctaccaggccgccgccggcgccccccacggccccgtgtaccccgcccccaacggcgccagatacccctacggcagcatgctgccccccggcggcttccccgccgccgtgtgcccccccggcagagcccagttcggccccggcgccggcgccggcagcggcgccggcggcagcagcggcggcggcggcggccccggcacctaccagtacagccagggcgcccccctgtacggcccctaccccggcgccgccgccgccggcagctgcggcggcctgggcggcctgggcgtgcccggcagcggcttcagagcccacgtgtacctgtgcaacagacccctgtggctgaagttccacagacaccagaccgagatgatcatcaccaagcagggcagaagaatgttccccttcctgagcttcaacatcaacggcctgaaccccaccgcccactacaacgtgttcgtggaggtggtgctggccgaccccaaccactggagattccagggcggcaagtgggtgacctgcggcaaggccgacaacaacatgcagggcaacaagatgtacgtgcaccccgagagccccaacaccggcagccactggatgagacaggagatcagcttcggcaagctgaagctgaccaacaacaagggcgccaacaacaacaacacccagatgatcgtgctgcagagcctgcacaagtaccagcccagactgcacatcgtggaggtgaccgaggacggcgtggaggacctgaacgagcccagcaagacccagaccttcaccttcagcgagacccagttcatcgccgtgaccgcctaccagaacaccgacatcacccagctgaagatcgaccacaaccccttcgccaagggcttcagagacaactacgacagcagccaccagatcgtgcccggcggcagatacggcgtgcagagcttcttccccgagcccttcgtgaacaccctgccccaggccagatactacaacggcgagagaaccgtgccccagaccaacggcctgctgagcccccagcagagcgaggaggtggccaaccccccccagagatggctggtgacccccgtgcagcagcccggcaccaacaagctggacatcagcagctacgagagcgagtacaccagcagcaccctgctgccctacggcatcaagagcctgcccctgcagaccagccacgccctgggctactaccccgaccccaccttccccgccatggccggctggggcggcagaggcagctaccagagaaagatggccgccggcctgccctggaccagcagaaccagccccaccgtgttcagcgaggaccagctgagcaaggagaaggtgaaggaggagatcggcagcagctggatcgagaccccccccagcatcaagagcctggacagcaacgacagcggcgtgtacaccagcgcctgcaagagaagaagactgagccccagcaacagcagcaacgagaacagccccagcatcaagtgcgaggacatcaacgccgaggagtacagcaaggacaccagcaagggcatgggcggctactacgccttctacaccaccccctag

SEQ ID NO: 80462 - DNA, 2118 bp, Artificial Sequence
  Description of Artificial Sequence: Synthetic coding sequence
atgcagctgggcgagcagctgctggtgagcagcgtgaacctgcccggcgcccacttctaccccctggagagcgccagaggcggcagcggcggcagcgccggccacctgcccagcgccgcccccagcccccagaagctggacctggacaaggccagcaagaagttcagcggcagcctgagctgcgaggccgtgagcggcgagcccgccgccgccagcgccggcgcccccgccgccatgctgagcgacaccgacgccggcgacgccttcgccagcgccgccgccgtggccaagcccggcccccccgacggcagaaagggcagcccctgcggcgaggaggagctgcccagcgccgccgccgccgccgccgccgccgccgccgccgccgccgccaccgccagatacagcatggacagcctgagcagcgagagatactacctgcagagccccggcccccagggcagcgagctggccgccccctgcagcctgttcccctaccaggccgccgccggcgccccccacggccccgtgtaccccgcccccaacggcgccagatacccctacggcagcatgctgccccccggcggcttccccgccgccgtgtgcccccccggcagagcccagttcggccccggcgccggcgccggcagcggcgccggcggcagcagcggcggcggcggcggccccggcacctaccagtacagccagggcgcccccctgtacggcccctaccccggcgccgccgccgccggcagctgcggcggcctgggcggcctgggcgtgcccggcagcggcttcagagcccacgtgtacctgtgcaacagacccctgtggctgaagttccacagacaccagaccgagatgatcatcaccaagcagggcagaagaatgttccccttcctgagcttcaacatcaacggcctgaaccccaccgcccactacaacgtgttcgtggaggtggtgctggccgaccccaaccactggagattccagggcggcaagtgggtgacctgcggcaaggccgacaacaacatgcagggcaacaagatgtacgtgcaccccgagagccccaacaccggcagccactggatgagacaggagatcagcttcggcaagctgaagctgaccaacaacaagggcgccaacaacaacaacacccagatgatcgtgctgcagagcctgcacaagtaccagcccagactgcacatcgtggaggtgaccgaggacggcgtggaggacctgaacgagcccagcaagacccagaccttcaccttcagcgagacccagttcatcgccgtgaccgcctaccagaacaccgacatcacccagctgaagatcgaccacaaccccttcgccaagggcttcagagacaactacgacagcatgtacaccgccagcgagaacgacagactgacccccagccccaccgacagccccagaagccaccagatcgtgcccggcggcagatacggcgtgcagagcttcttccccgagcccttcgtgaacaccctgccccaggccagatactacaacggcgagagaaccgtgccccagaccaacggcctgctgagcccccagcagagcgaggaggtggccaaccccccccagagatggctggtgacccccgtgcagcagcccggcaccaacaagctggacatcagcagctacgagagcgagtacaccagcagcaccctgctgccctacggcatcaagagcctgcccctgcagaccagccacgccctgggctactaccccgaccccaccttccccgccatggccggctggggcggcagaggcagctaccagagaaagatggccgccggcctgccctggaccagcagaaccagccccaccgtgttcagcgaggaccagctgagcaaggagaaggtgaaggaggagatcggcagcagctggatcgagaccccccccagcatcaagagcctggacagcaacgacagcggcgtgtacaccagcgcctgcaagagaagaagactgagccccagcaacagcagcaacgagaacagccccagcatcaagtgcgaggacatcaacgccgaggagtacagcaaggacaccagcaagggcatgggcggctactacgccttctacaccaccccctag

SEQ ID NO: 80463 - DNA, 1713 bp, Artificial Sequence
  Description of Artificial Sequence: Synthetic coding sequence
atggacagcctgagcagcgagagatactacctgcagagccccggcccccagggcagcgagctggccgccccctgcagcctgttcccctaccaggccgccgccggcgccccccacggccccgtgtaccccgcccccaacggcgccagatacccctacggcagcatgctgccccccggcggcttccccgccgccgtgtgcccccccggcagagcccagttcggccccggcgccggcgccggcagcggcgccggcggcagcagcggcggcggcggcggccccggcacctaccagtacagccagggcgcccccctgtacggcccctaccccggcgccgccgccgccggcagctgcggcggcctgggcggcctgggcgtgcccggcagcggcttcagagcccacgtgtacctgtgcaacagacccctgtggctgaagttccacagacaccagaccgagatgatcatcaccaagcagggcagaagaatgttccccttcctgagcttcaacatcaacggcctgaaccccaccgcccactacaacgtgttcgtggaggtggtgctggccgaccccaaccactggagattccagggcggcaagtgggtgacctgcggcaaggccgacaacaacatgcagggcaacaagatgtacgtgcaccccgagagccccaacaccggcagccactggatgagacaggagatcagcttcggcaagctgaagctgaccaacaacaagggcgccaacaacaacaacacccagatgatcgtgctgcagagcctgcacaagtaccagcccagactgcacatcgtggaggtgaccgaggacggcgtggaggacctgaacgagcccagcaagacccagaccttcaccttcagcgagacccagttcatcgccgtgaccgcctaccagaacaccgacatcacccagctgaagatcgaccacaaccccttcgccaagggcttcagagacaactacgacagcatgtacaccgccagcgagaacgacagactgacccccagccccaccgacagccccagaagccaccagatcgtgcccggcggcagatacggcgtgcagagcttcttccccgagcccttcgtgaacaccctgccccaggccagatactacaacggcgagagaaccgtgccccagaccaacggcctgctgagcccccagcagagcgaggaggtggccaaccccccccagagatggctggtgacccccgtgcagcagcccggcaccaacaagctggacatcagcagctacgagagcgagtacaccagcagcaccctgctgccctacggcatcaagagcctgcccctgcagaccagccacgccctgggctactaccccgaccccaccttccccgccatggccggctggggcggcagaggcagctaccagagaaagatggccgccggcctgccctggaccagcagaaccagccccaccgtgttcagcgaggaccagctgagcaaggagaaggtgaaggaggagatcggcagcagctggatcgagaccccccccagcatcaagagcctggacagcaacgacagcggcgtgtacaccagcgcctgcaagagaagaagactgagccccagcaacagcagcaacgagaacagccccagcatcaagtgcgaggacatcaacgccgaggagtacagcaaggacaccagcaagggcatgggcggctactacgccttctacaccaccccctag

SEQ ID NO: 80464 - DNA, 1233 bp, Artificial Sequence
  Description of Artificial Sequence: Synthetic coding sequence
atgttccccttcctgagcttcaacatcaacggcctgaaccccaccgcccactacaacgtgttcgtggaggtggtgctggccgaccccaaccactggagattccagggcggcaagtgggtgacctgcggcaaggccgacaacaacatgcagggcaacaagatgtacgtgcaccccgagagccccaacaccggcagccactggatgagacaggagatcagcttcggcaagctgaagctgaccaacaacaagggcgccaacaacaacaacacccagatgatcgtgctgcagagcctgcacaagtaccagcccagactgcacatcgtggaggtgaccgaggacggcgtggaggacctgaacgagcccagcaagacccagaccttcaccttcagcgagacccagttcatcgccgtgaccgcctaccagaacaccgacatcacccagctgaagatcgaccacaaccccttcgccaagggcttcagagacaactacgacagcatgtacaccgccagcgagaacgacagactgacccccagccccaccgacagccccagaagccaccagatcgtgcccggcggcagatacggcgtgcagagcttcttccccgagcccttcgtgaacaccctgccccaggccagatactacaacggcgagagaaccgtgccccagaccaacggcctgctgagcccccagcagagcgaggaggtggccaaccccccccagagatggctggtgacccccgtgcagcagcccggcaccaacaagctggacatcagcagctacgagagcgagtacaccagcagcaccctgctgccctacggcatcaagagcctgcccctgcagaccagccacgccctgggctactaccccgaccccaccttccccgccatggccggctggggcggcagaggcagctaccagagaaagatggccgccggcctgccctggaccagcagaaccagccccaccgtgttcagcgaggaccagctgagcaaggagaaggtgaaggaggagatcggcagcagctggatcgagaccccccccagcatcaagagcctggacagcaacgacagcggcgtgtacaccagcgcctgcaagagaagaagactgagccccagcaacagcagcaacgagaacagccccagcatcaagtgcgaggacatcaacgccgaggagtacagcaaggacaccagcaagggcatgggcggctactacgccttctacaccaccccctag

SEQ ID NO: 80465 - DNA, 1269 bp, Artificial Sequence
  Description of Artificial Sequence: Synthetic coding sequence
atgggccaggccggctgcaagggcctgtgcctgagcctgttcgactacaagaccgagaagtacgtgatcgccaagaacaagaaggtgggcctgctgtacagactgctgcaggccagcatcctggcctacctggtggtgtgggtgttcctgatcaagaagggctaccaggacgtggacaccagcctgcagagcgccgtgatcaccaaggtgaagggcgtggccttcaccaacaccagcgacctgggccagagaatctgggacgtggccgactacgtgatccccgcccagggcgagaacgtgttcttcgtggtgaccaacctgatcgtgacccccaaccagagacagaacgtgtgcgccgagaacgagggcatccccgacggcgcctgcagcaaggacagcgactgccacgccggcgaggccgtgaccgccggcaacggcgtgaagaccggcagatgcctgagaagagagaacctggccagaggcacctgcgagatcttcgcctggtgccccctggagaccagcagcagacccgaggagcccttcctgaaggaggccgaggacttcaccatcttcatcaagaaccacatcagattccccaagttcaacttcagcaagagcaacgtgatggacgtgaaggacagaagcttcctgaagagctgccacttcggccccaagaaccactactgccccatcttcagactgggcagcgtgatcagatgggccggcagcgacttccaggacatcgccctggagggcggcgtgatcggcatcaacatcgagtggaactgcgacctggacaaggccgccagcgagtgccacccccactacagcttcagcagactggacaacaagctgagcaagagcgtgagcagcggctacaacttcagattcgccagatactacagagacgccgccggcgtggagttcagaaccctgatgaaggcctacggcatcagattcgacgtgatggtgaacggcaagggcgccttcttctgcgacctggtgctgatctacctgatcaagaagagagagttctacagagacaagaagtacgaggaggtgagaggcctggaggacagcagccaggaggccgaggacgaggccagcggcctgggcctgagcgagcagctgaccagcggccccggcctgctgggcatgcccgagcagcaggagctgcaggagccccccgaggccaagagaggcagcagcagccagaagggcaacggcagcgtgtgcccccagctgctggagccccacagaagcacctag

SEQ ID NO: 80466 - DNA, 564 bp, Artificial Sequence
  Description of Artificial Sequence: Synthetic coding sequence
atgagcgagatggccgagctgagcgagctgtacgaggagagcagcgacctgcagatggacgtgatgcccggcgagggcgacctgccccagatggaggtgggcagcggcagcagagagctgagcctgagacccagcagaagcggcgcccagcagctggaggaggagggccccatggaggaggaggaggcccagcccatggccgcccccgagggcaagagaagcctggccaacggccccaacgccggcgagcagcccggccaggtggccggcgccgacttcgagagcgaggacgagggcgaggagttcgacgactgggaggacgactacgactaccccgaggaggagcagctgagcggcgccggctacagagtgagcgccgccctggaggaggccgacaagatgttcctgagaaccagagagcccgccctggacggcggcttccagatgcactacgagaagacccccttcgaccagctggccttcatcgaggagctgttcagcctgatggtggtgaacagactgaccgaggagctgggctgcgacgagatcatcgacagagagtag

SEQ ID NO: 80467 - DNA, 711 bp, Artificial Sequence
  Description of Artificial Sequence: Synthetic coding sequence
atgagcaagctgcccgccgacagcagcgtgccccagaccggcgccgccaacggcgacagagacgtgccccaggccgaggtgggcagaggcagaagagagcccgcccccgcccagcccgaggaggccggcgagggcgccatggccgccgccagaggcggccccgtgcccgccgccagagagggcagaatggccgccgccagagccgcccccgccgccgccgccagaggcgcccccgtggccgccgccgccctggccagagccgccgccgccggcagagagagccccgccgccgccgccgccagagaggccagaatggccgaggtggccagactgctgggcgagcccgtggacgaggagggccccgagggcagacccagaagcagacacggcaacggcggcctggccgccctgccctacctgagactgagacaccccctgagcgtgctgggcatcaactaccagcagttcctgagacactacctggagaactaccccatcgcccccggcagaatccaggagctggaggagagaagaagaagattcgtggaggcctgcagagccagagaggccgccttcgacgccgagtaccagagaaacccccacagagtggacctggacatcctgaccttcaccatcgccctgaccgccagcgaggtgatcaaccccctgatcgaggagctgggctgcgacaagttcatcaacagagagtag

SEQ ID NO: 80468 - DNA, 564 bp, Artificial Sequence
  Description of Artificial Sequence: Synthetic coding sequence
atgagcaagctgcccgccgacagcagcgtgccccagaccggcgccgccaacggcgacagagacgtgccccaggccgaggtgggcagaggcagaagagagcccgcccccgcccagcccgaggaggccggcgagagccccgccgccgccgccgccagagaggccagaatggccgaggtggccagactgctgggcgagcccgtggacgaggagggccccgagggcagacccagaagcagacacggcaacggcggcctggccgccctgccctacctgagactgagacaccccctgagcgtgctgggcatcaactaccagcagttcctgagacactacctggagaactaccccatcgcccccggcagaatccaggagctggaggagagaagaagaagattcgtggaggcctgcagagccagagaggccgccttcgacgccgagtaccagagaaacccccacagagtggacctggacatcctgaccttcaccatcgccctgaccgccagcgaggtgatcaaccccctgatcgaggagctgggctgcgacaagttcatcaacagagagtag

SEQ ID NO: 80469 - DNA, 1002 bp, Artificial Sequence
  Description of Artificial Sequence: Synthetic coding sequence
atgaagatggacgtgagcgtgagagccgccggctgcagcgacgacctgagcagcggcgaggccgacgtggaccccaagctgctggagctgaccgccgacgaggagaagtgcagaagcatcagaagacagtacagacagctgatgtactgcgtgagacagaacagagaggacatcgtgagcagcgccaacaacagcctgaccgaggccctggaggaggccaacgtgctgttcgacggcgtgagcagaaccagagaggccgccctggacgccagattcctggtgatggccagcgacctgggcaaggagaaggccaagcagctgaacagcgacatgaacttcttcaaccagctggccttctgcgacttcctgttcctgttcgtgggcctgaactggatggagggcgaccccgacaagctgagcgactgcgacgacagcatcgccctgagcttctggaaggccatcgagaaggaggccaccagctggatggtgaaggccgagaccttccacttcgtgttcggcagcttcaagctggagagaagcgcccccaagcccagactggagcaccagaagaaggtgagaaagatggaggagaacggcaacatgcccaccaagctgcagaagctggacctgagcagctaccccgaggccaccgagaagaacgtggagagaatcctgggcctgctgcagacctacttcagaaagtaccccgacacccccgtgagctacttcgagttcgtgatcgaccccaacagcttcagcagaaccgtggagaacatcttctacgtgagcttcatcgtgagagacggcttcgccagaatcagactggacgaggacagactgcccatcctggagcccatgaacgtgaaccagatgggcgagggcaacgacagcagctgccacggcagaaagcagggcgtgatcagcctgaccctgcaggagtggaagaacatcgtggccgccttcgagatcagcgaggccatgatcacctacagcagctactag

SEQ ID NO: 80470 - DNA, 2931 bp, Artificial Sequence
  Description of Artificial Sequence: Synthetic coding sequence
atggagagaagatggcccctgggcctgggcctggtgctgctgctgtgcgcccccctgccccccggcgccagagccaaggaggtgaccctgatggacaccagcaaggcccagggcgagctgggctggctgctggacccccccaaggacggctggagcgagcagcagcagatcctgaacggcacccccctgtacatgtaccaggactgccccatgcagggcagaagagacaccgaccactggctgagaagcaactggatctacagaggcgaggaggccagcagagtgcacgtggagctgcagttcaccgtgagagactgcaagagcttccccggcggcgccggccccctgggctgcaaggagaccttcaacctgctgtacatggagagcgaccaggacgtgggcatccagctgagaagacccctgttccagaaggtgaccaccgtggccgccgaccagagcttcaccatcagagacctggtgagcggcagcgtgaagctgaacgtggagagatgcagcctgggcagactgaccagaagaggcctgtacctggccttccacaaccccggcgcctgcgtggccctggtgagcgtgagagtgttctaccagagatgccccgagaccctgaacggcctggcccagttccccgacaccctgcccggccccgccggcctggtggaggtggccggcacctgcctgccccacgccagagccagccccagacccagcggcgcccccagaatgcactgcagccccgacggcgagtggctggtgcccgtgggcagatgccactgcgagcccggctacgaggagggcggcagcggcgaggcctgcgtggcctgccccagcggcagctacagaatggacatggacaccccccactgcctgacctgcccccagcagagcaccgccgagagcgagggcgccaccatctgcacctgcgagagcggccactacagagcccccggcgagggcccccaggtggcctgcaccggcccccccagcgcccccagaaacctgagcttcagcgccagcggcacccagctgagcctgagatgggagccccccgccgacaccggcggcagacaggacgtgagatacagcgtgagatgcagccagtgccagggcaccgcccaggacggcggcccctgccagccctgcggcgtgggcgtgcacttcagccccggcgccagaggcctgaccacccccgccgtgcacgtgaacggcctggagccctacgccaactacaccttcaacgtggaggcccagaacggcgtgagcggcctgggcagcagcggccacgccagcaccagcgtgagcatcagcatgggccacgccgagagcctgagcggcctgagcctgagactggtgaagaaggagcccagacagctggagctgacctgggccggcagcagacccagaagccccggcgccaacctgacctacgagctgcacgtgctgaaccaggacgaggagagataccagatggtgctggagcccagagtgctgctgaccgagctgcagcccgacaccacctacatcgtgagagtgagaatgctgacccccctgggccccggccccttcagccccgaccacgagttcagaaccagcccccccgtgagcagaggcctgaccggcggcgagatcgtggccgtgatcttcggcctgctgctgggcgccgccctgctgctgggcatcctggtgttcagaagcagaagagcccagagacagagacagcagagacagagagacagagccaccgacgtggacagagaggacaagctgtggctgaagccctacgtggacctgcaggcctacgaggaccccgcccagggcgccctggacttcaccagagagctggaccccgcctggctgatggtggacaccgtgatcggcgagggcgagttcggcgaggtgtacagaggcaccctgagactgcccagccaggactgcaagaccgtggccatcaagaccctgaaggacaccagccccggcggccagtggtggaacttcctgagagaggccaccatcatgggccagttcagccacccccacatcctgcacctggagggcgtggtgaccaagagaaagcccatcatgatcatcaccgagttcatggagaacggcgccctggacgccttcctgagagagagagaggaccagctggtgcccggccagctggtggccatgctgcagggcatcgccagcggcatgaactacctgagcaaccacaactacgtgcacagagacctggccgccagaaacatcctggtgaaccagaacctgtgctgcaaggtgagcgacttcggcctgaccagactgctggacgacttcgacggcacctacgagacccagggcggcaagatccccatcagatggaccgcccccgaggccatcgcccacagaatcttcaccaccgccagcgacgtgtggagcttcggcatcgtgatgtgggaggtgctgagcttcggcgacaagccctacggcgagatgagcaaccaggaggtgatgaagagcatcgaggacggctacagactgcccccccccgtggactgccccgcccccctgtacgagctgatgaagaactgctgggcctacgacagagccagaagaccccacttccagaagctgcaggcccacctggagcagctgctggccaacccccacagcctgagaaccatcgccaacttcgaccccagaatgaccctgagactgcccagcctgagcggcagcgacggcatcccctacagaaccgtgagcgagtggctggagagcatcagaatgaagagatacatcctgcacttccacagcgccggcctggacaccatggagtgcgtgctggagctgaccgccgaggacctgacccagatgggcatcaccctgcccggccaccagaagagaatcctgtgcagcatccagggcttcaaggactag

SEQ ID NO: 80471 - DNA, 888 bp, Artificial Sequence
  Description of Artificial Sequence: Synthetic coding sequence
atggagacctgcgccggcccccaccccctgagactgttcctgtgcagaatgcagctgtgcctggccctgctgctgggcccctggagacccggcaccgccgaggaggtgatcctgctggacagcaaggccagccaggccgagctgggctggaccgccctgcccagcaacggctgggaggagatcagcggcgtggacgagcacgacagacccatcagaacctaccaggtgtgcaacgtgctggagcccaaccaggacaactggctgcagaccggctggatcagcagaggcagaggccagagaatcttcgtggagctgcagttcaccctgagagactgcagcagcatccccggcgccgccggcacctgcaaggagaccttcaacgtgtactacctggagaccgaggccgacctgggcagaggcagacccagactgggcggcagcagacccagaaagatcgacaccatcgccgccgacgagagcttcacccagggcgacctgggcgagagaaagatgaagctgaacaccgaggtgagagagatcggccccctgagcagaagaggcttccacctggccttccaggacgtgggcgcctgcgtggccctggtgagcgtgagagtgtactacaagcagtgcagagccaccgtgagaggcctggccaccttccccgccaccgccgccgagagcgccttcagcaccctggtggaggtggccggcacctgcgtggcccacagcgagggcgagcccggcagcccccccagaatgcactgcggcgccgacggcgagtggctggtgcccgtgggcagatgcagctgcagcgccggcttccaggagagaggcgacttctgcgagggcatccagctggccggcggcagaggcgtgggcgtgtag

SEQ ID NO: 80472 - DNA, 1632 bp, Artificial Sequence
  Description of Artificial Sequence: Synthetic coding sequence
atggtgaagaccggcgcccccaccgtgaccgtgaccaacctgaagcccgccaccagatacgtgttccagatcagagccgccagccccggccccagctgggaggcccagagcttcaaccccagcatcgaggtgcagaccctgggcgaggccgccagcggcagcagagaccagagccccgccatcgtggtgaccgtggtgaccatcagcgccctgctggtgctgggcagcgtgatgagcgtgctggccatctggagaagaccctgcagctacggcaagggcggcggcgacgcccacgacgaggaggagctgtacttccacttcaaggtgcccaccagaagaaccttcctggacccccagagctgcggcgacctgctgcaggccgtgcacctgttcgccaaggagctggacgccaagagcgtgaccctggagagaagcctgggcggcggcagattcggcgagctgtgctgcggctgcctgcagctgcccggcagacaggagctgctggtggccgtgcacatgctgagagacagcgccagcgacagccagagactgggcttcctggccgaggccctgaccctgggccagttcgaccacagccacatcgtgagactggagggcgtggtgaccagaggcagcaccctgatgatcgtgaccgagtacatgagccacggcgccctggacggcttcctgagaagacacgagggccagctggtggccggccagctgatgggcctgctgcccggcctggccagcgccatgaagtacctgagcgagatgggctacgtgcacagaggcctggccgccagacacgtgctggtgagcagcgacctggtgtgcaagatcagcggcttcggcagaggccccagagacagaagcgaggccgtgtacaccaccatgagcggcagaagccccgccctgtgggccgcccccgagaccctgcagttcggccacttcagcagcgccagcgacgtgtggagcttcggcatcatcatgtgggaggtgatggccttcggcgagagaccctactgggacatgagcggccaggacgtgatcaaggccgtggaggacggcttcagactgcccccccccagaaactgccccaacctgctgcacagactgatgctggactgctggcagaaggaccccggcgagagacccagattcagccagatccacagcatcctgagcaagatggtgcaggaccccgagccccccaagtgcgccctgaccacctgccccagaccccccacccccctggccgacagagccttcagcaccttccccagcttcggcagcgtgggcgcctggctggaggccctggacctgtgcagatacaaggacagcttcgccgccgccggctacggcagcctggaggccgtggccgagatgaccgcccaggacctggtgagcctgggcatcagcctggccgagcacagagaggccctgctgagcggcatcagcgccctgcaggccagagtgctgcagctgcagggccagggcgtgcaggacaacaagaacctgagcgtgatctggtgcctgttcgagtggcagctgctggaccactgcatcgccggcgtggagggcctgctgccccccagcagcagaaccggcgtgagcagaatctgcgtgtag

SEQ ID NO: 80473 - DNA, 3027 bp, Artificial Sequence
  Description of Artificial Sequence: Synthetic coding sequence
atggagacctgcgccggcccccaccccctgagactgttcctgtgcagaatgcagctgtgcctggccctgctgctgggcccctggagacccggcaccgccgaggaggtgatcctgctggacagcaaggccagccaggccgagctgggctggaccgccctgcccagcaacggctgggaggagatcagcggcgtggacgagcacgacagacccatcagaacctaccaggtgtgcaacgtgctggagcccaaccaggacaactggctgcagaccggctggatcagcagaggcagaggccagagaatcttcgtggagctgcagttcaccctgagagactgcagcagcatccccggcgccgccggcacctgcaaggagaccttcaacgtgtactacctggagaccgaggccgacctgggcagaggcagacccagactgggcggcagcagacccagaaagatcgacaccatcgccgccgacgagagcttcacccagggcgacctgggcgagagaaagatgaagctgaacaccgaggtgagagagatcggccccctgagcagaagaggcttccacctggccttccaggacgtgggcgcctgcgtggccctggtgagcgtgagagtgtactacaagcagtgcagagccaccgtgagaggcctggccaccttccccgccaccgccgccgagagcgccttcagcaccctggtggaggtggccggcacctgcgtggcccacagcgagggcgagcccggcagcccccccagaatgcactgcggcgccgacggcgagtggctggtgcccgtgggcagatgcagctgcagcgccggcttccaggagagaggcgacttctgcgaggcctgcccccccggcttctacaaggtgagccccagaagacccctgtgcagcccctgccccgagcacagcagagccctggagaacgccagcaccttctgcgtgtgccaggacagctacgccagaagccccaccgacccccccagcgccagctgcaccagaccccccagcgcccccagagacctgcagtacagcctgagcagaagccccctggtgctgagactgagatggctgccccccgccgacagcggcggcagaagcgacgtgacctacagcctgctgtgcctgagatgcggcagagagggccccgccggcgcctgcgagccctgcggccccagagtggccttcctgcccagacaggccggcctgagagagagagccgccaccctgctgcacctgagacccggcgccagatacaccgtgagagtggccgccctgaacggcgtgagcggccccgccgccgccgccggcaccacctacgcccaggtgaccgtgagcaccggccccggcgccccctgggaggaggacgagatcagaagagacagagtggagccccagagcgtgagcctgagctggagagagcccatccccgccggcgcccccggcgccaacgacaccgagtacgagatcagatactacgagaagggccagagcgagcagacctacagcatggtgaagaccggcgcccccaccgtgaccgtgaccaacctgaagcccgccaccagatacgtgttccagatcagagccgccagccccggccccagctgggaggcccagagcttcaaccccagcatcgaggtgcagaccctgggcgaggccgccagcggcagcagagaccagagccccgccatcgtggtgaccgtggtgaccatcagcgccctgctggtgctgggcagcgtgatgagcgtgctggccatctggagaagaccctgcagctacggcaagggcggcggcgacgcccacgacgaggaggagctgtacttccacttcaaggtgcccaccagaagaaccttcctggacccccagagctgcggcgacctgctgcaggccgtgcacctgttcgccaaggagctggacgccaagagcgtgaccctggagagaagcctgggcggcggcagattcggcgagctgtgctgcggctgcctgcagctgcccggcagacaggagctgctggtggccgtgcacatgctgagagacagcgccagcgacagccagagactgggcttcctggccgaggccctgaccctgggccagttcgaccacagccacatcgtgagactggagggcgtggtgaccagaggcagcaccctgatgatcgtgaccgagtacatgagccacggcgccctggacggcttcctgagaagacacgagggccagctggtggccggccagctgatgggcctgctgcccggcctggccagcgccatgaagtacctgagcgagatgggctacgtgcacagaggcctggccgccagacacgtgctggtgagcagcgacctggtgtgcaagatcagcggcttcggcagaggccccagagacagaagcgaggccgtgtacaccaccatgagcggcagaagccccgccctgtgggccgcccccgagaccctgcagttcggccacttcagcagcgccagcgacgtgtggagcttcggcatcatcatgtgggaggtgatggccttcggcgagagaccctactgggacatgagcggccaggacgtgatcaaggccgtggaggacggcttcagactgcccccccccagaaactgccccaacctgctgcacagactgatgctggactgctggcagaaggaccccggcgagagacccagattcagccagatccacagcatcctgagcaagatggtgcaggaccccgagccccccaagtgcgccctgaccacctgccccagaccccccacccccctggccgacagagccttcagcaccttccccagcttcggcagcgtgggcgcctggctggaggccctggacctgtgcagatacaaggacagcttcgccgccgccggctacggcagcctggaggccgtggccgagatgaccgcccaggacctggtgagcctgggcatcagcctggccgagcacagagaggccctgctgagcggcatcagcgccctgcaggccagagtgctgcagctgcagggccagggcgtgcaggtgtag

SEQ ID NO: 80474 - DNA, 3045 bp, Artificial Sequence
  Description of Artificial Sequence: Synthetic coding sequence
atggagacctgcgccggcccccaccccctgagactgttcctgtgcagaatgcagctgtgcctggccctgctgctgggcccctggagacccggcaccgccgaggaggtgatcctgctggacagcaaggccagccaggccgagctgggctggaccgccctgcccagcaacggctgggaggagatcagcggcgtggacgagcacgacagacccatcagaacctaccaggtgtgcaacgtgctggagcccaaccaggacaactggctgcagaccggctggatcagcagaggcagaggccagagaatcttcgtggagctgcagttcaccctgagagactgcagcagcatccccggcgccgccggcacctgcaaggagaccttcaacgtgtactacctggagaccgaggccgacctgggcagaggcagacccagactgggcggcagcagacccagaaagatcgacaccatcgccgccgacgagagcttcacccagggcgacctgggcgagagaaagatgaagctgaacaccgaggtgagagagatcggccccctgagcagaagaggcttccacctggccttccaggacgtgggcgcctgcgtggccctggtgagcgtgagagtgtactacaagcagtgcagagccaccgtgagaggcctggccaccttccccgccaccgccgccgagagcgccttcagcaccctggtggaggtggccggcacctgcgtggcccacagcgagggcgagcccggcagcccccccagaatgcactgcggcgccgacggcgagtggctggtgcccgtgggcagatgcagctgcagcgccggcttccaggagagaggcgacttctgcgaggcctgcccccccggcttctacaaggtgagccccagaagacccctgtgcagcccctgccccgagcacagcagagccctggagaacgccagcaccttctgcgtgtgccaggacagctacgccagaagccccaccgacccccccagcgccagctgcaccagaccccccagcgcccccagagacctgcagtacagcctgagcagaagccccctggtgctgagactgagatggctgccccccgccgacagcggcggcagaagcgacgtgacctacagcctgctgtgcctgagatgcggcagagagggccccgccggcgcctgcgagccctgcggccccagagtggccttcctgcccagacaggccggcctgagagagagagccgccaccctgctgcacctgagacccggcgccagatacaccgtgagagtggccgccctgaacggcgtgagcggccccgccgccgccgccggcaccacctacgcccaggtgaccgtgagcaccggccccggcgccccctgggaggaggacgagatcagaagagacagagtggagccccagagcgtgagcctgagctggagagagcccatccccgccggcgcccccggcgccaacgacaccgagtacgagatcagatactacgagaagggccagagcgagcagacctacagcatggtgaagaccggcgcccccaccgtgaccgtgaccaacctgaagcccgccaccagatacgtgttccagatcagagccgccagccccggccccagctgggaggcccagagcttcaaccccagcatcgaggtgcagaccctgggcgaggccgccagcggcagcagagaccagagccccgccatcgtggtgaccgtggtgaccatcagcgccctgctggtgctgggcagcgtgatgagcgtgctggccatctggagaagaccctgcagctacggcaagggcggcggcgacgcccacgacgaggaggagctgtacttccacttcaaggtgcccaccagaagaaccttcctggacccccagagctgcggcgacctgctgcaggccgtgcacctgttcgccaaggagctggacgccaagagcgtgaccctggagagaagcctgggcggcggcagattcggcgagctgtgctgcggctgcctgcagctgcccggcagacaggagctgctggtggccgtgcacatgctgagagacagcgccagcgacagccagagactgggcttcctggccgaggccctgaccctgggccagttcgaccacagccacatcgtgagactggagggcgtggtgaccagaggcagcaccctgatgatcgtgaccgagtacatgagccacggcgccctggacggcttcctgagaagacacgagggccagctggtggccggccagctgatgggcctgctgcccggcctggccagcgccatgaagtacctgagcgagatgggctacgtgcacagaggcctggccgccagacacgtgctggtgagcagcgacctggtgtgcaagatcagcggcttcggcagaggccccagagacagaagcgaggccgtgtacaccaccatgagcggcagaagccccgccctgtgggccgcccccgagaccctgcagttcggccacttcagcagcgccagcgacgtgtggagcttcggcatcatcatgtgggaggtgatggccttcggcgagagaccctactgggacatgagcggccaggacgtgatcaaggccgtggaggacggcttcagactgcccccccccagaaactgccccaacctgctgcacagactgatgctggactgctggcagaaggaccccggcgagagacccagattcagccagatccacagcatcctgagcaagatggtgcaggaccccgagccccccaagtgcgccctgaccacctgccccagaccccccacccccctggccgacagagccttcagcaccttccccagcttcggcagcgtgggcgcctggctggaggccctggacctgtgcagatacaaggacagcttcgccgccgccggctacggcagcctggaggccgtggccgagatgaccgcccaggacctggtgagcctgggcatcagcctggccgagcacagagaggccctgctgagcggcatcagcgccctgcaggccagagtgctgcagctgcagggccagggcgtgcaggtgatcatcaagacctgcctgtag

SEQ ID NO: 80475 - DNA, 468 bp, Artificial Sequence
  Description of Artificial Sequence: Synthetic coding sequence
atggtgaagaccggcgcccccaccgtgaccgtgaccaacctgaagcccgccaccagatacgtgttccagatcagagccgccagccccggccccagctgggaggcccagagcttcaaccccagcatcgaggtgcagaccctgggcgaggccgccagcggcagcagagaccagagccccgccatcgtggtgaccgtggtgaccatcagcgccctgctggtgctgggcagcgtgatgagcgtgctggccatctggagaagaccctgcagctacggcaagggcggcggcgacgcccacgacgaggaggagctgtacttccacttcaaggtgcccaccagaagaaccttcctggacccccagagctgcggcgacctgctgcaggccgtgcacctgttcgccaaggagctggacgccaagagcgtgaccctggagagaagcctgggcggcggcctggagaccagcccccactag

SEQ ID NO: 80476 - DNA, 2931 bp, Artificial Sequence
  Description of Artificial Sequence: Synthetic coding sequence
atggagctgcaggccgccagagcctgcttcgccctgctgtggggctgcgccctggccgccgccgccgccgcccagggcaaggaggtggtgctgctggacttcgccgccgccggcggcgagctgggctggctgacccacccctacggcaagggctgggacctgatgcagaacatcatgaacgacatgcccatctacatgtacagcgtgtgcaacgtgatgagcggcgaccaggacaactggctgagaaccaactgggtgtacagaggcgaggccgagagaatcttcatcgagctgaagttcaccgtgagagactgcaacagcttccccggcggcgccagcagctgcaaggagaccttcaacctgtactacgccgagagcgacctggactacggcaccaacttccagaagagactgttcaccaagatcgacaccatcgcccccgacgagatcaccgtgagcagcgacttcgaggccagacacgtgaagctgaacgtggaggagagaagcgtgggccccctgaccagaaagggcttctacctggccttccaggacatcggcgcctgcgtggccctgctgagcgtgagagtgtactacaagaagtgccccgagctgctgcagggcctggcccacttccccgagaccatcgccggcagcgacgcccccagcctggccaccgtggccggcacctgcgtggaccacgccgtggtgccccccggcggcgaggagcccagaatgcactgcgccgtggacggcgagtggctggtgcccatcggccagtgcctgtgccaggccggctacgagaaggtggaggacgcctgccaggcctgcagccccggcttcttcaagttcgaggccagcgagagcccctgcctggagtgccccgagcacaccctgcccagccccgagggcgccaccagctgcgagtgcgaggagggcttcttcagagccccccaggaccccgccagcatgccctgcaccagaccccccagcgccccccactacctgaccgccgtgggcatgggcgccaaggtggagctgagatggacccccccccaggacagcggcggcagagaggacatcgtgtacagcgtgacctgcgagcagtgctggcccgagagcggcgagtgcggcccctgcgaggccagcgtgagatacagcgagcccccccacggcctgaccagaaccagcgtgaccgtgagcgacctggagccccacatgaactacaccttcaccgtggaggccagaaacggcgtgagcggcctggtgaccagcagaagcttcagaaccgccagcgtgagcatcaaccagaccgagccccccaaggtgagactggagggcagaagcaccaccagcctgagcgtgagctggagcatcccccccccccagcagagcagagtgtggaagtacgaggtgacctacagaaagaagggcgacagcaacagctacaacgtgagaagaaccgagggcttcagcgtgaccctggacgacctggcccccgacaccacctacctggtgcaggtgcaggccctgacccaggagggccagggcgccggcagcaaggtgcacgagttccagaccctgagccccgagggcagcggcaacctggccgtgatcggcggcgtggccgtgggcgtggtgctgctgctggtgctggccggcgtgggcttcttcatccacagaagaagaaagaaccagagagccagacagagccccgaggacgtgtacttcagcaagagcgagcagctgaagcccctgaagacctacgtggacccccacacctacgaggaccccaaccaggccgtgctgaagttcaccaccgagatccaccccagctgcgtgaccagacagaaggtgatcggcgccggcgagttcggcgaggtgtacaagggcatgctgaagaccagcagcggcaagaaggaggtgcccgtggccatcaagaccctgaaggccggctacaccgagaagcagagagtggacttcctgggcgaggccggcatcatgggccagttcagccaccacaacatcatcagactggagggcgtgatcagcaagtacaagcccatgatgatcatcaccgagtacatggagaacggcgccctggacaagttcctgagagagaaggacggcgagttcagcgtgctgcagctggtgggcatgctgagaggcatcgccgccggcatgaagtacctggccaacatgaactacgtgcacagagacctggccgccagaaacatcctggtgaacagcaacctggtgtgcaaggtgagcgacttcggcctgagcagagtgctggaggacgaccccgaggccacctacaccaccagcggcggcaagatccccatcagatggaccgcccccgaggccatcagctacagaaagttcaccagcgccagcgacgtgtggagcttcggcatcgtgatgtgggaggtgatgacctacggcgagagaccctactgggagctgagcaaccacgaggtgatgaaggccatcaacgacggcttcagactgcccacccccatggactgccccagcgccatctaccagctgatgatgcagtgctggcagcaggagagagccagaagacccaagttcgccgacatcgtgagcatcctggacaagctgatcagagcccccgacagcctgaagaccctggccgacttcgaccccagagtgagcatcagactgcccagcaccagcggcagcgagggcgtgcccttcagaaccgtgagcgagtggctggagagcatcaagatgcagcagtacaccgagcacttcatggccgccggctacaccgccatcgagaaggtggtgcagatgaccaacgacgacatcaagagaatcggcgtgagactgcccggccaccagaagagaatcgcctacagcctgctgggcctgaaggaccaggtgaacaccgtgggcatccccatctag

SEQ ID NO: 80477 - DNA, 2952 bp, Artificial Sequence
  Description of Artificial Sequence: Synthetic coding sequence
atggactgccagctgagcatcctgctgctgctgagctgcagcgtgctggacagcttcggcgagctgatcccccagcccagcaacgaggtgaacctgctggacagcaagaccatccagggcgagctgggctggatcagctaccccagccacggctgggaggagatcagcggcgtggacgagcactacacccccatcagaacctaccaggtgtgcaacgtgatggaccacagccagaacaactggctgagaaccaactgggtgcccagaaacagcgcccagaagatctacgtggagctgaagttcaccctgagagactgcaacagcatccccctggtgctgggcacctgcaaggagaccttcaacctgtactacatggagagcgacgacgaccacggcgtgaagttcagagagcaccagttcaccaagatcgacaccatcgccgccgacgagagcttcacccagatggacctgggcgacagaatcctgaagctgaacaccgagatcagagaggtgggccccgtgaacaagaagggcttctacctggccttccaggacgtgggcgcctgcgtggccctggtgagcgtgagagtgtacttcaagaagtgccccttcaccgtgaagaacctggccatgttccccgacaccgtgcccatggacagccagagcctggtggaggtgagaggcagctgcgtgaacaacagcaaggaggaggacccccccagaatgtactgcagcaccgagggcgagtggctggtgcccatcggcaagtgcagctgcaacgccggctacgaggagagaggcttcatgtgccaggcctgcagacccggcttctacaaggccctggacggcaacatgaagtgcgccaagtgccccccccacagcagcacccaggaggacggcagcatgaactgcagatgcgagaacaactacttcagagccgacaaggacccccccagcatggcctgcaccagaccccccagcagccccagaaacgtgatcagcaacatcaacgagaccagcgtgatcctggactggagctggcccctggacaccggcggcagaaaggacgtgaccttcaacatcatctgcaagaagtgcggctggaacatcaagcagtgcgagccctgcagccccaacgtgagattcctgcccagacagttcggcctgaccaacaccaccgtgaccgtgaccgacctgctggcccacaccaactacaccttcgagatcgacgccgtgaacggcgtgagcgagctgagcagcccccccagacagttcgccgccgtgagcatcaccaccaaccaggccgcccccagccccgtgctgaccatcaagaaggacagaaccagcagaaacagcatcagcctgagctggcaggagcccgagcaccccaacggcatcatcctggactacgaggtgaagtactacgagaagcaggagcaggagaccagctacaccatcctgagagccagaggcaccaacgtgaccatcagcagcctgaagcccgacaccatctacgtgttccagatcagagccagaaccgccgccggctacggcaccaacagcagaaagttcgagttcgagaccagccccgacagcttcagcatcagcggcgagagcagccaggtggtgatgatcgccatcagcgccgccgtggccatcatcctgctgaccgtggtgatctacgtgctgatcggcagattctgcggctacaagagcaagcacggcgccgacgagaagagactgcacttcggcaacggccacctgaagctgcccggcctgagaacctacgtggacccccacacctacgaggaccccacccaggccgtgcacgagttcgccaaggagctggacgccaccaacatcagcatcgacaaggtggtgggcgccggcgagttcggcgaggtgtgcagcggcagactgaagctgcccagcaagaaggagatcagcgtggccatcaagaccctgaaggtgggctacaccgagaagcagagaagagacttcctgggcgaggccagcatcatgggccagttcgaccaccccaacatcatcagactggagggcgtggtgaccaagagcaagcccgtgatgatcgtgaccgagtacatggagaacggcagcctggacagcttcctgagaaagcacgacgcccagttcaccgtgatccagctggtgggcatgctgagaggcatcgccagcggcatgaagtacctgagcgacatgggctacgtgcacagagacctggccgccagaaacatcctgatcaacagcaacctggtgtgcaaggtgagcgacttcggcctgagcagagtgctggaggacgaccccgaggccgcctacaccaccagaggcggcaagatccccatcagatggaccagccccgaggccatcgcctacagaaagttcaccagcgccagcgacgtgtggagctacggcatcgtgctgtgggaggtgatgagctacggcgagagaccctactgggagatgagcaaccaggacgtgatcaaggccgtggacgagggctacagactgcccccccccatggactgccccgccgccctgtaccagctgatgctggactgctggcagaaggacagaaacaacagacccaagttcgagcagatcgtgagcatcctggacaagctgatcagaaaccccggcagcctgaagatcatcaccagcgccgccgccagacccagcaacctgctgctggaccagagcaacgtggacatcaccaccttcagaaccaccggcgactggctgaacggcgtgtggaccgcccactgcaaggagatcttcaccggcgtggagtacagcagctgcgacaccatcgccaagatcagcaccgacgacatgaagaaggtgggcgtgaccgtggtgggcccccagaagaagatcatcagcagcatcaaggccctggagacccagagcaagaacggccccgtgcccgtgtag

SEQ ID NO: 80478 - DNA, 1620 bp, Artificial Sequence
  Description of Artificial Sequence: Synthetic coding sequence
atggactgccagctgagcatcctgctgctgctgagctgcagcgtgctggacagcttcggcgagctgatcccccagcccagcaacgaggtgaacctgctggacagcaagaccatccagggcgagctgggctggatcagctaccccagccacggctgggaggagatcagcggcgtggacgagcactacacccccatcagaacctaccaggtgtgcaacgtgatggaccacagccagaacaactggctgagaaccaactgggtgcccagaaacagcgcccagaagatctacgtggagctgaagttcaccctgagagactgcaacagcatccccctggtgctgggcacctgcaaggagaccttcaacctgtactacatggagagcgacgacgaccacggcgtgaagttcagagagcaccagttcaccaagatcgacaccatcgccgccgacgagagcttcacccagatggacctgggcgacagaatcctgaagctgaacaccgagatcagagaggtgggccccgtgaacaagaagggcttctacctggccttccaggacgtgggcgcctgcgtggccctggtgagcgtgagagtgtacttcaagaagtgccccttcaccgtgaagaacctggccatgttccccgacaccgtgcccatggacagccagagcctggtggaggtgagaggcagctgcgtgaacaacagcaaggaggaggacccccccagaatgtactgcagcaccgagggcgagtggctggtgcccatcggcaagtgcagctgcaacgccggctacgaggagagaggcttcatgtgccaggcctgcagacccggcttctacaaggccctggacggcaacatgaagtgcgccaagtgccccccccacagcagcacccaggaggacggcagcatgaactgcagatgcgagaacaactacttcagagccgacaaggacccccccagcatggcctgcaccagaccccccagcagccccagaaacgtgatcagcaacatcaacgagaccagcgtgatcctggactggagctggcccctggacaccggcggcagaaaggacgtgaccttcaacatcatctgcaagaagtgcggctggaacatcaagcagtgcgagccctgcagccccaacgtgagattcctgcccagacagttcggcctgaccaacaccaccgtgaccgtgaccgacctgctggcccacaccaactacaccttcgagatcgacgccgtgaacggcgtgagcgagctgagcagcccccccagacagttcgccgccgtgagcatcaccaccaaccaggccgcccccagccccgtgctgaccatcaagaaggacagaaccagcagaaacagcatcagcctgagctggcaggagcccgagcaccccaacggcatcatcctggactacgaggtgaagtactacgagaagcaggagcaggagaccagctacaccatcctgagagccagaggcaccaacgtgaccatcagcagcctgaagcccgacaccatctacgtgttccagatcagagccagaaccgccgccggctacggcaccaacagcagaaagttcgagttcgagaccagccccgactgcatgtactacttcaacgccgtgtag

SEQ ID NO: 80479 - DNA, 3114 bp, Artificial Sequence
  Description of Artificial Sequence: Synthetic coding sequence
atgagaggcagcggccccagaggcgccggcagaagaagaccccccagcggcggcggcgacacccccatcacccccgccagcctggccggctgctacagcgcccccagaagagcccccctgtggacctgcctgctgctgtgcgccgccctgagaaccctgctggccagccccagcaacgaggtgaacctgctggacagcagaaccgtgatgggcgacctgggctggatcgccttccccaagaacggctgggaggagatcggcgaggtggacgagaactacgcccccatccacacctaccaggtgtgcaaggtgatggagcagaaccagaacaactggctgctgaccagctggatcagcaacgagggcgccagcagaatcttcatcgagctgaagttcaccctgagagactgcaacagcctgcccggcggcctgggcacctgcaaggagaccttcaacatgtactacttcgagagcgacgaccagaacggcagaaacatcaaggagaaccagtacatcaagatcgacaccatcgccgccgacgagagcttcaccgagctggacctgggcgacagagtgatgaagctgaacaccgaggtgagagacgtgggccccctgagcaagaagggcttctacctggccttccaggacgtgggcgcctgcatcgccctggtgagcgtgagagtgtactacaagaagtgccccagcgtggtgagacacctggccgtgttccccgacaccatcaccggcgccgacagcagccagctgctggaggtgagcggcagctgcgtgaaccacagcgtgaccgacgagccccccaagatgcactgcagcgccgagggcgagtggctggtgcccatcggcaagtgcatgtgcaaggccggctacgaggagaagaacggcacctgccaggtgtgcagacccggcttcttcaaggccagcccccacatccagagctgcggcaagtgccccccccacagctacacccacgaggaggccagcaccagctgcgtgtgcgagaaggactacttcagaagagagagcgacccccccaccatggcctgcaccagaccccccagcgcccccagaaacgccatcagcaacgtgaacgagaccagcgtgttcctggagtggatcccccccgccgacaccggcggcagaaaggacgtgagctactacatcgcctgcaagaagtgcaacagccacgccggcgtgtgcgaggagtgcggcggccacgtgagatacctgcccagacagagcggcctgaagaacaccagcgtgatgatggtggacctgctggcccacaccaactacaccttcgagatcgaggccgtgaacggcgtgagcgacctgagccccggcgccagacagtacgtgagcgtgaacgtgaccaccaaccaggccgcccccagccccgtgaccaacgtgaagaagggcaagatcgccaagaacagcatcagcctgagctggcaggagcccgacagacccaacggcatcatcctggagtacgagatcaagtacttcgagaaggaccaggagaccagctacaccatcatcaagagcaaggagaccaccatcaccgccgagggcctgaagcccgccagcgtgtacgtgttccagatcagagccagaaccgccgccggctacggcgtgttcagcagaagattcgagttcgagaccacccccgtgttcgccgccagcagcgaccagagccagatccccgtgatcgccgtgagcgtgaccgtgggcgtgatcctgctggccgtggtgatcggcgtgctgctgagcggcagctgctgcgagtgcggctgcggcagagccagcagcctgtgcgccgtggcccaccccagcctgatctggagatgcggctacagcaaggccaagcaggaccccgaggaggagaagatgcacttccacaacggccacatcaagctgcccggcgtgagaacctacatcgacccccacacctacgaggaccccaaccaggccgtgcacgagttcgccaaggagatcgaggccagctgcatcaccatcgagagagtgatcggcgccggcgagttcggcgaggtgtgcagcggcagactgaagctgcccggcaagagagagctgcccgtggccatcaagaccctgaaggtgggctacaccgagaagcagagaagagacttcctgggcgaggccagcatcatgggccagttcgaccaccccaacatcatccacctggagggcgtggtgaccaagagcaagcccgtgatgatcgtgaccgagtacatggagaacggcagcctggacaccttcctgaagaagaacgacggccagttcaccgtgatccagctggtgggcatgctgagaggcatcagcgccggcatgaagtacctgagcgacatgggctacgtgcacagagacctggccgccagaaacatcctgatcaacagcaacctggtgtgcaaggtgagcgacttcggcctgagcagagtgctggaggacgaccccgaggccgcctacaccaccagaggcggcaagatccccatcagatggaccgcccccgaggccatcgccttcagaaagttcaccagcgccagcgacgtgtggagctacggcatcgtgatgtgggaggtggtgagctacggcgagagaccctactgggagatgaccaaccaggacgtgatcaaggccgtggaggagggctacagactgcccagccccatggactgccccgccgccctgtaccagctgatgctggactgctggcagaaggagagaaacagcagacccaagttcgacgagatcgtgaacatgctggacaagctgatcagaaaccccagcagcctgaagaccctggtgaacgccagctgcagagtgagcaacctgctggccgagcacagccccctgggcagcggcgcctacagaagcgtgggcgagtggctggaggccatcaagatgggcagatacaccgagatcttcatggagaacggctacagcagcatggacgccgtggcccaggtgaccctggaggacctgagaagactgggcgtgaccctggtgggccaccagaagaagatcatgaacagcctgcaggagatgaaggtgcagctggtgaacggcatggtgcccctgtag

SEQ ID NO: 80480 - DNA, 3048 bp, Artificial Sequence
  Description of Artificial Sequence: Synthetic coding sequence
atgagaggcagcggccccagaggcgccggcagaagaagaccccccagcggcggcggcgacacccccatcacccccgccagcctggccggctgctacagcgcccccagaagagcccccctgtggacctgcctgctgctgtgcgccgccctgagaaccctgctggccagccccagcaacgaggtgaacctgctggacagcagaaccgtgatgggcgacctgggctggatcgccttccccaagaacggctgggaggagatcggcgaggtggacgagaactacgcccccatccacacctaccaggtgtgcaaggtgatggagcagaaccagaacaactggctgctgaccagctggatcagcaacgagggcgccagcagaatcttcatcgagctgaagttcaccctgagagactgcaacagcctgcccggcggcctgggcacctgcaaggagaccttcaacatgtactacttcgagagcgacgaccagaacggcagaaacatcaaggagaaccagtacatcaagatcgacaccatcgccgccgacgagagcttcaccgagctggacctgggcgacagagtgatgaagctgaacaccgaggtgagagacgtgggccccctgagcaagaagggcttctacctggccttccaggacgtgggcgcctgcatcgccctggtgagcgtgagagtgtactacaagaagtgccccagcgtggtgagacacctggccgtgttccccgacaccatcaccggcgccgacagcagccagctgctggaggtgagcggcagctgcgtgaaccacagcgtgaccgacgagccccccaagatgcactgcagcgccgagggcgagtggctggtgcccatcggcaagtgcatgtgcaaggccggctacgaggagaagaacggcacctgccaggtgtgcagacccggcttcttcaaggccagcccccacatccagagctgcggcaagtgccccccccacagctacacccacgaggaggccagcaccagctgcgtgtgcgagaaggactacttcagaagagagagcgacccccccaccatggcctgcaccagaccccccagcgcccccagaaacgccatcagcaacgtgaacgagaccagcgtgttcctggagtggatcccccccgccgacaccggcggcagaaaggacgtgagctactacatcgcctgcaagaagtgcaacagccacgccggcgtgtgcgaggagtgcggcggccacgtgagatacctgcccagacagagcggcctgaagaacaccagcgtgatgatggtggacctgctggcccacaccaactacaccttcgagatcgaggccgtgaacggcgtgagcgacctgagccccggcgccagacagtacgtgagcgtgaacgtgaccaccaaccaggccgcccccagccccgtgaccaacgtgaagaagggcaagatcgccaagaacagcatcagcctgagctggcaggagcccgacagacccaacggcatcatcctggagtacgagatcaagtacttcgagaaggaccaggagaccagctacaccatcatcaagagcaaggagaccaccatcaccgccgagggcctgaagcccgccagcgtgtacgtgttccagatcagagccagaaccgccgccggctacggcgtgttcagcagaagattcgagttcgagaccacccccgtgttcgccgccagcagcgaccagagccagatccccgtgatcgccgtgagcgtgaccgtgggcgtgatcctgctggccgtggtgatcggcgtgctgctgagcggcagaagatgcggctacagcaaggccaagcaggaccccgaggaggagaagatgcacttccacaacggccacatcaagctgcccggcgtgagaacctacatcgacccccacacctacgaggaccccaaccaggccgtgcacgagttcgccaaggagatcgaggccagctgcatcaccatcgagagagtgatcggcgccggcgagttcggcgaggtgtgcagcggcagactgaagctgcccggcaagagagagctgcccgtggccatcaagaccctgaaggtgggctacaccgagaagcagagaagagacttcctgggcgaggccagcatcatgggccagttcgaccaccccaacatcatccacctggagggcgtggtgaccaagagcaagcccgtgatgatcgtgaccgagtacatggagaacggcagcctggacaccttcctgaagaagaacgacggccagttcaccgtgatccagctggtgggcatgctgagaggcatcagcgccggcatgaagtacctgagcgacatgggctacgtgcacagagacctggccgccagaaacatcctgatcaacagcaacctggtgtgcaaggtgagcgacttcggcctgagcagagtgctggaggacgaccccgaggccgcctacaccaccagaggcggcaagatccccatcagatggaccgcccccgaggccatcgccttcagaaagttcaccagcgccagcgacgtgtggagctacggcatcgtgatgtgggaggtggtgagctacggcgagagaccctactgggagatgaccaaccaggacgtgatcaaggccgtggaggagggctacagactgcccagccccatggactgccccgccgccctgtaccagctgatgctggactgctggcagaaggagagaaacagcagacccaagttcgacgagatcgtgaacatgctggacaagctgatcagaaaccccagcagcctgaagaccctggtgaacgccagctgcagagtgagcaacctgctggccgagcacagccccctgggcagcggcgcctacagaagcgtgggcgagtggctggaggccatcaagatgggcagatacaccgagatcttcatggagaacggctacagcagcatggacgccgtggcccaggtgaccctggaggacctgagaagactgggcgtgaccctggtgggccaccagaagaagatcatgaacagcctgcaggagatgaaggtgcagctggtgaacggcatggtgcccctgtag

SEQ ID NO: 80481 - DNA, 3015 bp, Artificial Sequence
  Description of Artificial Sequence: Synthetic coding sequence
atgagaggcagcggccccagaggcgccggcagaagaagaccccccagcggcggcggcgacacccccatcacccccgccagcctggccggctgctacagcgcccccagaagagcccccctgtggacctgcctgctgctgtgcgccgccctgagaaccctgctggccagccccagcaacgaggtgaacctgctggacagcagaaccgtgatgggcgacctgggctggatcgccttccccaagaacggctgggaggagatcggcgaggtggacgagaactacgcccccatccacacctaccaggtgtgcaaggtgatggagcagaaccagaacaactggctgctgaccagctggatcagcaacgagggcgccagcagaatcttcatcgagctgaagttcaccctgagagactgcaacagcctgcccggcggcctgggcacctgcaaggagaccttcaacatgtactacttcgagagcgacgaccagaacggcagaaacatcaaggagaaccagtacatcaagatcgacaccatcgccgccgacgagagcttcaccgagctggacctgggcgacagagtgatgaagctgaacaccgaggtgagagacgtgggccccctgagcaagaagggcttctacctggccttccaggacgtgggcgcctgcatcgccctggtgagcgtgagagtgtactacaagaagtgccccagcgtggtgagacacctggccgtgttccccgacaccatcaccggcgccgacagcagccagctgctggaggtgagcggcagctgcgtgaaccacagcgtgaccgacgagccccccaagatgcactgcagcgccgagggcgagtggctggtgcccatcggcaagtgcatgtgcaaggccggctacgaggagaagaacggcacctgccaggtgtgcagacccggcttcttcaaggccagcccccacatccagagctgcggcaagtgccccccccacagctacacccacgaggaggccagcaccagctgcgtgtgcgagaaggactacttcagaagagagagcgacccccccaccatggcctgcaccagaccccccagcgcccccagaaacgccatcagcaacgtgaacgagaccagcgtgttcctggagtggatcccccccgccgacaccggcggcagaaaggacgtgagctactacatcgcctgcaagaagtgcaacagccacgccggcgtgtgcgaggagtgcggcggccacgtgagatacctgcccagacagagcggcctgaagaacaccagcgtgatgatggtggacctgctggcccacaccaactacaccttcgagatcgaggccgtgaacggcgtgagcgacctgagccccggcgccagacagtacgtgagcgtgaacgtgaccaccaaccaggccgcccccagccccgtgaccaacgtgaagaagggcaagatcgccaagaacagcatcagcctgagctggcaggagcccgacagacccaacggcatcatcctggagtacgagatcaagtacttcgagaaggaccaggagaccagctacaccatcatcaagagcaaggagaccaccatcaccgccgagggcctgaagcccgccagcgtgtacgtgttccagatcagagccagaaccgccgccggctacggcgtgttcagcagaagattcgagttcgagaccacccccgtgagcgtggccgccagcagcgaccagagccagatccccgtgatcgccgtgagcgtgaccgtgggcgtgatcctgctggccgtggtgatcggcgtgctgctgagcggcagctgctgcgagtgcggctgcggcagagccagcagcctgtgcgccgtggcccaccccagcctgatctggagatgcggctacagcaaggccaagcaggaccccgaggaggagaagatgcacttccacaacggccacatcaagctgcccggcgtgagaacctacatcgacccccacacctacgaggaccccaaccaggccgtgcacgagttcgccaaggagatcgaggccagctgcatcaccatcgagagagtgatcggcgccggcgagttcggcgaggtgtgcagcggcagactgaagctgcccggcaagagagagctgcccgtggccatcaagaccctgaaggtgggctacaccgagaagcagagaagagacttcctgggcgaggccagcatcatgggccagttcgaccaccccaacatcatccacctggagggcgtggtgaccaagagcaagcccgtgatgatcgtgaccgagtacatggagaacggcagcctggacaccttcctgaagaagaacgacggccagttcaccgtgatccagctggtgggcatgctgagaggcatcagcgccggcatgaagtacctgagcgacatgggctacgtgcacagagacctggccgccagaaacatcctgatcaacagcaacctggtgtgcaaggtgagcgacttcggcctgagcagagtgctggaggacgaccccgaggccgcctacaccaccagaggcggcaagatccccatcagatggaccgcccccgaggccatcgccttcagaaagttcaccagcgccagcgacgtgtggagctacggcatcgtgatgtgggaggtggtgagctacggcgagagaccctactgggagatgaccaaccaggacgtgatcaaggccgtggaggagggctacagactgcccagccccatggactgccccgccgccctgtaccagctgatgctggactgctggcagaaggagagaaacagcagacccaagttcgacgagatcgtgaacatgctggacaagctgatcagaaaccccagcagcctgaagaccctggtgaacgccagctgcagagtgagcaacctgctggccgagcacagccccctgggcagcggcgcctacagaagcgtgggcgagtggctggaggccatcaagatgggcagatacaccgagatcttcatggagaacggctacagcagcatggacgccgtggcccaggtgaccctggagtag

SEQ ID NO: 80482 - DNA, 3018 bp, Artificial Sequence
  Description of Artificial Sequence: Synthetic coding sequence
atggcccccgccagaggcagactgccccccgccctgtgggtggtgaccgccgccgccgccgccgccacctgcgtgagcgccgccagaggcgaggtgaacctgctggacaccagcaccatccacggcgactggggctggctgacctaccccgcccacggctgggacagcatcaacgaggtggacgagagcttccagcccatccacacctaccaggtgtgcaacgtgatgagccccaaccagaacaactggctgagaaccagctgggtgcccagagacggcgccagaagagtgtacgccgagatcaagttcaccctgagagactgcaacagcatgcccggcgtgctgggcacctgcaaggagaccttcaacctgtactacctggagagcgacagagacctgggcgccagcacccaggagagccagttcctgaagatcgacaccatcgccgccgacgagagcttcaccggcgccgacctgggcgtgagaagactgaagctgaacaccgaggtgagaagcgtgggccccctgagcaagagaggcttctacctggccttccaggacatcggcgcctgcctggccatcctgagcctgagaatctactacaagaagtgccccgccatggtgagaaacctggccgccttcagcgaggccgtgaccggcgccgacagcagcagcctggtggaggtgagaggccagtgcgtgagacacagcgaggagagagacacccccaagatgtactgcagcgccgagggcgagtggctggtgcccatcggcaagtgcgtgtgcagcgccggctacgaggagagaagagacgcctgcgtggcctgcgagctgggcttctacaagagcgcccccggcgaccagctgtgcgccagatgccccccccacagccacagcgccgcccccgccgcccaggcctgccactgcgacctgagctactacagagccgccctggacccccccagcagcgcctgcaccagaccccccagcgcccccgtgaacctgatcagcagcgtgaacggcaccagcgtgaccctggagtgggccccccccctggaccccggcggcagaagcgacatcacctacaacgccgtgtgcagaagatgcccctgggccctgagcagatgcgaggcctgcggcagcggcaccagattcgtgccccagcagaccagcctggtgcaggccagcctgctggtggccaacctgctggcccacatgaactacagcttctggatcgaggccgtgaacggcgtgagcgacctgagccccgagcccagaagagccgccgtggtgaacatcaccaccaaccaggccgcccccagccaggtggtggtgatcagacaggagagagccggccagaccagcgtgagcctgctgtggcaggagcccgagcagcccaacggcatcatcctggagtacgagatcaagtactacgagaaggacaaggagatgcagagctacagcaccctgaaggccgtgaccaccagagccaccgtgagcggcctgaagcccggcaccagatacgtgttccaggtgagagccagaaccagcgccggctgcggcagattcagccaggccatggaggtggagaccggcaagcccagacccagatacgacaccagaaccatcgtgtggatctgcctgaccctgatcaccggcctggtggtgctgctgctgctgctgatctgcaagaagagacactgcggctacagcaaggccttccaggacagcgacgaggagaagatgcactaccagaacggccaggcccccccccccgtgttcctgcccctgcaccacccccccggcaagctgcccgagccccagttctacgccgagccccacacctacgaggagcccggcagagccggcagaagcttcaccagagagatcgaggccagcagaatccacatcgagaagatcatcggcagcggcgacagcggcgaggtgtgctacggcagactgagagtgcccggccagagagacgtgcccgtggccatcaaggccctgaaggccggctacaccgagagacagagaagagacttcctgagcgaggccagcatcatgggccagttcgaccaccccaacatcatcagactggagggcgtggtgaccagaggcagactggccatgatcgtgaccgagtacatggagaacggcagcctggacaccttcctgagaacccacgacggccagttcaccatcatgcagctggtgggcatgctgagaggcgtgggcgccggcatgagatacctgagcgacctgggctacgtgcacagagacctggccgccagaaacgtgctggtggacagcaacctggtgtgcaaggtgagcgacttcggcctgagcagagtgctggaggacgaccccgacgccgcctacaccaccaccggcggcaagatccccatcagatggaccgcccccgaggccatcgccttcagaaccttcagcagcgccagcgacgtgtggagcttcggcgtggtgatgtgggaggtgctggcctacggcgagagaccctactggaacatgaccaacagagacgtgatcagcagcgtggaggagggctacagactgcccgcccccatgggctgcccccacgccctgcaccagctgatgctggactgctggcacaaggacagagcccagagacccagattcagccagatcgtgagcgtgctggacgccctgatcagaagccccgagagcctgagagccaccgccaccgtgagcagatgccccccccccgccttcgtgagaagctgcttcgacctgagaggcggcagcggcggcggcggcggcctgaccgtgggcgactggctggacagcatcagaatgggcagatacagagaccacttcgccgccggcggctacagcagcctgggcatggtgctgagaatgaacgcccaggacgtgagagccctgggcatcaccctgatgggccaccagaagaagatcctgggcagcatccagaccatgagagcccagctgaccagcacccagggccccagaagacacctgtag

SEQ ID NO: 80483 - DNA, 1488 bp, Artificial Sequence
  Description of Artificial Sequence: Synthetic coding sequence
atggcccccgccagaggcagactgccccccgccctgtgggtggtgaccgccgccgccgccgccgccacctgcgtgagcgccgccagaggcgaggtgaacctgctggacaccagcaccatccacggcgactggggctggctgacctaccccgcccacggctgggacagcatcaacgaggtggacgagagcttccagcccatccacacctaccaggtgtgcaacgtgatgagccccaaccagaacaactggctgagaaccagctgggtgcccagagacggcgccagaagagtgtacgccgagatcaagttcaccctgagagactgcaacagcatgcccggcgtgctgggcacctgcaaggagaccttcaacctgtactacctggagagcgacagagacctgggcgccagcacccaggagagccagttcctgaagatcgacaccatcgccgccgacgagagcttcaccggcgccgacctgggcgtgagaagactgaagctgaacaccgaggtgagaagcgtgggccccctgagcaagagaggcttctacctggccttccaggacatcggcgcctgcctggccatcctgagcctgagaatctactacaagaagtgccccgccatggtgagaaacctggccgccttcagcgaggccgtgaccggcgccgacagcagcagcctggtggaggtgagaggccagtgcgtgagacacagcgaggagagagacacccccaagatgtactgcagcgccgagggcgagtggctggtgcccatcggcaagtgcgtgtgcagcgccggctacgaggagagaagagacgcctgcgtggcctgcgagctgggcttctacaagagcgcccccggcgaccagctgtgcgccagatgccccccccacagccacagcgccgcccccgccgcccaggcctgccactgcgacctgagctactacagagccgccctggacccccccagcagcgcctgcaccagaccccccagcgcccccgtgaacctgatcagcagcgtgaacggcaccagcgtgaccctggagtgggccccccccctggaccccggcggcagaagcgacatcacctacaacgccgtgtgcagaagatgcccctgggccctgagcagatgcgaggcctgcggcagcggcaccagattcgtgccccagcagaccagcctggtgcaggccagcctgctggtggccaacctgctggcccacatgaactacagcttctggatcgaggccgtgaacggcgtgagcgacctgagccccgagcccagaagagccgccgtggtgaacatcaccaccaaccaggccggcagaagaagaaacagcgtgccccagagacccggcccccccgccagccccgccagcgaccccagcagagaccagagcagcgccggcgacgtgctgtgggccttcagacaggtgcccctgtggccctgcgccccccaccaggaccccgagctggaggccctgcactgcctgtag

SEQ ID NO: 80484 - DNA, 1488 bp, Artificial Sequence; identical to SEQ ID NO: 80483
  Description of Artificial Sequence: Synthetic coding sequence

SEQ ID NO: 80485 - DNA, 2955 bp, Artificial Sequence
  Description of Artificial Sequence: Synthetic coding sequence
atggccctggactacctgctgctgctgctgctggccagcgccgtggccgccatggaggagaccctgatggacaccagaaccgccaccgccgagctgggctggaccgccaaccccgccagcggctgggaggaggtgagcggctacgacgagaacctgaacaccatcagaacctaccaggtgtgcaacgtgttcgagcccaaccagaacaactggctgctgaccaccttcatcaacagaagaggcgcccacagaatctacaccgagatgagattcaccgtgagagactgcagcagcctgcccaacgtgcccggcagctgcaaggagaccttcaacctgtactactacgagaccgacagcgtgatcgccaccaagaagagcgccttctggagcgaggccccctacctgaaggtggacaccatcgccgccgacgagagcttcagccaggtggacttcggcggcagactgatgaaggtgaacaccgaggtgagaagcttcggccccctgaccagaaacggcttctacctggccttccaggactacggcgcctgcatgagcctgctgagcgtgagagtgttcttcaagaagtgccccagcatcgtgcagaacttcgccgtgttccccgagaccatgaccggcgccgagagcaccagcctggtgatcgccagaggcacctgcatccccaacgccgaggaggtggacgtgcccatcaagctgtactgcaacggcgacggcgagtggatggtgcccatcggcagatgcacctgcaagcccggctacgagcccgagaacagcgtggcctgcaaggcctgccccgccggcaccttcaaggccagccaggaggccgagggctgcagccactgccccagcaacagcagaagccccgccgaggccagccccatctgcacctgcagaaccggctactacagagccgacttcgacccccccgaggtggcctgcaccagcgtgcccagcggccccagaaacgtgatcagcatcgtgaacgagaccagcatcatcctggagtggcacccccccagagagaccggcggcagagacgacgtgacctacaacatcatctgcaagaagtgcagagccgacagaagaagctgcagcagatgcgacgacaacgtggagttcgtgcccagacagctgggcctgaccgagtgcagagtgagcatcagcagcctgtgggcccacaccccctacaccttcgacatccaggccatcaacggcgtgagcagcaagagccccttccccccccagcacgtgagcgtgaacatcaccaccaaccaggccgcccccagcaccgtgcccatcatgcaccaggtgagcgccaccatgagaagcatcaccctgagctggccccagcccgagcagcccaacggcatcatcctggactacgagatcagatactacgagaaggagcacaacgagttcaacagcagcatggccagaagccagaccaacaccgccagaatcgacggcctgagacccggcatggtgtacgtggtgcaggtgagagccagaaccgtggccggctacggcaagttcagcggcaagatgtgcttccagaccctgaccgacgacgactacaagagcgagctgagagagcagctgcccctgatcgccggcagcgccgccgccggcgtggtgttcgtggtgagcctggtggccatcagcatcgtgtgcagcagaaagagagcctacagcaaggaggccgtgtacagcgacaagctgcagcactacagcaccggcagaggcagccccggcatgaagatctacatcgaccccttcacctacgaggaccccaacgaggccgtgagagagttcgccaaggagatcgacgtgagcttcgtgaagatcgaggaggtgatcggcgccggcgagttcggcgaggtgtacaagggcagactgaagctgcccggcaagagagagatctacgtggccatcaagaccctgaaggccggctacagcgagaagcagagaagagacttcctgagcgaggccagcatcatgggccagttcgaccaccccaacatcatcagactggagggcgtggtgaccaagagcagacccgtgatgatcatcaccgagttcatggagaacggcgccctggacagcttcctgagacagaacgacggccagttcaccgtgatccagctggtgggcatgctgagaggcatcgccgccggcatgaagtacctggccgagatgaactacgtgcacagagacctggccgccagaaacatcctggtgaacagcaacctggtgtgcaaggtgagcgacttcggcctgagcagatacctgcaggacgacaccagcgaccccacctacaccagcagcctgggcggcaagatccccgtgagatggaccgcccccgaggccatcgcctacagaaagttcaccagcgccagcgacgtgtggagctacggcatcgtgatgtgggaggtgatgagcttcggcgagagaccctactgggacatgagcaaccaggacgtgatcaacgccatcgagcaggactacagactgcccccccccatggactgccccgccgccctgcaccagctgatgctggactgctggcagaaggacagaaacagcagacccagattcgccgagatcgtgaacaccctggacaagatgatcagaaaccccgccagcctgaagaccgtggccaccatcaccgccgtgcccagccagcccctgctggacagaagcatccccgacttcaccgccttcaccaccgtggacgactggctgagcgccatcaagatggtgcagtacagagacagcttcctgaccgccggcttcaccagcctgcagctggtgacccagatgaccagcgaggacctgctgagaatcggcatcaccctggccggccaccagaagaagatcctgaacagcatccacagcatgagagtgcagatcagccagagccccaccgccatggcctag

SEQ ID NO: 80486 - DNA, 1638 bp, Artificial Sequence
  Description of Artificial Sequence: Synthetic coding sequence
atgcaccaggtgagcgccaccatgagaagcatcaccctgagctggccccagcccgagcagcccaacggcatcatcctggactacgagatcagatactacgagaaggagcacaacgagttcaacagcagcatggccagaagccagaccaacaccgccagaatcgacggcctgagacccggcatggtgtacgtggtgcaggtgagagccagaaccgtggccggctacggcaagttcagcggcaagatgtgcttccagaccctgaccgacgacgactacaagagcgagctgagagagcagctgcccctgatcgccggcagcgccgccgccggcgtggtgttcgtggtgagcctggtggccatcagcatcgtgtgcagcagaaagagagcctacagcaaggaggccgtgtacagcgacaagctgcagcactacagcaccggcagaggcagccccggcatgaagatctacatcgaccccttcacctacgaggaccccaacgaggccgtgagagagttcgccaaggagatcgacgtgagcttcgtgaagatcgaggaggtgatcggcgccggcgagttcggcgaggtgtacaagggcagactgaagctgcccggcaagagagagatctacgtggccatcaagaccctgaaggccggctacagcgagaagcagagaagagacttcctgagcgaggccagcatcatgggccagttcgaccaccccaacatcatcagactggagggcgtggtgaccaagagcagacccgtgatgatcatcaccgagttcatggagaacggcgccctggacagcttcctgagacagaacgacggccagttcaccgtgatccagctggtgggcatgctgagaggcatcgccgccggcatgaagtacctggccgagatgaactacgtgcacagagacctggccgccagaaacatcctggtgaacagcaacctggtgtgcaaggtgagcgacttcggcctgagcagatacctgcaggacgacaccagcgaccccacctacaccagcagcctgggcggcaagatccccgtgagatggaccgcccccgaggccatcgcctacagaaagttcaccagcgccagcgacgtgtggagctacggcatcgtgatgtgggaggtgatgagcttcggcgagagaccctactgggacatgagcaaccaggacgtgatcaacgccatcgagcaggactacagactgcccccccccatggactgccccgccgccctgcaccagctgatgctggactgctggcagaaggacagaaacagcagacccagattcgccgagatcgtgaacaccctggacaagatgatcagaaaccccgccagcctgaagaccgtggccaccatcaccgccgtgcccagccagcccctgctggacagaagcatccccgacttcaccgccttcaccaccgtggacgactggctgagcgccatcaagatggtgcagtacagagacagcttcctgaccgccggcttcaccagcctgcagctggtgacccagatgaccagcgaggacctgctgagaatcggcatcaccctggccggccaccagaagaagatcctgaacagcatccacagcatgagagtgcagatcagccagagccccaccgccatggcctag

SEQ ID NO: 80487 - DNA, 2997 bp, Artificial Sequence
  Description of Artificial Sequence: Synthetic coding sequence
atggccagagccagacccccccccccccccagccccccccccggcctgctgcccctgctgccccccctgctgctgctgcccctgctgctgctgcccgccggctgcagagccctggaggagaccctgatggacaccaagtgggtgaccagcgagctggcctggaccagccaccccgagagcggctgggaggaggtgagcggctacgacgaggccatgaaccccatcagaacctaccaggtgtgcaacgtgagagagagcagccagaacaactggctgagaaccggcttcatctggagaagagacgtgcagagagtgtacgtggagctgaagttcaccgtgagagactgcaacagcatccccaacatccccggcagctgcaaggagaccttcaacctgttctactacgaggccgacagcgacgtggccagcgccagcagccccttctggatggagaacccctacgtgaaggtggacaccatcgcccccgacgagagcttcagcagactggacgccggcagagtgaacaccaaggtgagaagcttcggccccctgagcaaggccggcttctacctggccttccaggaccagggcgcctgcatgagcctgatcagcgtgagagccttctacaagaagtgcgccagcaccaccgccggcttcgccctgttccccgagaccctgaccggcgccgagcccaccagcctggtgatcgcccccggcacctgcatccccaacgccgtggaggtgagcgtgcccctgaagctgtactgcaacggcgacggcgagtggatggtgcccgtgggcgcctgcacctgcgccaccggccacgagcccgccgccaaggagagccagtgcagaccctgcccccccggcagctacaaggccaagcagggcgagggcccctgcctgccctgcccccccaacagcagaaccaccagccccgccgccagcatctgcacctgccacaacaacttctacagagccgacagcgacagcgccgacagcgcctgcaccaccgtgcccagcccccccagaggcgtgatcagcaacgtgaacgagaccagcctgatcctggagtggagcgagcccagagacctgggcggcagagacgacctgctgtacaacgtgatctgcaagaagtgccacggcgccggcggcgccagcgcctgcagcagatgcgacgacaacgtggagttcgtgcccagacagctgggcctgaccgagagaagagtgcacatcagccacctgctggcccacaccagatacaccttcgaggtgcaggccgtgaacggcgtgagcggcaagagccccctgccccccagatacgccgccgtgaacatcaccaccaaccaggccgcccccagcgaggtgcccaccctgagactgcacagcagcagcggcagcagcctgaccctgagctgggccccccccgagagacccaacggcgtgatcctggactacgagatgaagtacttcgagaagagcgagggcatcgccagcaccgtgaccagccagatgaacagcgtgcagctggacggcctgagacccgacgccagatacgtggtgcaggtgagagccagaaccgtggccggctacggccagtacagcagacccgccgagttcgagaccaccagcgagagaggcagcggcgcccagcagctgcaggagcagctgcccctgatcgtgggcagcgccaccgccggcctggtgttcgtggtggccgtggtggtgatcgccatcgtgtgcctgagaaagcagagacacggcagcgacagcgagtacaccgagaagctgcagcagtacatcgcccccggcatgaaggtgtacatcgaccccttcacctacgaggaccccaacgaggccgtgagagagttcgccaaggagatcgacgtgagctgcgtgaagatcgaggaggtgatcggcgccggcgagttcggcgaggtgtgcagaggcagactgaagcagcccggcagaagagaggtgttcgtggccatcaagaccctgaaggtgggctacaccgagagacagagaagagacttcctgagcgaggccagcatcatgggccagttcgaccaccccaacatcatcagactggagggcgtggtgaccaagagcagacccgtgatgatcctgaccgagttcatggagaactgcgccctggacagcttcctgagactgaacgacggccagttcaccgtgatccagctggtgggcatgctgagaggcatcgccgccggcatgaagtacctgagcgagatgaactacgtgcacagagacctggccgccagaaacatcctggtgaacagcaacctggtgtgcaaggtgagcgacttcggcctgagcagattcctggaggacgaccccagcgaccccacctacaccagcagcctgggcggcaagatccccatcagatggaccgcccccgaggccatcgcctacagaaagttcaccagcgccagcgacgtgtggagctacggcatcgtgatgtgggaggtgatgagctacggcgagagaccctactgggacatgagcaaccaggacgtgatcaacgccgtggagcaggactacagactgcccccccccatggactgccccaccgccctgcaccagctgatgctggactgctgggtgagagacagaaacctgagacccaagttcagccagatcgtgaacaccctggacaagctgatcagaaacgccgccagcctgaaggtgatcgccagcgcccagagcggcatgagccagcccctgctggacagaaccgtgcccgactacaccaccttcaccaccgtgggcgactggctggacgccatcaagatgggcagatacaaggagagcttcgtgagcgccggcttcgccagcttcgacctggtggcccagatgaccgccgaggacctgctgagaatcggcgtgaccctggccggccaccagaagaagatcctgagcagcatccaggacatgagactgcagatgaaccagaccctgcccgtgcaggtgtag

SEQ ID NO: 80488 - DNA, 3066 bp, Artificial Sequence
  Description of Artificial Sequence: Synthetic coding sequence
atggccaccgagggcgccgcccagctgggcaacagagtggccggcatggtgtgcagcctgtgggtgctgctgctggtgagcagcgtgctggccctggaggaggtgctgctggacaccaccggcgagaccagcgagatcggctggctgacctacccccccggcggctgggacgaggtgagcgtgctggacgaccagagaagactgaccagaaccttcgaggcctgccacgtggccggcgccccccccggcaccggccaggacaactggctgcagacccacttcgtggagagaagaggcgcccagagagcccacatcagactgcacttcagcgtgagagcctgcagcagcctgggcgtgagcggcggcacctgcagagagaccttcaccctgtactacagacaggccgaggagcccgacagccccgacagcgtgagcagctggcacctgaagagatggaccaaggtggacaccatcgccgccgacgagagcttccccagcagcagcagcagcagcagcagcagcagcagcgccgcctgggccgtgggcccccacggcgccggccagagagccggcctgcagctgaacgtgaaggagagaagcttcggccccctgacccagagaggcttctacgtggccttccaggacaccggcgcctgcctggccctggtggccgtgagactgttcagctacacctgccccgccgtgctgagaagcttcgccagcttccccgagacccaggccagcggcgccggcggcgccagcctggtggccgccgtgggcacctgcgtggcccacgccgagcccgaggaggacggcgtgggcggccaggccggcggcagcccccccagactgcactgcaacggcgagggcaagtggatggtggccgtgggcggctgcagatgccagcccggctaccagcccgccagaggcgacaaggcctgccaggcctgccccagaggcctgtacaagagcagcgccggcaacgccccctgcagcccctgccccgccagaagccacgcccccaaccccgccgcccccgtgtgcccctgcctggagggcttctacagagccagcagcgacccccccgaggccccctgcaccggcccccccagcgccccccaggagctgtggttcgaggtgcagggcagcgccctgatgctgcactggagactgcccagagagctgggcggcagaggcgacctgctgttcaacgtggtgtgcaaggagtgcgagggcagacaggagcccgccagcggcggcggcggcacctgccacagatgcagagacgaggtgcacttcgaccccagacagagaggcctgaccgagagcagagtgctggtgggcggcctgagagcccacgtgccctacatcctggaggtgcaggccgtgaacggcgtgagcgagctgagccccgaccccccccaggccgccgccatcaacgtgagcaccagccacgaggtgcccagcgccgtgcccgtggtgcaccaggtgagcagagccagcaacagcatcaccgtgagctggccccagcccgaccagaccaacggcaacatcctggactaccagctgagatactacgaccaggccgaggacgagagccacagcttcaccctgaccagcgagaccaacaccgccaccgtgacccagctgagccccggccacatctacggcttccaggtgagagccagaaccgccgccggccacggcccctacggcggcaaggtgtacttccagaccctgccccagggcgagctgagcagccagctgcccgagagactgagcctggtgatcggcagcatcctgggcgccctggccttcctgctgctggccgccatcaccgtgctggccgtggtgttccagagaaagagaagaggcaccggctacaccgagcagctgcagcagtacagcagccccggcctgggcgtgaagtactacatcgaccccagcacctacgaggacccctgccaggccatcagagagctggccagagaggtggaccccgcctacatcaagatcgaggaggtgatcggcaccggcagcttcggcgaggtgagacagggcagactgcagcccagaggcagaagagagcagaccgtggccatccaggccctgtgggccggcggcgccgagagcctgcagatgaccttcctgggcagagccgccgtgctgggccagttccagcaccccaacatcctgagactggagggcgtggtgaccaagagcagacccctgatggtgctgaccgagttcatggagctgggccccctggacagcttcctgagacagagagagggccagttcagcagcctgcagctggtggccatgcagagaggcgtggccgccgccatgcagtacctgagcagcttcgccttcgtgcacagaagcctgagcgcccacagcgtgctggtgaacagccacctggtgtgcaaggtggccagactgggccacagcccccagggccccagctgcctgctgagatgggccgcccccgaggtgatcgcccacggcaagcacaccaccagcagcgacgtgtggagcttcggcatcctgatgtgggaggtgatgagctacggcgagagaccctactgggacatgagcgagcaggaggtgctgaacgccatcgagcaggagttcagactgccccccccccccggctgcccccccggcctgcacctgctgatgctggacacctggcagaaggacagagccagaagaccccacttcgaccagctggtggccgccttcgacaagatgatcagaaagcccgacaccctgcaggccggcggcgaccccggcgagagacccagccaggccctgctgacccccgtggccctggacttcccctgcctggacagcccccaggcctggctgagcgccatcggcctggagtgctaccaggacaacttcagcaagttcggcctgtgcaccttcagcgacgtggcccagctgagcctggaggacctgcccgccctgggcatcaccctggccggccaccagaagaagctgctgcaccacatccagctgctgcagcagcacctgagacagcagggcagcgtggaggtgtag

SEQ ID NO: 80489 - DNA, 2235 bp, Artificial Sequence
  Description of Artificial Sequence: Synthetic coding sequence
atggccaccgagggcgccgcccagctgggcaacagagtggccggcatggtgagcgtgggcggctgcagatgccagcccggctaccagcccgccagaggcgacaaggcctgccaggcctgccccagaggcctgtacaagagcagcgccggcaacgccccctgcagcccctgccccgccagaagccacgcccccaaccccgccgcccccgtgtgcccctgcctggagggcttctacagagccagcagcgacccccccgaggccccctgcaccggcccccccagcgccccccaggagctgtggttcgaggtgcagggcagcgccctgatgctgcactggagactgcccagagagctgggcggcagaggcgacctgctgttcaacgtggtgtgcaaggagtgcgagggcagacaggagcccgccagcggcggcggcggcacctgccacagatgcagagacgaggtgcacttcgaccccagacagagaggcctgaccgagagcagagtgctggtgggcggcctgagagcccacgtgccctacatcctggaggtgcaggccgtgaacggcgtgagcgagctgagccccgaccccccccaggccgccgccatcaacgtgagcaccagccacgaggtgcccagcgccgtgcccgtggtgcaccaggtgagcagagccagcaacagcatcaccgtgagctggccccagcccgaccagaccaacggcaacatcctggactaccagctgagatactacgaccaggccgaggacgagagccacagcttcaccctgaccagcgagaccaacaccgccaccgtgacccagctgagccccggccacatctacggcttccaggtgagagccagaaccgccgccggccacggcccctacggcggcaaggtgtacttccagaccctgccccagggcgagctgagcagccagctgcccgagagactgagcctggtgatcggcagcatcctgggcgccctggccttcctgctgctggccgccatcaccgtgctggccgtggtgttccagagaaagagaagaggcaccggctacaccgagcagctgcagcagtacagcagccccggcctgggcgtgaagtactacatcgaccccagcacctacgaggacccctgccaggccatcagagagctggccagagaggtggaccccgcctacatcaagatcgaggaggtgatcggcaccggcagcttcggcgaggtgagacagggcagactgcagcccagaggcagaagagagcagaccgtggccatccaggccctgtgggccggcggcgccgagagcctgcagatgaccttcctgggcagagccgccgtgctgggccagttccagcaccccaacatcctgagactggagggcgtggtgaccaagagcagacccctgatggtgctgaccgagttcatggagctgggccccctggacagcttcctgagacagagagagggccagttcagcagcctgcagctggtggccatgcagagaggcgtggccgccgccatgcagtacctgagcagcttcgccttcgtgcacagaagcctgagcgcccacagcgtgctggtgaacagccacctggtgtgcaaggtggccagactgggccacagcccccagggccccagctgcctgctgagatgggccgcccccgaggtgatcgcccacggcaagcacaccaccagcagcgacgtgtggagcttcggcatcctgatgtgggaggtgatgagctacggcgagagaccctactgggacatgagcgagcaggaggtgctgaacgccatcgagcaggagttcagactgccccccccccccggctgcccccccggcctgcacctgctgatgctggacacctggcagaaggacagagccagaagaccccacttcgaccagctggtggccgccttcgacaagatgatcagaaagcccgacaccctgcaggccggcggcgaccccggcgagagacccagccaggccctgctgacccccgtggccctggacttcccctgcctggacagcccccaggcctggctgagcgccatcggcctggagtgctaccaggacaacttcagcaagttcggcctgtgcaccttcagcgacgtggcccagctgagcctggaggacctgcccgccctgggcatcaccctggccggccaccagaagaagctgctgcaccacatccagctgctgcagcagcacctgagacagcagggcagcgtggaggtgtag

SEQ ID NO: 80490 - DNA, 3066 bp, Artificial Sequence; identical to SEQ ID NO: 80488
  Description of Artificial Sequence: Synthetic coding sequence

SEQ ID NO: 80491 - DNA, 654 bp, Artificial Sequence
  Description of Artificial Sequence: Synthetic coding sequence
atggccggcagaaccgtgagagccgagaccagaagcagagccaaggacgacatcaagaaggtgatggccaccatcgagaaggtgagaagatgggagaagagatgggtgaccgtgggcgacaccagcctgagaatcttcaagtgggtgcccgtggtggacccccaggaggaggagagaagaagagccggcggcggcgccgagagaagcagaggcagagagagaagaggcagaggcgccagccccagaggcggcggccccctgatcctgctggacctgaacgacgagaacagcaaccagagcttccacagcgagggcagcctgcagaagggcaccgagcccagccccggcggcaccccccagcccagcagacccgtgagccccgccggcccccccgagggcgtgcccgaggaggcccagccccccagactgggccaggagagagaccccggcggcatcaccgccggcagcaccgacgagccccccatgctgaccaaggaggagcccgtgcccgagctgctggaggccgaggcccccgaggcctaccccgtgttcgagcccgtgccccccgtgcccgaggccgcccagggcgacaccgaggacagcgagggcgccccccccctgaagagaatctgccccaacgcccccgacccctag

SEQ ID NO: 80492 - DNA, 717 bp, Artificial Sequence
  Description of Artificial Sequence: Synthetic coding sequence
atggccgccgcccccctgctgctgctgctgctgctggtgcccgtgcccctgctgcccctgctggcccagggccccggcggcgccctgggcaacagacacgccgtgtactggaacagcagcaaccagcacctgagaagagagggctacaccgtgcaggtgaacgtgaacgactacctggacatctactgcccccactacaacagcagcggcgtgggccccggcgccggccccggccccggcggcggcgccgagcagtacgtgctgtacatggtgagcagaaacggctacagaacctgcaacgccagccagggcttcaagagatgggagtgcaacagaccccacgccccccacagccccatcaagttcagcgagaagttccagagatacagcgccttcagcctgggctacgagttccacgccggccacgagtactactacatcagcacccccacccacaacctgcactggaagtgcctgagaatgaaggtgttcgtgtgctgcgccagcaccagccacagcggcgagaagcccgtgcccaccctgccccagttcaccatgggccccaacgtgaagatcaacgtgctggaggacttcgagggcgagaacccccaggtgcccaagctggagaagagcatcagcggcaccagccccaagagagagcacctgcccctggccgtgggcatcgccttcttcctgatgaccttcctggccagctag

SEQ ID NO: 80493 - DNA, 639 bp, Artificial Sequence
  Description of Artificial Sequence: Synthetic coding sequence
atggccgccgcccccctgctgctgctgctgctgctggtgcccgtgcccctgctgcccctgctggcccagggccccggcggcgccctgggcaacagacacgccgtgtactggaacagcagcaaccagcacctgagaagagagggctacaccgtgcaggtgaacgtgaacgactacctggacatctactgcccccactacaacagcagcggcgtgggccccggcgccggccccggccccggcggcggcgccgagcagtacgtgctgtacatggtgagcagaaacggctacagaacctgcaacgccagccagggcttcaagagatgggagtgcaacagaccccacgccccccacagccccatcaagttcagcgagaagttccagagatacagcgccttcagcctgggctacgagttccacgccggccacgagtactactacatcagcacccccacccacaacctgcactggaagtgcctgagaatgaaggtgttcgtgtgctgcgccagcaaggacttcgagggcgagaacccccaggtgcccaagctggagaagagcatcagcggcaccagccccaagagagagcacctgcccctggccgtgggcatcgccttcttcctgatgaccttcctggccagctag

SEQ ID NO: 80494 - DNA, 702 bp, Artificial Sequence
  Description of Artificial Sequence: Synthetic coding sequence
atgagactgctgcccctgctgagaaccgtgctgtgggccgccttcctgggcagccccctgagaggcggcagcagcctgagacacgtggtgtactggaacagcagcaaccccagcctgagaagagagggctacaccgtgcaggtgaacgtgaacgactacctggacatctactgcccccactacaacagcagcggcgtgggccccggcgccggccccggccccggcggcggcgccgagcagtacgtgctgtacatggtgagcagaaacggctacagaacctgcaacgccagccagggcttcaagagatgggagtgcaacagaccccacgccccccacagccccatcaagttcagcgagaagttccagagatacagcgccttcagcctgggctacgagttccacgccggccacgagtactactacatcagcacccccacccacaacctgcactggaagtgcctgagaatgaaggtgttcgtgtgctgcgccagcaccagccacagcggcgagaagcccgtgcccaccctgccccagttcaccatgggccccaacgtgaagatcaacgtgctggaggacttcgagggcgagaacccccaggtgcccaagctggagaagagcatcagcggcaccagccccaagagagagcacctgcccctggccgtgggcatcgccttcttcctgatgaccttcctggccagctag

SEQ ID NO: 80495 - DNA, 582 bp, Artificial Sequence
  Description of Artificial Sequence: Synthetic coding sequence
atgagactgctgcccctgctgagaaccgtgctgtgggccgccttcctgggcagccccctgagaggcggcagcagcctgagacacgtggtgtactggaacagcagcaaccccagactgctgagaggcgacgccgtggtggagctgggcctgaacgactacctggacatcgtgtgcccccactacgagggccccggcccccccgagggccccgagaccttcgccctgtacatggtggactggcccggctacgagagctgccaggccgagggccccagagcctacaagagatgggtgtgcagcctgcccttcggccacgtgcagttcagcgagaagatccagagattcacccccttcagcctgggcttcgagttcctgcccggcgagacctactactacatcagcgtgcccacccccgagagcagcggccagtgcctgagactgcaggtgagcgtgtgctgcaaggagagaaacctgcccagccaccccaaggagcccgagagcagccaggaccccctggaggaggagggcagcctgctgcccgccctgggcgtgcccatccagaccgacaagatggagcactag

SEQ ID NO: 80496 - DNA, 606 bp, Artificial Sequence
  Description of Artificial Sequence: Synthetic coding sequence
atgagactgctgcccctgctgagaaccgtgctgtgggccgccttcctgggcagccccctgagaggcggcagcagcctgagacacgtggtgtactggaacagcagcaaccccagactgctgagaggcgacgccgtggtggagctgggcctgaacgactacctggacatcgtgtgcccccactacgagggccccggcccccccgagggccccgagaccttcgccctgtacatggtggactggcccggctacgagagctgccaggccgagggccccagagcctacaagagatgggtgtgcagcctgcccttcggccacgtgcagttcagcgagaagatccagagattcacccccttcagcctgggcttcgagttcctgcccggcgagacctactactacatcagcgtgcccacccccgagagcagcggccagtgcctgagactgcaggtgagcgtgtgctgcaaggagagaaagagcgagagcgcccaccccgtgggcagccccggcgagagcggcaccagcggctggagaggcggcgacacccccagccccctgtgcctgctgctgctgctgctgctgctgatcctgagactgctgagaatcctgtag

SEQ ID NO: 80497 - DNA, 624 bp, Artificial Sequence
  Description of Artificial Sequence: Synthetic coding sequence
atgagactgctgcccctgctgagaaccgtgctgtgggccgccttcctgggcagccccctgagaggcggcagcagcctgagacacgtggtgtactggaacagcagcaaccccagactgctgagaggcgacgccgtggtggagctgggcctgaacgactacctggacatcgtgtgcccccactacgagggccccggcccccccgagggccccgagaccttcgccctgtacatggtggactggcccggctacgagagctgccaggccgagggccccagagcctacaagagatgggtgtgcagcctgcccttcggccacgtgcagttcagcgagaagatccagagattcacccccttcagcctgggcttcgagttcctgcccggcgagacctactactacatcagcgtgcccacccccgagagcagcggccagtgcctgagactgcaggtgagcgtgtgctgcaaggagagaagagccagagtgctgcccagaagccccggcggcggcggcatccccgccgcctgcaccggcggcgccaacagcgacagacaggacggcgccctgatgggcgagatcagaggcagcgaggtgaccctggccggcgcctgccccctgatcaccggctag

SEQ ID NO: 80498 - DNA, 1083 bp, Artificial Sequence
  Description of Artificial Sequence: Synthetic coding sequence
atgagcgacagcaaggagcccagactgcagcagctgggcctgctggtgagcaaggtgcccagcagcatcagccaggagcagagcagacaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgacctggctgaaggccgccgtgggcgagctgcccgagaagagcaagatgcaggagatctaccaggagctgaccagactgaaggccgccgtgggcgagctgcccgagaagagcaagcagcaggagatctaccaggagctgaccagactgaaggccgccgtgggcgagctgcccgagaagagcaagcagcaggagatctaccaggagctgaccagactgaaggccgccgtgggcgagctgcccgagaagagcaagcagcaggagatctaccaggagctgacccagctgaaggccgccgtggagagactgtgccacccctgcccctgggagtggaccttcttccagggcaactgctacttcatgagcaacagccagagaaactggcacgacagcatcaccgcctgcaaggaggtgggcgcccagctggtggtgatcaagagcgccgaggagcagaacttcctgcagctgcagagcagcagaagcaacagattcacctggatgggcctgagcgacctgaaccaggagggcacctggcagtgggtggacggcagccccctgctgcccagcttcaagcagtactggaacagaggcgagcccaacaacgtgggcgaggaggactgcgccgagttcagcggcaacggctggaacgacgacaagtgcaacctggccaagttctggatctgcaagaagagcgccgccagctgcagcagagacgaggagcagttcctgagccccgcccccgccacccccaaccccccccccgcctag

SEQ ID NO: 80499 - DNA, 888 bp, Artificial Sequence
  Description of Artificial Sequence: Synthetic coding sequence
atggagaagatgagcagacccctgcccctgaaccccaccttcatcccccccccctacggcgtgctgagaagcctgctggagaaccccctgaagctgcccctgcaccacgaggacgccttcagcaaggacaaggacaaggagaagaagctggacgacgagagcaacagccccaccgtgccccagagcgccttcctgggccccaccctgtgggacaagaccctgccctacgacggcgacaccttccagctggagtacatggacctggaggagttcctgagcgagaacggcatcccccccagccccagccagcacgaccacagcccccacccccccggcctgcagcccgccagcagcgccgcccccagcgtgatggacctgagcagcagagccagcgcccccctgcaccccggcatccccagccccaactgcatgcagagccccatcagacccggccagctgctgcccgccaacagaaacacccccagccccatcgaccccgacaccatccaggtgcccgtgggctacgagcccgaccccgccgacctggccctgagcagcatccccggccaggagatgttcgaccccagaaagagaaagttcagcgaggaggagctgaagccccagcccatgatcaagaaggccagaaaggtgttcatccccgacgacctgaaggacgacaagtactgggccagaagaagaaagaacaacatggccgccaagagaagcagagacgccagaagactgaaggagaaccagatcgccatcagagccagcttcctggagaaggagaacagcgccctgagacaggaggtggccgacctgagaaaggagctgggcaagtgcaagaacatcctggccaagtacgaggccagacacggccccctgtag

SEQ ID NO: 80500 - DNA, 780 bp, Artificial Sequence
  Description of Artificial Sequence: Synthetic coding sequence
atggccgccgccgcccagctgagcctgacccagctgagcagcggcaaccccgtgtacgagaagtactacagacaggtggacaccggcaacaccggcagagtgctggccagcgacgccgccgccttcctgaagaagagcggcctgcccgacctgatcctgggcaagatctgggacctggccgacaccgacggcaagggcatcctgaacaagcaggagttcttcgtggccctgagactggtggcctgcgcccagaacggcctggaggtgagcctgagcagcctgaacctggccgtgcccccccccagattccacgacaccagcagccccctgctgatcagcggcaccagcgccgccgagctgccctgggccgtgaagcccgaggacaaggccaagtacgacgccatcttcgacagcctgagccccgtgaacggcttcctgagcggcgacaaggtgaagcccgtgctgctgaacagcaagctgcccgtggacatcctgggcagagtgtgggagctgagcgacatcgaccacgacggcatgctggacagagacgagttcgccgtgaccgagagccacagcgtgacccaggccggcgtgcagtggagagacctgagcagcctgcagcccagaccccccggcttcaagctgttcttccacctgagcctgctgagaagctgggactacagacacgccccccccccccccgccaacttctacatcttcagcagagacagcgtgagcccctgcctgcccgactggagcagagcccccgacaacagatag

SEQ ID NO: 80501 - DNA, 2289 bp, Artificial Sequence
  Description of Artificial Sequence: Synthetic coding sequence
atggccgccgccgcccagctgagcctgacccagctgagcagcggcaaccccgtgtacgagaagtactacagacaggtggacaccggcaacaccggcagagtgctggccagcgacgccgccgccttcctgaagaagagcggcctgcccgacctgatcctgggcaagatctgggacctggccgacaccgacggcaagggcatcctgaacaagcaggagttcttcgtggccctgagactggtggcctgcgcccagaacggcctggaggtgagcctgagcagcctgaacctggccgtgcccccccccagattccacgacaccagcagccccctgctgatcagcggcaccagcgccgccgagctgccctgggccgtgaagcccgaggacaaggccaagtacgacgccatcttcgacagcctgagccccgtgaacggcttcctgagcggcgacaaggtgaagcccgtgctgctgaacagcaagctgcccgtggacatcctgggcagagtgtgggagctgagcgacatcgaccacgacggcatgctggacagagacgagttcgccgtggccatgttcctggtgtactgcgccctggagaaggagcccgtgcccatgagcctgccccccgccctggtgccccccagcaagagaaagacctgggtggtgagccccgccgagaaggccaagtacgacgagatcttcctgaagaccgacaaggacatggacggcttcgtgagcggcctggaggtgagagagatcttcctgaagaccggcctgcccagcaccctgctggcccacatctggagcctgtgcgacaccaaggactgcggcaagctgagcaaggaccagttcgccctggccttccacctgatcagccagaagctgatcaagggcatcgaccccccccacgtgctgacccccgagatgatcccccccagcgacagagccagcctgcagaagaacatcatcggcagcagccccgtggccgacttcagcgccatcaaggagctggacaccctgaacaacgagatcgtggacctgcagagagagaagaacaacgtggagcaggacctgaaggagaaggaggacaccatcaagcagagaaccagcgaggtgcaggacctgcaggacgaggtgcagagagagaacaccaacctgcagaagctgcaggcccagaagcagcaggtgcaggagctgctggacgagctggacgagcagaaggcccagctggaggagcagctgaaggaggtgagaaagaagtgcgccgaggaggcccagctggccagaagcagccccgagctgctgcccagcggcgtgaccgacgagaacgaggtgaccaccgccgtgaccgagaaggtgtgcagcgagctggacaacaacagacacagcaaggaggaggaccccttcaacgtggacagcagcagcctgaccggccccgtggccgacaccaacctggacttcttccagagcgaccccttcgtgggcagcgaccccttcaaggacgaccccttcggcaagatcgaccccttcggcggcgaccccttcaagggcagcgaccccttcgccagcgactgcttcttcagacagagcaccgaccccttcgccaccagcagcaccgaccccttcagcgccgccaacaacagcagcatcaccagcgtggagaccctgaagcacaacgaccccttcgcccccggcggcaccgtggtggccgccagcgacagcgccaccgaccccttcgccagcgtgttcggcaacgagagcttcggcggcggcttcgccgacttcagcaccctgagcaaggtgaacaacgaggaccccttcagaagcgccaccagcagcagcgtgagcaacgtggtgatcaccaagaacgtgttcgaggagaccagcgtgaagagcgaggacgagccccccgccctgccccccaagatcggcacccccaccagaccctgccccctgccccccggcaagagaagcatcaacaagctggacagccccgaccccttcaagctgaacgaccccttccagcccttccccggcaacgacagccccaaggagaaggaccccgagatcttctgcgaccccttcaccagcgccaccaccaccaccaacaaggaggccgaccccagcaacttcgccaacttcagcgcctaccccagcgaggaggacatgatcgagtgggccaagagagagagcgagagagaggaggagcagagactggccagactgaaccagcaggagcaggaggacctggagctggccatcgccctgagcaagagcgagatcagcgaggcctag

SEQ ID NO: 80502 - DNA, 2691 bp, Artificial Sequence
  Description of Artificial Sequence: Synthetic coding sequence
atggccgccgccgcccagctgagcctgacccagctgagcagcggcaaccccgtgtacgagaagtactacagacaggtggacaccggcaacaccggcagagtgctggccagcgacgccgccgccttcctgaagaagagcggcctgcccgacctgatcctgggcaagatctgggacctggccgacaccgacggcaagggcatcctgaacaagcaggagttcttcgtggccctgagactggtggcctgcgcccagaacggcctggaggtgagcctgagcagcctgaacctggccgtgcccccccccagattccacgacaccagcagccccctgctgatcagcggcaccagcgccgccgagctgccctgggccgtgaagcccgaggacaaggccaagtacgacgccatcttcgacagcctgagccccgtgaacggcttcctgagcggcgacaaggtgaagcccgtgctgctgaacagcaagctgcccgtggacatcctgggcagagtgtgggagctgagcgacatcgaccacgacggcatgctggacagagacgagttcgccgtggccatgttcctggtgtactgcgccctggagaaggagcccgtgcccatgagcctgccccccgccctggtgccccccagcaagagaaagacctgggtggtgagccccgccgagaaggccaagtacgacgagatcttcctgaagaccgacaaggacatggacggcttcgtgagcggcctggaggtgagagagatcttcctgaagaccggcctgcccagcaccctgctggcccacatctggagcctgtgcgacaccaaggactgcggcaagctgagcaaggaccagttcgccctggccttccacctgatcagccagaagctgatcaagggcatcgaccccccccacgtgctgacccccgagatgatcccccccagcgacagagccagcctgcagaagaacatcatcggcagcagccccgtggccgacttcagcgccatcaaggagctggacaccctgaacaacgagatcgtggacctgcagagagagaagaacaacgtggagcaggacctgaaggagaaggaggacaccatcaagcagagaaccagcgaggtgcaggacctgcaggacgaggtgcagagagagaacaccaacctgcagaagctgcaggcccagaagcagcaggtgcaggagctgctggacgagctggacgagcagaaggcccagctggaggagcagctgaaggaggtgagaaagaagtgcgccgaggaggcccagctgatcagcagcctgaaggccgagctgaccagccaggagagccagatcagcacctacgaggaggagctggccaaggccagagaggagctgagcagactgcagcaggagaccgccgagctggaggagagcgtggagagcggcaaggcccagctggagcccctgcagcagcacctgcaggacagccagcaggagatcagcagcatgcagatgaagctgatggagatgaaggacctggagaaccacaacagccagctgaactggtgcagcagcccccacagcatcctggtgaacggcgccaccgactactgcagcctgagcaccagcagcagcgagaccgccaacctgaacgagcacgtggagggccagagcaacctggagagcgagcccatccaccaggagagccccgccagaagcagccccgagctgctgcccagcggcgtgaccgacgagaacgaggtgaccaccgccgtgaccgagaaggtgtgcagcgagctggacaacaacagacacagcaaggaggaggaccccttcaacgtggacagcagcagcctgaccggccccgtggccgacaccaacctggacttcttccagagcgaccccttcgtgggcagcgaccccttcaaggacgaccccttcggcaagatcgaccccttcggcggcgaccccttcaagggcagcgaccccttcgccagcgactgcttcttcagacagagcaccgaccccttcgccaccagcagcaccgaccccttcagcgccgccaacaacagcagcatcaccagcgtggagaccctgaagcacaacgaccccttcgcccccggcggcaccgtggtggccgccagcgacagcgccaccgaccccttcgccagcgtgttcggcaacgagagcttcggcggcggcttcgccgacttcagcaccctgagcaaggtgaacaacgaggaccccttcagaagcgccaccagcagcagcgtgagcaacgtggtgatcaccaagaacgtgttcgaggagaccagcgtgaagagcgaggacgagccccccgccctgccccccaagatcggcacccccaccagaccctgccccctgccccccggcaagagaagcatcaacaagctggacagccccgaccccttcaagctgaacgaccccttccagcccttccccggcaacgacagccccaaggagaaggaccccgagatcttctgcgaccccttcaccagcgccaccaccaccaccaacaaggaggccgaccccagcaacttcgccaacttcagcgcctaccccagcgaggaggacatgatcgagtgggccaagagagagagcgagagagaggaggagcagagactggccagactgaaccagcaggagcaggaggacctggagctggccatcgccctgagcaagagcgagatcagcgaggcctag

SEQ ID NO: 80503 - DNA, 1722 bp, Artificial Sequence
  Description of Artificial Sequence: Synthetic coding sequence
atgatcctgatggtgagagactgcctgaagagccagcacagagacccccactgcgaccccagcgacaagagagagaagaacaacgtggagcaggacctgaaggagaaggaggacaccatcaagcagagaaccagcgaggtgcaggacctgcaggacgaggtgcagagagagaacaccaacctgcagaagctgcaggcccagaagcagcaggtgcaggagctgctggacgagctggacgagcagaaggcccagctggaggagcagctgaaggaggtgagaaagaagtgcgccgaggaggcccagctgatcagcagcctgaaggccgagctgaccagccaggagagccagatcagcacctacgaggaggagctggccaaggccagagaggagctgagcagactgcagcaggagaccgccgagctggaggagagcgtggagagcggcaaggcccagctggagcccctgcagcagcacctgcaggacagccagcaggagatcagcagcatgcagatgaagctgatggagatgaaggacctggagaaccacaacagccagctgaactggtgcagcagcccccacagcatcctggtgaacggcgccaccgactactgcagcctgagcaccagcagcagcgagaccgccaacctgaacgagcacgtggagggccagagcaacctggagagcgagcccatccaccaggagagccccgccagaagcagccccgagctgctgcccagcggcgtgaccgacgagaacgaggtgaccaccgccgtgaccgagaaggtgtgcagcgagctggacaacaacagacacagcaaggaggaggaccccttcaacgtggacagcagcagcctgaccggccccgtggccgacaccaacctggacttcttccagagcgaccccttcgtgggcagcgaccccttcaaggacgaccccttcggcaagatcgaccccttcggcggcgaccccttcaagggcagcgaccccttcgccagcgactgcttcttcagacagagcaccgaccccttcgccaccagcagcaccgaccccttcagcgccgccaacaacagcagcatcaccagcgtggagaccctgaagcacaacgaccccttcgcccccggcggcaccgtggtggccgccagcgacagcgccaccgaccccttcgccagcgtgttcggcaacgagagcttcggcggcggcttcgccgacttcagcaccctgagcaaggtgaacaacgaggaccccttcagaagcgccaccagcagcagcgtgagcaacgtggtgatcaccaagaacgtgttcgaggagaccagcgtgaagagcgaggacgagccccccgccctgccccccaagatcggcacccccaccagaccctgccccctgccccccggcaagagaagcatcaacaagctggacagccccgaccccttcaagctgaacgaccccttccagcccttccccggcaacgacagccccaaggagaaggaccccgagatcttctgcgaccccttcaccagcgccaccaccaccaccaacaaggaggccgaccccagcaacttcgccaacttcagcgcctaccccagcgaggaggacatgatcgagtgggccaagagagagagcgagagagaggaggagcagagactggccagactgaaccagcaggagcaggaggacctggagctggccatcgccctgagcaagagcgagatcagcgaggcctag

SEQ ID NO: 80504 - DNA, 2469 bp, Artificial Sequence
  Description of Artificial Sequence: Synthetic coding sequence
atgaacggccacatcagcaaccaccccagcagcttcggcatgtaccccagccagatgaacggctacggcagcagccccaccttcagccagaccgacagagagcacggcagcaagaccagcgccaaggccctgtacgagcagagaaagaactacgccagagacagcgtgagcagcgtgagcgacatcagccagtacagagtggagcacctgaccaccttcgtgctggacagaaaggacgccatgatcaccgtggacgacggcatcagaaagctgaagctgctggacgccaagggcaaggtgtggacccaggacatgatcctgcaggtggacgacagagccgtgagcctgatcgacctggagagcaagaacgagctggagaacttccccctgaacaccatccagcactgccaggccgtgatgcacagctgcagctacgacagcgtgctggccctggtgtgcaaggagcccacccagaacaagcccgacctgcacctgttccagtgcgacgaggtgaaggccaacctgatcagcgaggacatcgagagcgccatcagcgacagcaagggcggcaagcagaagagaagacccgacgccctgagaatgatcagcaacgccgaccccagcatcccccccccccccagagcccccgcccccgccccccccggcaccgtgacccaggtggacgtgagaagcagagtggccgcctggagcgcctgggccgccgaccagggcgacttcgagaagcccagacagtaccacgagcaggaggagacccccgagatgatggccgccagaatcgacagagacgtgcagatcctgaaccacatcctggacgacatcgagttcttcatcaccaagctgcagaaggccgccgaggccttcagcgagctgagcaagagaaagaagaacaagaagggcaagagaaagggccccggcgagggcgtgctgaccctgagagccaagccccccccccccgacgagttcctggactgcttccagaagttcaagcacggcttcaacctgctggccaagctgaagagccacatccagaaccccagcgccgccgacctggtgcacttcctgttcacccccctgaacatggtggtgcaggccaccggcggccccgagctggccagcagcgtgctgagccccctgctgaacaaggacaccatcgacttcctgaactacaccgtgaacggcgacgagagacagctgtggatgagcctgggcggcacctggatgaaggccagagccgagtggcccaaggagcagttcatccccccctacgtgcccagattcagaaacggctgggagccccccatgctgaacttcatgggcgccaccatggagcaggacctgtaccagctggccgagagcgtggccaacgtggccgagcaccagagaaagcaggagatcaagagactgagcaccgagcacagcagcgtgagcgagtaccaccccgccgacggctacgccttcagcagcaacatctacaccagaggcagccacctggaccagggcgaggccgccgtggccttcaagcccaccagcaacagacacatcgacagaaactacgagcccctgaagacccagcccaagaagtacgccaagagcaagtacgacttcgtggccagaaacaacagcgagctgagcgtgctgaaggacgacatcctggagatcctggacgacagaaagcagtggtggaaggtgagaaacgccagcggcgacagcggcttcgtgcccaacaacatcctggacatcgtgagaccccccgagagcggcctgggcagagccgaccccccctacacccacaccatccagaagcagagaatggagtacggccccagacccgccgacaccccccccgcccccagccccccccccacccccgcccccgtgcccgtgcccctgccccccagcacccccgcccccgtgcccgtgagcaaggtgcccgccaacatcaccagacagaacagcagcagcagcgacagcggcggcagcatcgtgagagacagccagagacacaagcagctgcccgtggacagaagaaagagccagatggaggaggtgcaggacgagctgatccacagactgaccatcggcagaagcgccgcccagaagaagttccacgtgcccagacagaacgtgcccgtgatcaacatcacctacgacagcacccccgaggacgtgaagacctggctgcagagcaagggcttcaaccccgtgaccgtgaacagcctgggcgtgctgaacggcgcccagctgttcagcctgaacaaggacgagctgagaaccgtgtgccccgagggcgccagagtgtacagccagatcaccgtgcagaaggccgccctggaggacagcagcggcagcagcgagctgcaggagatcatgagaagaagacaggagaagatcagcgccgccgccagcgacagcggcgtggagagcttcgacgagggcagcagccactag

SEQ ID NO: 80505 - DNA, 366 bp, Artificial Sequence
  Description of Artificial Sequence: Synthetic coding sequence
atgaacggccacatcagcaaccaccccagcagcttcggcatgtaccccagccagatgaacggctacggcagcagccccaccttcagccagaccgacagagagcacggcagcaagaccagcgccaaggccctgtacgagcagagaaagaactacgccagagacagcgtgagcagcgtgagcgacatcagccagtacagagtggagcacctgaccaccttcgtgctggacagaaaggacgccatgatcaccgtggacgacggcatcagaaagctgaagctgctggacgccaagggcaaggtgtggacccaggacatgatcctgcaggtggacgacagagccgtgagcctgatcgacctggagagctag

SEQ ID NO: 80506 - DNA, 207 bp, Artificial Sequence
  Description of Artificial Sequence: Synthetic coding sequence
atgaacggccacatcagcaaccaccccagcagcttcggcatgtaccccagccagatgaacggctacggcagcagccccaccttcagccagaccgacagagagcacggcagcaagaccagcgccaaggccctgtacgagcagagaaagaactacgccagagacagcgtgagcagcgtgagcgacatcagccagtacagagtggagtag

SEQ ID NO: 80507 - DNA, 1689 bp, Artificial Sequence
  Description of Artificial Sequence: Synthetic coding sequence
atgatggccgccagaatcgacagagacgtgcagatcctgaaccacatcctggacgacatcgagttcttcatcaccaagctgcagaaggccgccgaggccttcagcgagctgagcaagagaaagaagaacaagaagggcaagagaaagggccccggcgagggcgtgctgaccctgagagccaagccccccccccccgacgagttcctggactgcttccagaagttcaagcacggcttcaacctgctggccaagctgaagagccacatccagaaccccagcgccgccgacctggtgcacttcctgttcacccccctgaacatggtggtgcaggccaccggcggccccgagctggccagcagcgtgctgagccccctgctgaacaaggacaccatcgacttcctgaactacaccgtgaacggcgacgagagacagctgtggatgagcctgggcggcacctggatgaaggccagagccgagtggcccaaggagcagttcatccccccctacgtgcccagattcagaaacggctgggagccccccatgctgaacttcatgggcgccaccatggagcaggacctgtaccagctggccgagagcgtggccaacgtggccgagcaccagagaaagcaggagatcaagagactgagcaccgagcacagcagcgtgagcgagtaccaccccgccgacggctacgccttcagcagcaacatctacaccagaggcagccacctggaccagggcgaggccgccgtggccttcaagcccaccagcaacagacacatcgacagaaactacgagcccctgaagacccagcccaagaagtacgccaagagcaagtacgacttcgtggccagaaacaacagcgagctgagcgtgctgaaggacgacatcctggagatcctggacgacagaaagcagtggtggaaggtgagaaacgccagcggcgacagcggcttcgtgcccaacaacatcctggacatcgtgagaccccccgagagcggcctgggcagagccgaccccccctacacccacaccatccagaagcagagaatggagtacggccccagacccgccgacaccccccccgcccccagccccccccccacccccgcccccgtgcccgtgcccctgccccccagcacccccgcccccgtgcccgtgagcaaggtgcccgccaacatcaccagacagaacagcagcagcagcgacagcggcggcagcatcgtgagagacagccagagacacaagcagctgcccgtggacagaagaaagagccagatggaggaggtgcaggacgagctgatccacagactgaccatcggcagaagcgccgcccagaagaagttccacgtgcccagacagaacgtgcccgtgatcaacatcacctacgacagcacccccgaggacgtgaagacctggctgcagagcaagggcttcaaccccgtgaccgtgaacagcctgggcgtgctgaacggcgcccagctgttcagcctgaacaaggacgagctgagaaccgtgtgccccgagggcgccagagtgtacagccagatcaccgtgcagaaggccgccctggaggacagcagcggcagcagcgagctgcaggagatcatgagaagaagacaggagaagatcagcgccgccgccagcgacagcggcgtggagagcttcgacgagggcagcagccactag

SEQ ID NO: 80508 - DNA, 1689 bp, Artificial Sequence; identical to SEQ ID NO: 80507
  Description of Artificial Sequence: Synthetic coding sequence

SEQ ID NO: 80509 - DNA, 2076 bp, Artificial Sequence
  Description of Artificial Sequence: Synthetic coding sequence
atgaacggccacatcagcaaccaccccagcagcttcggcatgtaccccagccagatgaacggctacggcagcagccccaccttcagccagaccgacagagagcacggcagcaagaccagcgccaaggccctgtacgagcagagaaagaactacgccagagacagcgtgagcagcgtgagcgacatcagccagtacagagtggagcacctgaccaccttcgtgctggacagaaaggacgccatgatcaccgtggacgacggcatcagaaagctgaagctgctggacgccaagggcaaggtgtggacccaggacatgatcctgcaggtggacgacagagccgtgagcctgatcgacctggagagcaagaacgagctggagaacttccccctgaacaccatccagcactgccaggccgtgatgcacagctgcagctacgacagcgtgctggccctggtgtgcaaggagcccacccagaacaagcccgacctgcacctgttccagtgcgacgaggtgaaggccaacctgatcagcgaggacatcgagagcgccatcagcgacagcaagggcggcaagcagaagagaagacccgacgccctgagaatgatcagcaacgccgaccccagcatcccccccccccccagagcccccgcccccgccccccccggcaccgtgacccaggtggacgtgagaagcagagtggccgcctggagcgcctgggccgccgaccagggcgacttcgagaagcccagacagtaccacgagcaggaggagacccccgagatgatggccgccagaatcgacagagacgtgcagatcctgaaccacatcctggacgacatcgagttcttcatcaccaagctgcagaaggccgccgaggccttcagcgagctgagcaagagaaagaagaacaagaagggcaagagaaagggccccggcgagggcgtgctgaccctgagagccaagccccccccccccgacgagttcctggactgcttccagaagttcaagcacggcttcaacctgctggccaagctgaagagccacatccagaaccccagcgccgccgacctggtgcacttcctgttcacccccctgaacatggtggtgcaggccaccggcggccccgagctggccagcagcgtgctgagccccctgctgaacaaggacaccatcgacttcctgaactacaccgtgaacggcgacgagagacagctgtggatgagcctgggcggcacctggatgaaggccagagccgagtggcccaaggagcagttcatccccccctacgtgcccagattcagaaacggctgggagccccccatgctgaacttcatgggcgccaccatggagcaggacctgtaccagctggccgagagcgtggccaacgtggccgagcaccagagaaagcaggagatcaagagactgagcaccgagcacagcagcgtgagcgagtaccaccccgccgacggctacgccttcagcagcaacatctacaccagaggcagccacctggaccagggcgaggccgccgtggccttcaagcccaccagcaacagacacatcgacagaaactacgagcccctgaagacccagcccaagaagtacgccaagagcaagtacgacttcgtggccagaaacaacagcgagctgagcgtgctgaaggacgacatcctggagatcctggacgacagaaagcagtggtggaaggtgagaaacgccagcggcgacagcggcttcgtgcccaacaacatcctggacatcgtgagaccccccgagagcggcctgggcagagccgaccccccctacacccacaccatccagaagcagagaatggagtacggccccagacccgccgacaccccccccgcccccagccccccccccacccccgcccccgtgcccgtgcccctgccccccagcacccccgcccccgtgcccgtgagcaaggtgcccgccaacatcaccagacagaacagcagcagcagcgacagcggcggcagcatcgtgagagacagccagagacacaagaccagcggcggccccaaggagatcagcgacggcggcagcgccagatag

SEQ ID NO: 80510 - DNA, 207 bp, Artificial Sequence; identical to SEQ ID NO: 80506
  Description of Artificial Sequence: Synthetic coding sequence

SEQ ID NO: 80511 - DNA, 2469 bp, Artificial Sequence; identical to SEQ ID NO: 80504
  Description of Artificial Sequence: Synthetic coding sequence

SEQ ID NO: 80512 - DNA, 2469 bp, Artificial Sequence; identical to SEQ ID NO: 80504
  Description of Artificial Sequence: Synthetic coding sequence

SEQ ID NO: 80513 - DNA, 204 bp, Artificial Sequence
  Description of Artificial Sequence: Synthetic coding sequence
atgaacggccacatcagcaaccaccccagcagcttcggcatgtaccccagccagatgaacggctacggcagcagccccaccttcagccagaccgacagagagcacggcagcaagaccagcgccaaggccctgtacgagcagagaaagaactacgccagagacagcgtgagcagcgtgagcgacatcagccagtacagagtgtag

SEQ ID NO: 80514 - DNA, 387 bp, Artificial Sequence
  Description of Artificial Sequence: Synthetic coding sequence
atgaacggccacatcagcaaccaccccagcagcttcggcatgtaccccagccagatgaacggctacggcagcagccccaccttcagccagaccgacagagagcacggcagcaagaccagcgccaaggccctgtacgagcagagaaagaactacgccagagacagcgtgagcagcgtgagcgacatcagccagtacagagtggagcacctgaccaccttcgtgctggacagaaaggacgccatgatcaccgtggacgacggcatcagaaagctgaagctgctggacgccaagggcaaggtgtggacccaggacatgatcctgcaggtggacgacagagccgtgagcctgatcgacctggagagcaagaacgagctggagaacttctag

SEQ ID NO: 80515 - DNA, 996 bp, Artificial Sequence
  Description of Artificial Sequence: Synthetic coding sequence
atgagattcagattcggcgtggtggtgccccccgccgtggccggcgccagacccgagctgctggtggtgggcagcagacccgagctgggcagatgggagcccagaggcgccgtgagactgagacccgccggcaccgccgccggcgacggcgccctggccctgcaggagcccggcctgtggctgggcgaggtggagctggccgccgaggaggccgcccaggacggcgccgagatcggcgccacccccaagctgcccagcaccatcttcccctggttcgtgctgagacagggcctgatcctgggcaacggcccccaccacgacagatgctgcacctacaacgagaacaacctggtggacggcgtgtactgcctgcccatcggccactggatcgaggccaccggccacaccaacgagatgaagcacaccaccgacttctacttcaacatcgccggccaccaggccatgcactacagcagaatcctgcccaacatctggctgggcagctgccccagacaggtggagcacgtgaccatcaagctgaagcacgagctgggcatcaccgccgtgatgaacttccagaccgagtgggacatcgtgcagaacagcagcggctgcaacagataccccgagcccatgacccccgacaccatgatcaagctgtacagagaggagggcctggcctacatctggatgcccacccccgacatgagcaccgagggcagagtgcagatgctgccccaggccgtgtgcctgctgcacgccctgctggagaagggccacatcgtgtacgtgcactgcaacgccggcgtgggcagaagcaccgccgccgtgtgcggctggctgcagtacgtgatgggctggaacctgagaaaggtgcagtacttcctgatggccaagagacccgccgtgtacatcgacgaggaggccctggccagagcccaggaggacttcttccagaagttcggcaaggtgagaagcagcgtgtgcagcctgtag

SEQ ID NO: 80516 - DNA, 996 bp, Artificial Sequence
  Description of Artificial Sequence: Synthetic coding sequence
atgagattcagattcggcgtggtggtgccccccgccgtggccggcgccagacccgagctgctggtggtgggcagcagacccgagctgggcagatgggagcccagaggcgccgtgagactgagacccgccggcaccgccgccggcgacggcgccctggccctgcaggagcccggcctgtggctgggcgaggtggagctggccgccgaggaggccgcccaggacggcgccgagcccggcagagtggacaccttctggtacaagttcctgaagagagagcccggcggcgagctgagctgggagggcaacggcccccaccacgacagatgctgcacctacaacgagaacaacctggtggacggcgtgtactgcctgcccatcggccactggatcgaggccaccggccacaccaacgagatgaagcacaccaccgacttctacttcaacatcgccggccaccaggccatgcactacagcagaatcctgcccaacatctggctgggcagctgccccagacaggtggagcacgtgaccatcaagctgaagcacgagctgggcatcaccgccgtgatgaacttccagaccgagtgggacatcgtgcagaacagcagcggctgcaacagataccccgagcccatgacccccgacaccatgatcaagctgtacagagaggagggcctggcctacatctggatgcccacccccgacatgagcaccgagggcagagtgcagatgctgccccaggccgtgtgcctgctgcacgccctgctggagaagggccacatcgtgtacgtgcactgcaacgccggcgtgggcagaagcaccgccgccgtgtgcggctggctgcagtacgtgatgggctggaacctgagaaaggtgcagtacttcctgatggccaagagacccgccgtgtacatcgacgaggaggccctggccagagcccaggaggacttcttccagaagttcggcaaggtgagaagcagcgtgtgcagcctgtag

SEQ ID NO: 80517 - DNA, 954 bp, Artificial Sequence
  Description of Artificial Sequence: Synthetic coding sequence
atgagattcagattcggcgtggtggtgccccccgccgtggccggcgccagacccgagctgctggtggtgggcagcagacccgagctgggcagatgggagcccagaggcgccgtgagactgagacccgccggcaccgccgccggcgacggcgccctggccctgcaggagcccggcctgtggctgggcgaggtggagctggccgccgaggaggccgcccaggacggcgccgagcccggcagagtggacaccttctggtacaagttcctgaagagagagcccggcggcgagctgagctgggagggcaacggcccccaccacgacagatgctgcacctacaacgagaacaacctggtggacggcgtgtactgcctgcccatcggccactggatcgaggccaccggccacaccaacgagatgaagcacaccaccgacttctacttcaacatcgccggccaccaggccatgcactacagcagaatcctgcccaacatctggctgggcagctgccccagacaggtggagcacgtgaccatcaagctgaagcacgagctgggcatcaccgccgtgatgaacttccagaccgagtgggacatcgtgcagaacagcagcggctgcaacagataccccgagcccatgacccccgacaccatgatcaagctgtacagagaggagggcctggcctacatctggatgcccacccccgacatgagcaccgagggcagagtgcagatgctgccccaggccgtgtgcctgctgcacgccctgctggagaagggccacatcgtgtacgtgcactgcaacgccggcgtgggcagaagcaccgccgccgtgtgcggctggctgcagtacgtgatgggctggaacctgagaaaggtgcagtacttcctgatggccaagagacccgccgtgtacatcgacgaggaggccgccagccaggacaccttccccctgtag

SEQ ID NO: 80518 - DNA, 714 bp, Artificial Sequence
  Description of Artificial Sequence: Synthetic coding sequence
tgagacaccttctggtacaagttcctgaagagagagcccggcggcgagctgagctgggagggcaacggcccccaccacgacagatgctgcacctacaacgagaacaacctggtggacggcgtgtactgcctgcccatcggccactggatcgaggccaccggccacaccaacgagatgaagcacaccaccgacttctacttcaacatcgccggccaccaggccatgcactacagcagaatcctgcccaacatctggctgggcagctgccccagacaggtggagcacgtgaccatcaagctgaagcacgagctgggcatcaccgccgtgatgaacttccagaccgagtgggacatcgtgcagaacagcagcggctgcaacagataccccgagcccatgacccccgacaccatgatcaagctgtacagagaggagggcctggcctacatctggatgcccacccccgacatgagcaccgagggcagagtgcagatgctgccccaggccgtgtgcctgctgcacgccctgctggagaagggccacatcgtgtacgtgcactgcaacgccggcgtgggcagaagcaccgccgccgtgtgcggctggctgcagtacgtgatgggctggaacctgagaaaggtgcagtacttcctgatggccaagagacccgccgtgtacatcgacgaggaggccgccagccaggacaccttccccctgtag

SEQ ID NO: 80519 - DNA, 513 bp, Artificial Sequence
  Description of Artificial Sequence: Synthetic coding sequence
tgaaacggcccccaccacgacagatgctgcacctacaacgagaacaacctggtggacggcgtgtactgcctgcccatcggccactggatcgaggccaccggccacaccaacgagatgaagcacaccaccgacttctacttcaacatcgccggccaccaggccatgcactacagcagaatcctgcccaacatctggctgggcagctgccccagacaggtggagcacgtgaccatcaagctgaagcacgagctgggcatcaccgccgtgatgaacttccagaccgagtgggacatcgtgcagaacagcagcggctgcaacagataccccgagcccatgacccccgacaccatgatcaagctgtacagagaggagggcctggcctacatctggatgcccacccccgacatgagcaccgaggacgagaagagaaccgccgacatgtgctgcagcggcatgtgggaggagaccgccgacttcggcctgggcatcctggactacctgaagcagaagtag

SEQ ID NO: 80520 - DNA, 813 bp, Artificial Sequence
  Description of Artificial Sequence: Synthetic coding sequence
atgagattcagattcggcgtggtggtgccccccgccgtggccggcgccagacccgagctgctggtggtgggcagcagacccgagctgggcagatgggagcccagaggcgccgtgagactgagacccgccggcaccgccgccggcgacggcgccctggccctgcaggagcccggcctgtggctgggcgaggtggagctggccgccgaggaggccgcccaggacggcgccgagcccggcagagtggacaccttctggtacaagttcctgaagagagagcccggcggcgagctgagctgggagggcaacggcccccaccacgacagatgctgcacctacaacgagaacaacctggtggacggcgtgtactgcctgcccatcggccactggatcgaggccaccggccacaccaacgagatgaagcacaccaccgacttctacttcaacatcgccggccaccaggccatgcactacagcagaatcctgcccaacatctggctgggcagctgccccagacaggtggagcacgtgaccatcaagctgaagcacgagctgggcatcaccgccgtgatgaacttccagaccgagtgggacatcgtgcagaacagcagcggctgcaacagataccccgagcccatgacccccgacaccatgatcaagctgtacagagaggagggcctggcctacatctggatgcccacccccgacatgagcaccgaggacgagaagagaaccgccgacatgtgctgcagcggcatgtgggaggagaccgccgacttcggcctgggcatcctggactacctgaagcagaagtag

SEQ ID NO: 80521 - DNA, 945 bp, Artificial Sequence
  Description of Artificial Sequence: Synthetic coding sequence
atggcccccccccaggtgctggccttcggcctgctgctggccgccgccaccgccaccttcgccgccgcccaggaggagtgcgtgtgcgagaactacaagctggccgtgaactgcttcgtgaacaacaacagacagtgccagtgcaccagcgtgggcgcccagaacaccgtgatctgcagcaagctggccgccaagtgcctggtgatgaaggccgagatgaacggcagcaagctgggcagaagagccaagcccgagggcgccctgcagaacaacgacggcctgtacgaccccgactgcgacgagagcggcctgttcaaggccaagcagtgcaacggcaccagcatgtgctggtgcgtgaacaccgccggcgtgagaagaaccgacaaggacaccgagatcacctgcagcgagagagtgagaacctactggatcatcatcgagctgaagcacaaggccagagagaagccctacgacagcaagagcctgagaaccgccctgcagaaggagatcaccaccagataccagctggaccccaagttcatcaccagcatcctgtacgagaacaacgtgatcaccatcgacctggtgcagaacagcagccagaagacccagaacgacgtggacatcgccgacgtggcctactacttcgagaaggacgtgaagggcgagagcctgttccacagcaagaagatggacctgaccgtgaacggcgagcagctggacctggaccccggccagaccctgatctactacgtggacgagaaggcccccgagttcagcatgcagggcctgaaggccggcgtgatcgccgtgatcgtggtggtggtgatcgccgtggtggccggcatcgtggtgctggtgatcagcagaaagaagagaatggccaagtacgagaaggccgagatcaaggagatgggcgagatgcacagagagctgaacgcctag

SEQ ID NO: 80522 - DNA, 474 bp, Artificial Sequence
  Description of Artificial Sequence: Synthetic coding sequence
atgctggtgctgctggccggcatcttcgtggtgcacatcgccaccgtgatcatgctgttcgtgagcaccatcgccaacgtgtggctggtgagcaacaccgtggacgccagcgtgggcctgtggaagaactgcaccaacatcagctgcagcgacagcctgagctacgccagcgaggacgccctgaagaccgtgcaggccttcatgatcctgagcatcatcttctgcgtgatcgccctgctggtgttcgtgttccagctgttcaccatggagaagggcaacagattcttcctgagcggcgccaccaccctggtgtgctggctgtgcatcctggtgggcgtgagcatctacaccagccactacgccaacagagacggcacccagtaccaccacggctacagctacatcctgggctggatctgcttctgcttcagcttcatcatcggcgtgctgtacctggtgctgagaaagaagtag

SEQ ID NO: 80523 - DNA, 426 bp, Artificial Sequence
  Description of Artificial Sequence: Synthetic coding sequence
atgctggtgctgctggccggcatcttcgtggtgcacatcgccaccgtgatcatgctgttcgtgagcaccatcgccaacgtgtggctggtgagcaacaccgtggacgccagcgtgggcctgtggaagaactgcaccaacatcagctgcagcgacagcctgagctacgccagcgaggacgccctgaagaccgtgcaggccttcatgatcctgagcatcatcttctgcgtgatcgccctgctggtgttcgtgttccagctgttcaccatggagaagggcaacagattcttcctgagcggcgccaccaccctggtgtgcttcatcatgagaatcgtgatggagagaagcatcaccaccgccatccccaccagctgggccggcagcgccagcgccagcgccagcagcagcgccttcagcatctggagctag

SEQ ID NO: 80524 - DNA, 12 bp, Artificial Sequence
  Description of Artificial Sequence: Synthetic coding sequence
atgctggtgtag

SEQ ID NO: 80525 - DNA, 504 bp, Artificial Sequence
  Description of Artificial Sequence: Synthetic coding sequence
atgctggtgctgctggccttcatcatcgccttccacatcaccagcgccgccctgctgttcatcgccaccgtggacaacgcctggtgggtgggcgacgagttcttcgccgacgtgtggagaatctgcaccaacaacaccaactgcaccgtgatcaacgacagcttccaggagtacagcaccctgcaggccgtgcaggccaccatgatcctgagcaccatcctgtgctgcatcgccttcttcatcttcgtgctgcagctgttcagactgaagcagggcgagagattcgtgctgaccagcatcatccagctgatgagctgcctgtgcgtgatgatcgccgccagcatctacaccgacagaagagaggacatccacgacaagaacgccaagttctaccccgtgaccagagagggcagctacggctacagctacatcctggcctgggtggccttcgcctgcaccttcatcagcggcatgatgtacctgatcctgagaaagagaaagtag

SEQ ID NO: 80526 - DNA, 504 bp, Artificial Sequence; identical to SEQ ID NO: 80525
  Description of Artificial Sequence: Synthetic coding sequence

SEQ ID NO: 80527 - DNA, 492 bp, Artificial Sequence
  Description of Artificial Sequence: Synthetic coding sequence
atgagcctgctgctgctggtggtgagcgccctgcacatcctgatcctgatcctgctgttcgtggccaccctggacaagagctggtggaccctgcccggcaaggagagcctgaacctgtggtacgactgcacctggaacaacgacaccaagacctgggcctgcagcaacgtgagcgagaacggctggctgaaggccgtgcaggtgctgatggtgctgagcctgatcctgtgctgcctgagcttcatcctgttcatgttccagctgtacaccatgagaagaggcggcctgttctacgccaccggcctgtgccagctgtgcaccagcgtggccgtgttcaccggcgccctgatctacgccatccacgccgaggagatcctggagaagcaccccagaggcggcagcttcggctactgcttcgccctggcctgggtggccttccccctggccctggtgagcggcatcatctacatccacctgagaaagagagagtag

SEQ ID NO: 80528 - DNA, 2034 bp, Artificial Sequence
  Description of Artificial Sequence: Synthetic coding sequence
atgaccgccagccccgactacctggtggtgctgttcggcatcaccgccggcgccaccggcgccaagctgggcagcgacgagaaggagctgatcctgctgttctggaaggtggtggacctggccaacaagaaggtgggccagctgcacgaggtgctggtgagacccgaccagctggagctgaccgaggactgcaaggaggagaccaagatcgacgtggagagcctgagcagcgccagccagctggaccaggccctgagacagttcaaccagagcgtgagcaacgagctgaacatcggcgtgggcaccagcttctgcctgtgcaccgacggccagctgcacgtgagacagatcctgcaccccgaggccagcaagaagaacgtgctgctgcccgagtgcttctacagcttcttcgacctgagaaaggagttcaagaagtgctgccccggcagccccgacatcgacaagctggacgtggccaccatgaccgagtacctgaacttcgagaagagcagcagcgtgagcagatacggcgccagccaggtggaggacatgggcaacatcatcctggccatgatcagcgagccctacaaccacagattcagcgaccccgagagagtgaactacaagttcgagagcggcacctgcagcaagatggagctgatcgacgacaacaccgtggtgagagccagaggcctgccctggcagagcagcgaccaggacatcgccagattcttcaagggcctgaacatcgccaagggcggcgccgccctgtgcctgaacgcccagggcagaagaaacggcgaggccctggtgagattcgtgagcgaggagcacagagacctggccctgcagagacacaagcaccacatgggcaccagatacatcgaggtgtacaaggccaccggcgaggacttcctgaagatcgccggcggcaccagcaacgaggtggcccagttcctgagcaaggagaaccaggtgatcgtgagaatgagaggcctgcccttcaccgccaccgccgaggaggtggtggccttcttcggccagcactgccccatcaccggcggcaaggagggcatcctgttcgtgacctaccccgacggcagacccaccggcgacgccttcgtgctgttcgcctgcgaggagtacgcccagaacgccctgagaaagcacaaggacctgctgggcaagagatacatcgagctgttcagaagcaccgccgccgaggtgcagcaggtgctgaacagattcagcagcgcccccctgatccccctgcccaccccccccatcatccccgtgctgccccagcagttcgtgccccccaccaacgtgagagactgcatcagactgagaggcctgccctacgccgccaccatcgaggacatcctggacttcctgggcgagttcgccaccgacatcagaacccacggcgtgcacatggtgctgaaccaccagggcagacccagcggcgacgccttcatccagatgaagagcgccgacagagccttcatggccgcccagaagtgccacaagaagaacatgaaggacagatacgtggaggtgttccagtgcagcgccgaggagatgaacttcgtgctgatgggcggcaccctgaacagaaacggcctgagcccccccccctgcctgagcccccccagctacaccttccccgcccccgccgccgtgatccccaccgaggccgccatctaccagcccagcgtgatcctgaaccccagagccctgcagcccagcaccgcctactaccccgccggcacccagctgttcatgaactacaccgcctactaccccagcccccccggcagccccaacagcctgggctacttccccaccgccgccaacctgagcggcgtgcccccccagcccggcaccgtggtgagaatgcagggcctggcctacaacaccggcgtgaaggagatcctgaacttcttccagggctaccagtacgccaccgaggacggcctgatccacaccaacgaccaggccagaaccctgcccaaggagtgggtgtgcatctag

SEQ ID NO: 80529 - DNA, 1980 bp, Artificial Sequence
  Description of Artificial Sequence: Synthetic coding sequence
atgaccgccagccccgactacctggtggtgctgttcggcatcaccgccggcgccaccggcgccaagctgggcagcgacgagaaggagctgatcctgctgttctggaaggtggtggacctggccaacaagaaggtgggccagctgcacgaggtgctggtgagacccgaccagctggagctgaccgaggactgcaaggaggagaccaagatcgacgtggagagcctgagcagcgccagccagctggaccaggccctgagacagttcaaccagagcgtgagcaacgagctgaacatcggcgtgggcaccagcttctgcctgtgcaccgacggccagctgcacgtgagacagatcctgcaccccgaggccagcaagaagaacgtgctgctgcccgagtgcttctacagcttcttcgacctgagaaaggagttcaagaagtgctgccccggcagccccgacatcgacaagctggacgtggccaccatgaccgagtacctgaacttcgagaagagcagcagcgtgagcagatacggcgccagccaggtggaggacatgggcaacatcatcctggccatgatcagcgagccctacaaccacagattcagcgaccccgagagagtgaactacaagttcgagagcggcacctgcagcaagatggagctgatcgacgacaacaccgtggtgagagccagaggcctgccctggcagagcagcgaccaggacatcgccagattcttcaagggcctgaacatcgccaagggcggcgccgccctgtgcctgaacgcccagggcagaagaaacggcgaggccctggtgagattcgtgagcgaggagcacagagacctggccctgcagagacacaagcaccacatgggcaccagatacatcgaggtgtacaaggccaccggcgaggacttcctgaagatcgccggcggcaccagcaacgaggtggcccagttcctgagcaaggagaaccaggtgatcgtgagaatgagaggcctgcccttcaccgccaccgccgaggaggtggtggccttcttcggccagcactgccccatcaccggcggcaaggagggcatcctgttcgtgacctaccccgacggcagacccaccggcgacgccttcgtgctgttcgcctgcgaggagtacgcccagaacgccctgagaaagcacaaggacctgctgggcaagagatacatcgagctgttcagaagcaccgccgccgaggtgcagcaggtgctgaacagattcagcagcgcccccctgatccccctgcccaccccccccatcatccccgtgctgccccagcagttcgtgccccccaccaacgtgagagactgcatcagactgagaggcctgccctacgccgccaccatcgaggacatcctggacttcctgggcgagttcgccaccgacatcagaacccacggcgtgcacatggtgctgaaccaccagggcagacccagcggcgacgccttcatccagatgaagagcgccgacagagccttcatggccgcccagaagtgccacaagaagaacatgaaggacagatacgtggaggtgttccagtgcagcgccgaggagatgaacttcgtgctgatgggcggcaccctgaacagaaacggcctgagcccccccccctgcctgagcccccccagctacaccttccccgcccccgccgccgtgatccccaccgaggccgccatctaccagcccagcgtgatcctgaaccccagagccctgcagcccagcaccgcctactaccccgccggcacccagctgttcatgaactacaccgcctactaccccagcccccccggcagccccaacagcctgggctacttccccaccgccgccaacctgagcggcgtgcccccccagcccggcaccgtggtgagaatgcagggcctggcctacaacaccggcgtgaaggagatcctgaacttcttccagggctaccagtgcctgaaggacgtgtggtag

SEQ ID NO: 80530 - DNA, 2046 bp, Artificial Sequence
  Description of Artificial Sequence: Synthetic coding sequence
atgaccgccagccccgactacctggtggtgctgttcggcatcaccgccggcgccaccggcgccaagctgggcagcgacgagaaggagctgatcctgctgttctggaaggtggtggacctggccaacaagaaggtgggccagctgcacgaggtgctggtgagacccgaccagctggagctgaccgaggactgcaaggaggagaccaagatcgacgtggagagcctgagcagcgccagccagctggaccaggccctgagacagttcaaccagagcgtgagcaacgagctgaacatcggcgtgggcaccagcttctgcctgtgcaccgacggccagctgcacgtgagacagatcctgcaccccgaggccagcaagaagaacgtgctgctgcccgagtgcttctacagcttcttcgacctgagaaaggagttcaagaagtgctgccccggcagccccgacatcgacaagctggacgtggccaccatgaccgagtacctgaacttcgagaagagcagcagcgtgagcagatacggcgccagccaggtggaggacatgggcaacatcatcctggccatgatcagcgagccctacaaccacagattcagcgaccccgagagagtgaactacaagttcgagagcggcacctgcagcaagatggagctgatcgacgacaacaccgtggtgagagccagaggcctgccctggcagagcagcgaccaggacatcgccagattcttcaagggcctgaacatcgccaagggcggcgccgccctgtgcctgaacgcccagggcagaagaaacggcgaggccctggtgagattcgtgagcgaggagcacagagacctggccctgcagagacacaagcaccacatgggcaccagatacatcgaggtgtacaaggccaccggcgaggacttcctgaagatcgccggcggcaccagcaacgaggtggcccagttcctgagcaaggagaaccaggtgatcgtgagaatgagaggcctgcccttcaccgccaccgccgaggaggtggtggccttcttcggccagcactgccccatcaccggcggcaaggagggcatcctgttcgtgacctaccccgacggcagacccaccggcgacgccttcgtgctgttcgcctgcgaggagtacgcccagaacgccctgagaaagcacaaggacctgctgggcaagagatacatcgagctgttcagaagcaccgccgccgaggtgcagcaggtgctgaacagattcagcagcgcccccctgatccccctgcccaccccccccatcatccccgtgctgccccagcagttcgtgccccccaccaacgtgagagactgcatcagactgagaggcctgccctacgccgccaccatcgaggacatcctggacttcctgggcgagttcgccaccgacatcagaacccacggcgtgcacatggtgctgaaccaccagggcagacccagcggcgacgccttcatccagatgaagagcgccgacagagccttcatggccgcccagaagtgccacaagaagaacatgaaggacagatacgtggaggtgttccagtgcagcgccgaggagatgaacttcgtgctgatgggcggcaccctgaacagaaacggcctgagcccccccccctgcaagctgccctgcctgagcccccccagctacaccttccccgcccccgccgccgtgatccccaccgaggccgccatctaccagcccagcgtgatcctgaaccccagagccctgcagcccagcaccgcctactaccccgccggcacccagctgttcatgaactacaccgcctactaccccagcccccccggcagccccaacagcctgggctacttccccaccgccgccaacctgagcggcgtgcccccccagcccggcaccgtggtgagaatgcagggcctggcctacaacaccggcgtgaaggagatcctgaacttcttccagggctaccagtacgccaccgaggacggcctgatccacaccaacgaccaggccagaaccctgcccaaggagtgggtgtgcatctag

SEQ ID NO: 80531 - DNA, 1827 bp, Artificial Sequence
  Description of Artificial Sequence: Synthetic coding sequence
atgaccgccagccccgactacctggtggtgctgttcggcatcaccgccggcgccaccggcgccaagctgggcagcgacgagaaggagctgatcctgctgttctggaaggtggtggacctggccaacaagaaggtgggccagctgcacgaggtgctggtgagacccgaccagctggagctgaccgaggactgcaaggaggagaccaagatcgacgtggagagcctgagcagcgccagccagctggaccaggccctgagacagttcaaccagagcgtgagcaacgagctgaacatcggcgtgggcaccagcttctgcctgtgcaccgacggccagctgcacgtgagacagatcctgcaccccgaggccagcaagaagaacgtgctgctgcccgagtgcttctacagcttcttcgacctgagaaaggagttcaagaagtgctgccccggcagccccgacatcgacaagctggacgtggccaccatgaccgagtacctgaacttcgagaagagcagcagcgtgagcagatacggcgccagccaggtggaggacatgggcaacatcatcctggccatgatcagcgagccctacaaccacagattcagcgaccccgagagagtgaactacaagttcgagagcggcacctgcagcaagatggagctgatcgacgacaacaccgtggtgagagccagaggcctgccctggcagagcagcgaccaggacatcgccagattcttcaagggcctgaacatcgccaagggcggcgccgccctgtgcctgaacgcccagggcagaagaaacggcgaggccctggtgagattcgtgagcgaggagcacagagacctggccctgcagagacacaagcaccacatgggcaccagatacatcgaggtgtacaaggccaccggcgaggacttcctgaagatcgccggcggcaccagcaacgaggtggcccagttcctgagcaaggagaaccaggtgatcgtgagaatgagaggcctgcccttcaccgccaccgccgaggaggtggtggccttcttcggccagcactgccccatcaccggcggcaaggagggcatcctgttcgtgacctaccccgacggcagacccaccggcgacgccttcgtgctgttcgcctgcgaggagtacgcccagaacgccctgagaaagcacaaggacctgctgggcaagagatacatcgagctgttcagaagcaccgccgccgaggtgcagcaggtgctgaacagattcagcagcgcccccctgatccccctgcccaccccccccatcatccccgtgctgccccagcagttcgtgccccccaccaacgtgagagactgcatcagactgagaggcctgccctacgccgccaccatcgaggacatcctggacttcctgggcgagttcgccaccgacatcagaacccacggcgtgcacatggtgctgaaccaccagggcagacccagcggcgacgccttcatccagatgaagagcgccgacagagccttcatggccgcccagaagtgccacaagaagaacatgaaggacagatacgtggaggtgttccagtgcagcgccgaggagatgaacttcgtgctgatgggcggcaccctgaacagaaacggcctgagcccccccccctgcaagctgccctgcctgagcccccccagctacaccttccccgcccccgccgccgtgatccccaccgaggccgccatctaccagcccagcgtgatcctgaaccccagagccctgcagcccagcaccgcctactaccccgccggcacccagctgttcatgaactacaccgcctactaccccagcgtgtag

SEQ ID NO: 80532 - DNA, 2154 bp, Artificial Sequence
  Description of Artificial Sequence: Synthetic coding sequence
atgacccccccccccccccccccccccccccccggccccgaccccgccgccgaccccgccgccgacccctgcccctggcccggcagcctggtggtgctgttcggcgccaccgccggcgccctgggcagagacctgggcagcgacgagaccgacctgatcctgctggtgtggcaggtggtggagcccagaagcagacaggtgggcaccctgcacaagagcctggtgagagccgaggccgccgccctgagcacccagtgcagagaggccagcggcctgagcgccgacagcctggccagagccgagcccctggacaaggtgctgcagcagttcagccagctggtgaacggcgacgtggccctgctgggcggcggcccctacatgctgtgcaccgacggccagcagctgctgagacaggtgctgcaccccgaggccagcagaaagaacctggtgctgcccgacatgttcttcagcttctacgacctgagaagagagttccacatgcagcaccccagcacctgccccgccagagacctgaccgtggccaccatggcccagggcctgggcctggagaccgacgccaccgaggacgacttcggcgtgtgggaggtgaagaccatggtggccgtgatcctgcacctgctgaaggagcccagcagccagctgttcagcaagcccgaggtgatcaagcagaagtacgagaccggcccctgcagcaaggccgacgtggtggacagcgagaccgtggtgagagccagaggcctgccctggcagagcagcgaccaggacgtggccagattcttcaagggcctgaacgtggccagaggcggcgtggccctgtgcctgaacgcccagggcagaagaaacggcgaggccctgatcagattcgtggacagcgagcagagagacctggccctgcagagacacaagcaccacatgggcgtgagatacatcgaggtgtacaaggccaccggcgaggagttcgtgaagatcgccggcggcaccagcctggaggtggccagattcctgagcagagaggaccaggtgatcctgagactgagaggcctgcccttcagcgccggccccaccgacgtgctgggcttcctgggccccgagtgccccgtgaccggcggcaccgagggcctgctgttcgtgagacaccccgacggcagacccaccggcgacgccttcgccctgttcgcctgcgaggagctggcccaggccgccctgagaagacacaagggcatgctgggcaagagatacatcgagctgttcagaagcaccgccgccgaggtgcagcaggtgctgaacagatacgccagcggccccctgctgcccaccctgaccgcccccctgctgcccatccccttccccctggcccccggcaccggcagagactgcgtgagactgagaggcctgccctacaccgccaccatcgaggacatcctgagcttcctgggcgaggccgccgccgacatcagaccccacggcgtgcacatggtgctgaaccagcagggcagacccagcggcgacgccttcatccagatgaccagcgccgagagagccctggccgccgcccagagatgccacaagaaggtgatgaaggagagatacgtggaggtggtgccctgcagcaccgaggagatgagcagagtgctgatgggcggcaccctgggcagaagcggcatgagcccccccccctgcaagctgccctgcctgagcccccccacctacaccaccttccaggccacccccaccctgatccccaccgagaccgccgccctgtaccccagcagcgccctgctgcccgccgccagagtgcccgccgcccccacccccgtggcctactaccccggccccgccacccagctgtacctgaactacaccgcctactaccccagcccccccgtgagccccaccaccgtgggctacctgaccacccccaccgccgccctggccagcgcccccaccagcgtgctgagccagagcggcgccctggtgagaatgcagggcgtgccctacaccgccggcatgaaggacctgctgagcgtgttccaggcctaccagctgcccgccgacgactacaccagcctgatgcccgtgggcgacccccccagaaccgtgctgcaggcccccaaggagtgggtgtgcctgtag

SEQ ID NO: 80533 - DNA, 924 bp, Artificial Sequence
  Description of Artificial Sequence: Synthetic coding sequence
atgaacaccagaaacagagtggtgaacagcggcctgggcgccagccccgccagcagacccaccagagacccccaggaccccagcggcagacagggcgagctgagccccgtggaggaccagagagagggcctggaggccgcccccaagggccccagcagagagagcgtggtgcacgccggccagagaagaaccagcgcctacaccctgatcgcccccaacatcaacagaagaaacgagatccagagaatcgccgagcaggagctggccaacctggagaagtggaaggagcagaacagagccaagcccgtgcacctggtgcccagaagactgggcggcagccagagcgagaccgaggtgagacagaagcagcagctgcagctgatgcagagcaagtacaagcagaagctgaagagagaggagagcgtgagaatcaagaaggaggccgaggaggccgagctgcagaagatgaaggccatccagagagagaagagcaacaagctggaggagaagaagagactgcaggagaacctgagaagagaggccttcagagagcaccagcagtacaagaccgccgagttcctgagcaagctgaacaccgagagccccgacagaagcgcctgccagagcgccgtgtgcggcccccagagcagcacctgggccagaagctgggcctacagagacagcctgaaggccgaggagaacagaaagctgcagaagatgaaggacgagcagcaccagaagagcgagctgctggagctgaagagacagcagcaggagcaggagagagccaagatccaccagaccgagcacagaagagtgaacaacgccttcctggacagactgcagggcaagagccagcccggcggcctggagcagagcggcggctgctggaacatgaacagcggcaacagctggggcatctag

SEQ ID NO: 80534 - DNA, 1233 bp, Artificial Sequence
  Description of Artificial Sequence: Synthetic coding sequence
atgaacaccagaaacagagtggtgaacagcggcctgggcgccagccccgccagcagacccaccagagacccccaggaccccagcggcagacagggcgagctgagccccgtggaggaccagagagagggcctggaggccgcccccaagggccccagcagagagagcgtggtgcacgccggccagagaagaaccagcgcctacaccctgatcgcccccaacatcaacagaagaaacgagatccagagaatcgccgagcaggagctggccaacctggagaagtggaaggagcagaacagagccaagcccgtgcacctggtgcccagaagactgggcggcagccagagcgagaccgaggtgagacagaagcagcagctgcagctgatgcagagcaagtacaagcagaagctgaagagagaggagagcgtgagaatcaagaaggaggccgaggaggccgagctgcagaagatgaaggccatccagagagagaagagcaacaagctggaggagaagaagagactgcaggagaacctgagaagagaggccttcagagagcaccagcagtacaagaccgccgagttcctgagcaagctgaacaccgagagccccgacagaagcgcctgccagagcgccgtgtgcggcccccagagcagcacctggaagctgcccatcctgcccagagaccacagctgggccagaagctgggcctacagagacagcctgaaggccgaggagaacagaaagctgcagaagatgaaggacgagcagcaccagaagagcgagctgctggagctgaagagacagcagcaggagcaggagagagccaagatccaccagaccgagcacagaagagtgaacaacgccttcctggacagactgcagggcaagagccagcccggcggcctggagcagagcggcggctgctggaacatgaacagcggcaacagctggggcagcctgctggtgttcagcagacacctgagagtgtacgagaagatcctgacccccatctggcccagcagcaccgacctggagaagccccacgagatgctgttcctgaacgtgatcctgttcagcctgaccgtgttcaccctgatcagcaccgcccacaccctggacagagccgtgagaagcgactggctgctgctggtgctgatctacgcctgcctggaggagctgatccccgagctgatcttcaacctgtactgccagggcaacgccaccctgttcttctag

SEQ ID NO: 80535 - DNA, 1368 bp, Artificial Sequence
  Description of Artificial Sequence: Synthetic coding sequence
atgtggctggagatcctgctgaccagcgtgctgggcttcgccatctactggttcatcagcagagacaaggaggagaccctgcccctggaggacggctggtggggccccggcaccagaagcgccgccagagaggacgacagcatcagacccttcaaggtggagaccagcgacgaggagatccacgacctgcaccagagaatcgacaagttcagattcaccccccccctggaggacagctgcttccactacggcttcaacagcaactacctgaagaaggtgatcagctactggagaaacgagttcgactggaagaagcaggtggagatcctgaacagatacccccacttcaagaccaagatcgagggcctggacatccacttcatccacgtgaagcccccccagctgcccgccggccacacccccaagcccctgctgatggtgcacggctggcccggcagcttctacgagttctacaagatcatccccctgctgaccgaccccaagaaccacggcctgagcgacgagcacgtgttcgaggtgatctgccccagcatccccggctacggcttcagcgaggccagcagcaagaagggcttcaacagcgtggccaccgccagaatcttctacaagctgatgctgagactgggcttccaggagttctacatccagggcggcgactggggcagcctgatctgcaccaacatggcccagctggtgcccagccacgtgaagggcctgcacctgaacatggccctggtgctgagcaacttcagcaccctgaccctgctgctgggccagagattcggcagattcctgggcctgaccgagagagacgtggagctgctgtaccccgtgaaggagaaggtgttctacagcctgatgagagagagcggctacatgcacatccagtgcaccaagcccgacaccgtgggcagcgccctgaacgacagccccgtgggcctggccgcctacatcctggagaagttcagcacctggaccaacaccgagttcagatacctggaggacggcggcctggagagaaagttcagcctggacgacctgctgaccaacgtgatgctgtactggaccaccggcaccatcatcagcagccagagattctacaaggagaacctgggccagggctggatgacccagaagcacgagagaatgaaggtgtacgtgcccaccggcttcagcgccttccccttcgagctgctgcacacccccgagaagtgggtgagattcaagtaccccaagctgatcagctacagctacatggtgagaggcggccacttcgccgccttcgaggagcccgagctgctggcccaggacatcagaaagttcctgagcgtgctggagagacagtag

SEQ ID NO: 80536 - DNA, 1368 bp, Artificial Sequence; identical to SEQ ID NO: 80535
  Description of Artificial Sequence: Synthetic coding sequence

SEQ ID NO: 80537 - DNA, 486 bp, Artificial Sequence
  Description of Artificial Sequence: Synthetic coding sequence
atgtggctggagatcctgctgaccagcgtgctgggcttcgccatctactggttcatcagcagagacaaggaggagaccctgcccctggaggacggctggtggggccccggcaccagaagcgccgccagagaggacgacagcatcagacccttcaaggtggagaccagcgacgaggagatccacgacctgcaccagagaatcgacaagttcagattcaccccccccctggaggacagctgcttccactacggcttcaacagcaactacctgaagaaggtgatcagctactggagaaacgagttcgactggaagaagcaggtggagatcctgaacagatacccccacttcaagaccaagatcgagggcctggacatccacttcatccacgtgaagcccccccagctgcccgccggccacacccccaagcccctgctgatggtgcacggctggcccggcagcttctacgagttctacaagatcatctag

SEQ ID NO: 80538 - DNA, 411 bp, Artificial Sequence
  Description of Artificial Sequence: Synthetic coding sequence
atgtggctggagatcctgctgaccagcgtgctgggcttcgccatctactggttcatcagcagagacaaggaggagaccctgcccctggaggacggctggtggggccccggcaccagaagcgccgccagagaggacgacagcatcagacccttcaaggtggagaccagcgacgaggagatccacgacctgcaccagagaatcgacaagttcagattcaccccccccctggaggacagctgcttccactacggcttcaacagcaactacctgaagaaggtgatcagctactggagaaacgagttcgactggaagaagcaggtggagatcctgaacagatacccccacttcaagaccaagatcgagggcctggacatccacttcatccacgtgaagcccccccagctgccctag

SEQ ID NO: 80539 - DNA, 1509 bp, Artificial Sequence
  Description of Artificial Sequence: Synthetic coding sequence
atgaagggcgagatcaccctgagccagtggatccccctgatggaggagaactgcagaaagtgcagcgagaccgccaaggtgtgcctgcccaagaacttcagcatcaaggagatcttcgacaaggccatcagcgccagaaagatcaacagacccatgctgcaggccgccctgatgctgagaaagaagggcttcaccaccgccatcctgaccaacacctggctggacgacagagccgagagagacggcctggcccagctgatgtgcgagctgaagatgcacttcgacttcctgatcgagagctgccaggtgggcatggtgaagcccgagccccagatctacaagttcctgctggacaccctgaaggccagccccagcgaggtggtgttcctggacgacatcggcgccaacctgaagcccgccagagacctgggcatggtgaccatcctggtgcaggacaccgacaccgccctgaaggagctggagaaggtgaccggcatccagctgctgaacacccccgcccccctgcccaccagctgcaaccccagcgacatgagccacggctacgtgaccgtgaagcccagagtgagactgcacttcgtggagctgggcagcggccccgccgtgtgcctgtgccacggcttccccgagagctggtacagctggagataccagatccccgccctggcccaggccggctacagagtgctggccatggacatgaagggctacggcgagagcagcgccccccccgagatcgaggagtactgcatggaggtgctgtgcaaggagatggtgaccttcctggacaagctgggcctgagccaggccgtgttcatcggccacgactggggcggcatgctggtgtggtacatggccctgttctaccccgagagagtgagagccgtggccagcctgaacacccccttcatccccgccaaccccaacatgagccccctggagagcatcaaggccaaccccgtgttcgactaccagctgtacttccaggagcccggcgtggccgaggccgagctggagcagaacctgagcagaaccttcaagagcctgttcagagccagcgacgagagcgtgctgagcatgcacaaggtgtgcgaggccggcggcctgttcgtgaacagccccgaggagcccagcctgagcagaatggtgaccgaggaggagatccagttctacgtgcagcagttcaagaagagcggcttcagaggccccctgaactggtacagaaacatggagagaaactggaagtgggcctgcaagagcctgggcagaaagatcctgatccccgccctgatggtgaccgccgagaaggacttcgtgctggtgccccagatgagccagcacatggaggactggatcccccacctgaagagaggccacatcgaggactgcggccactggacccagatggacaagcccaccgaggtgaaccagatcctgatcaagtggctggacagcgacgccagaaacccccccgtggtgagcaagatgtag

SEQ ID NO: 80540 - DNA, 1470 bp, Artificial Sequence
  Description of Artificial Sequence: Synthetic coding sequence
atggaggagaactgcagaaagtgcagcgagaccgccaaggtgtgcctgcccaagaacttcagcatcaaggagatcttcgacaaggccatcagcgccagaaagatcaacagacccatgctgcaggccgccctgatgctgagaaagaagggcttcaccaccgccatcctgaccaacacctggctggacgacagagccgagagagacggcctggcccagctgatgtgcgagctgaagatgcacttcgacttcctgatcgagagctgccaggtgggcatggtgaagcccgagccccagatctacaagttcctgctggacaccctgaaggccagccccagcgaggtggtgttcctggacgacatcggcgccaacctgaagcccgccagagacctgggcatggtgaccatcctggtgcaggacaccgacaccgccctgaaggagctggagaaggtgaccggcatccagctgctgaacacccccgcccccctgcccaccagctgcaaccccagcgacatgagccacggctacgtgaccgtgaagcccagagtgagactgcacttcgtggagctgggcagcggccccgccgtgtgcctgtgccacggcttccccgagagctggtacagctggagataccagatccccgccctggcccaggccggctacagagtgctggccatggacatgaagggctacggcgagagcagcgccccccccgagatcgaggagtactgcatggaggtgctgtgcaaggagatggtgaccttcctggacaagctgggcctgagccaggccgtgttcatcggccacgactggggcggcatgctggtgtggtacatggccctgttctaccccgagagagtgagagccgtggccagcctgaacacccccttcatccccgccaaccccaacatgagccccctggagagcatcaaggccaaccccgtgttcgactaccagctgtacttccaggagcccggcgtggccgaggccgagctggagcagaacctgagcagaaccttcaagagcctgttcagagccagcgacgagagcgtgctgagcatgcacaaggtgtgcgaggccggcggcctgttcgtgaacagccccgaggagcccagcctgagcagaatggtgaccgaggaggagatccagttctacgtgcagcagttcaagaagagcggcttcagaggccccctgaactggtacagaaacatggagagaaactggaagtgggcctgcaagagcctgggcagaaagatcctgatccccgccctgatggtgaccgccgagaaggacttcgtgctggtgccccagatgagccagcacatggaggactggatcccccacctgaagagaggccacatcgaggactgcggccactggacccagatggacaagcccaccgaggtgaaccagatcctgatcaagtggctggacagcgacgccagaaacccccccgtggtgagcaagatgtag

SEQ ID NO: 80541 - DNA, 1509 bp, Artificial Sequence
  Description of Artificial Sequence: Synthetic coding sequence
atgaccctgagagccgccgtgttcgacctggacggcgtgctggccctgcccgccgtgttcggcgtgctgggcagaaccgaggaggccctggccctgcccagaggcctgctgaacgacgccttccagaagggcggccccgagggcgccaccaccagactgatgaagggcgagatcaccctgagccagtggatccccctgatggaggagaactgcagaaagtgcagcgagaccgccaaggtgtgcctgcccaagaacttcagcatcaaggagatcttcgacaaggccatcagcgccagaaagatcaacagacccatgctgcaggccgccctgatgctgagaaagaaggccttctgcagcggcttcaccaccgccatcctgaccaacacctggctggacgacagagccgagagagacggcctggcccagctgatgtgcgagctgaagatgcacttcgacttcctgatcgagagctgccaggtgggcatggtgaagcccgagccccagatctacaagttcctgctggacaccctgaaggccagccccagcgaggtggtgttcctggacgacatcggcgccaacctgaagcccgccagagacctgggcatggtgaccatcctggtgcaggacaccgacaccgccctgaaggagctggagaaggtgaccggcatccagctgctgaacacccccgcccccctgcccaccagctgcaaccccagcgacatgagccacggctacgtgaccgtgaagcccagagtgagactgcacttcgtggagctgggcagcggccccgccgtgtgcctgtgccacggcttccccgagagctggtacagctggagataccagatccccgccctggcccaggccggctacagagtgctggccatggacatgaagggctacggcgagagcagcgccccccccgagatcgaggagtactgcatggaggtgctgtgcaaggagagcatcaaggccaaccccgtgttcgactaccagctgtacttccaggagcccggcgtggccgaggccgagctggagcagaacctgagcagaaccttcaagagcctgttcagagccagcgacgagagcgtgctgagcatgcacaaggtgtgcgaggccggcggcctgttcgtgaacagccccgaggagcccagcctgagcagaatggtgaccgaggaggagatccagttctacgtgcagcagttcaagaagagcggcttcagaggccccctgaactggtacagaaacatggagagaaactggaagtgggcctgcaagagcctgggcagaaagatcctgatccccgccctgatggtgaccgccgagaaggacttcgtgctggtgccccagatgagccagcacatggaggactggatcccccacctgaagagaggccacatcgaggactgcggccactggacccagatggacaagcccaccgaggtgaaccagatcctgatcaagtggctggacagcgacgccagaaacccccccgtggtgagcaagatgtag

SEQ ID NO: 80542 - DNA, 1668 bp, Artificial Sequence
  Description of Artificial Sequence: Synthetic coding sequence
atgaccctgagagccgccgtgttcgacctggacggcgtgctggccctgcccgccgtgttcggcgtgctgggcagaaccgaggaggccctggccctgcccagaggcctgctgaacgacgccttccagaagggcggccccgagggcgccaccaccagactgatgaagggcgagatcaccctgagccagtggatccccctgatggaggagaactgcagaaagtgcagcgagaccgccaaggtgtgcctgcccaagaacttcagcatcaaggagatcttcgacaaggccatcagcgccagaaagatcaacagacccatgctgcaggccgccctgatgctgagaaagaagggcttcaccaccgccatcctgaccaacacctggctggacgacagagccgagagagacggcctggcccagctgatgtgcgagctgaagatgcacttcgacttcctgatcgagagctgccaggtgggcatggtgaagcccgagccccagatctacaagttcctgctggacaccctgaaggccagccccagcgaggtggtgttcctggacgacatcggcgccaacctgaagcccgccagagacctgggcatggtgaccatcctggtgcaggacaccgacaccgccctgaaggagctggagaaggtgaccggcatccagctgctgaacacccccgcccccctgcccaccagctgcaaccccagcgacatgagccacggctacgtgaccgtgaagcccagagtgagactgcacttcgtggagctgggcagcggccccgccgtgtgcctgtgccacggcttccccgagagctggtacagctggagataccagatccccgccctggcccaggccggctacagagtgctggccatggacatgaagggctacggcgagagcagcgccccccccgagatcgaggagtactgcatggaggtgctgtgcaaggagatggtgaccttcctggacaagctgggcctgagccaggccgtgttcatcggccacgactggggcggcatgctggtgtggtacatggccctgttctaccccgagagagtgagagccgtggccagcctgaacacccccttcatccccgccaaccccaacatgagccccctggagagcatcaaggccaaccccgtgttcgactaccagctgtacttccaggagcccggcgtggccgaggccgagctggagcagaacctgagcagaaccttcaagagcctgttcagagccagcgacgagagcgtgctgagcatgcacaaggtgtgcgaggccggcggcctgttcgtgaacagccccgaggagcccagcctgagcagaatggtgaccgaggaggagatccagttctacgtgcagcagttcaagaagagcggcttcagaggccccctgaactggtacagaaacatggagagaaactggaagtgggcctgcaagagcctgggcagaaagatcctgatccccgccctgatggtgaccgccgagaaggacttcgtgctggtgccccagatgagccagcacatggaggactggatcccccacctgaagagaggccacatcgaggactgcggccactggacccagatggacaagcccaccgaggtgaaccagatcctgatcaagtggctggacagcgacgccagaaacccccccgtggtgagcaagatgtag

SEQ ID NO: 80543 - DNA, 1653 bp, Artificial Sequence
  Description of Artificial Sequence: Synthetic coding sequence
atgagcaccagcagcctgagaagacagatgaagaacatcgtgcacaactacagcgaggccgagatcaaggtgagagaggccaccagcaacgacccctggggccccagcagcagcctgatgagcgagatcgccgacctgacctacaacgtggtggccttcagcgagatcatgagcatgatctggaagagactgaacgaccacggcaagaactggagacacgtgtacaaggccatgaccctgatggagtacctgatcaagaccggcagcgagagagtgagccagcagtgcaaggagaacatgtacgccgtgcagaccctgaaggacttccagtacgtggacagagacggcaaggaccagggcgtgaacgtgagagagaaggccaagcagctggtggccctgctgagagacgaggacagactgagagaggagagagcccacgccctgaagaccaaggagaagctggcccagaccgccaccgccagcagcgccgccgtgggcagcggccccccccccgaggccgagcaggcctggccccagagcagcggcgaggaggagctgcagctgcagctggccctggccatgagcaaggaggaggccgaccaggaggagagaatcagaagaggcgacgacctgagactgcagatggccatcgaggagagcaagagagagaccggcggcaaggaggagagcagcctgatggacctggccgacgtgttcaccgcccccgcccccgcccccaccaccgacccctggggcggccccgcccccatggccgccgccgtgcccaccgccgcccccaccagcgacccctggggcggcccccccgtgccccccgccgccgacccctggggcggccccgcccccacccccgccagcggcgacccctggagacccgccgcccccgccggccccagcgtggacccctggggcggcacccccgcccccgccgccggcgagggccccacccccgacccctggggcagcagcgacggcggcgtgcccgtgagcggccccagcgccagcgacccctggacccccgcccccgccttcagcgacccctggggcggcagccccgccaagcccagcaccaacggcaccaccgccggcggcttcgacaccgagcccgacgagttcagcgacttcgacagactgagaaccgccctgcccaccagcggcagcagcgccggcgagctggagctgctggccggcgaggtgcccgccagaagccccggcgccttcgacatgagcggcgtgagaggcagcctggccgaggccgtgggcagccccccccccgccgccacccccacccccaccccccccaccagaaagacccccgagagcttcctgggccccaacgccgccctggtggacctggacagcctggtgagcagacccggccccaccccccccggcgccaaggccagcaaccccttcctgcccggcggcggccccgccaccggccccagcgtgaccaaccccttccagcccgccccccccgccaccctgaccctgaaccagctgagactgagccccgtgccccccgtgcccggcgccccccccacctacatcagccccctgggcggcggccccggcctgccccccatgatgccccccggcccccccgcccccaacaccaaccccttcctgctgtag

SEQ ID NO: 80544 - DNA, 1731 bp, Artificial Sequence
  Description of Artificial Sequence: Synthetic coding sequence
atgagcaccagcagcctgagaagacagatgaagaacatcgtgcacaactacagcgaggccgagatcaaggtgagagaggccaccagcaacgacccctggggccccagcagcagcctgatgagcgagatcgccgacctgacctacaacgtggtggccttcagcgagatcatgagcatgatctggaagagactgaacgaccacggcaagaactggagacacgtgtacaaggccatgaccctgatggagtacctgatcaagaccggcagcgagagagtgagccagcagtgcaaggagaacatgtacgccgtgcagaccctgaaggacttccagtacgtggacagagacggcaaggaccagggcgtgaacgtgagagagaaggccaagcagctggtggccctgctgagagacgaggacagactgagagaggagagagcccacgccctgaagaccaaggagaagctggcccagaccgccaccgccagcagcgccgccgtgggcagcggccccccccccgaggccgagcaggcctggccccagagcagcggcgaggaggagctgcagctgcagctggccctggccatgagcaaggaggaggccgaccagccccccagctgcggccccgaggacgacgcccagctgcagctggccctgagcctgagcagagaggagcacgacaaggaggagagaatcagaagaggcgacgacctgagactgcagatggccatcgaggagagcaagagagagaccggcggcaaggaggagagcagcctgatggacctggccgacgtgttcaccgcccccgcccccgcccccaccaccgacccctggggcggccccgcccccatggccgccgccgtgcccaccgccgcccccaccagcgacccctggggcggcccccccgtgccccccgccgccgacccctggggcggccccgcccccacccccgccagcggcgacccctggagacccgccgcccccgccggccccagcgtggacccctggggcggcacccccgcccccgccgccggcgagggccccacccccgacccctggggcagcagcgacggcggcgtgcccgtgagcggccccagcgccagcgacccctggacccccgcccccgccttcagcgacccctggggcggcagccccgccaagcccagcaccaacggcaccaccgccgccggcggcttcgacaccgagcccgacgagttcagcgacttcgacagactgagaaccgccctgcccaccagcggcagcagcgccggcgagctggagctgctggccggcgaggtgcccgccagaagccccggcgccttcgacatgagcggcgtgagaggcagcctggccgaggccgtgggcagccccccccccgccgccacccccacccccaccccccccaccagaaagacccccgagagcttcctgggccccaacgccgccctggtggacctggacagcctggtgagcagacccggccccaccccccccggcgccaaggccagcaaccccttcctgcccggcggcggccccgccaccggccccagcgtgaccaaccccttccagcccgccccccccgccaccctgaccctgaaccagctgagactgagccccgtgccccccgtgcccggcgccccccccacctacatcagccccctgggcggcggccccggcctgccccccatgatgccccccggcccccccgcccccaacaccaaccccttcctgctgtag

SEQ ID NO: 80545 - DNA, 1989 bp, Artificial Sequence
  Description of Artificial Sequence: Synthetic coding sequence
atgggcgaccagagctggctgtggaaccaggccgcccccggcgtgagaagccccgtgttcgcctgcagcgtggagaagggcaacgtgcccctggtgctgagcgagcacctggcccacagcagagaccccggcagcggcgccgtgagattcctgatcagccccgagccctgggccagcgccatcctgggcaccagcggcctgctggccagccccgtgctgcccgccgccctggacgccgtgacctgccagcacctgccccagcccagcagcggcagcagacccatcagccccagaatcggcgccctgtgccccctgctgctgcagcccggcaccatgagcaccagcagcctgagaagacagatgaagaacatcgtgcacaactacagcgaggccgagatcaaggtgagagaggccaccagcaacgacccctggggccccagcagcagcctgatgagcgagatcgccgacctgacctacaacgtggtggccttcagcgagatcatgagcatgatctggaagagactgaacgaccacggcaagaactggagacacgtgtacaaggccatgaccctgatggagtacctgatcaagaccggcagcgagagagtgagccagcagtgcaaggagaacatgtacgccgtgcagaccctgaaggacttccagtacgtggacagagacggcaaggaccagggcgtgaacgtgagagagaaggccaagcagctggtggccctgctgagagacgaggacagactgagagaggagagagcccacgccctgaagaccaaggagaagctggcccagaccgccaccgccagcagcgccgccgtgggcagcggccccccccccgaggccgagcaggcctggccccagagcagcggcgaggaggagctgcagctgcagctggccctggccatgagcaaggaggaggccgaccaggaggagagaatcagaagaggcgacgacctgagactgcagatggccatcgaggagagcaagagagagaccggcggcaaggaggagagcagcctgatggacctggccgacgtgttcaccgcccccgcccccgcccccaccaccgacccctggggcggccccgcccccatggccgccgccgtgcccaccgccgcccccaccagcgacccctggggcggcccccccgtgccccccgccgccgacccctggggcggccccgcccccacccccgccagcggcgacccctggagacccgccgcccccgccggccccagcgtggacccctggggcggcacccccgcccccgccgccggcgagggccccacccccgacccctggggcagcagcgacggcggcgtgcccgtgagcggccccagcgccagcgacccctggacccccgcccccgccttcagcgacccctggggcggcagccccgccaagcccagcaccaacggcaccaccgccgccggcggcttcgacaccgagcccgacgagttcagcgacttcgacagactgagaaccgccctgcccaccagcggcagcagcgccggcgagctggagctgctggccggcgaggtgcccgccagaagccccggcgccttcgacatgagcggcgtgagaggcagcctggccgaggccgtgggcagccccccccccgccgccacccccacccccaccccccccaccagaaagacccccgagagcttcctgggccccaacgccgccctggtggacctggacagcctggtgagcagacccggccccaccccccccggcgccaaggccagcaaccccttcctgcccggcggcggccccgccaccggccccagcgtgaccaaccccttccagcccgccccccccgccaccctgaccctgaaccagctgagactgagccccgtgccccccgtgcccggcgccccccccacctacatcagccccctgggcggcggccccggcctgccccccatgatgccccccggcccccccgcccccaacaccaaccccttcctgctgtag

SEQ ID NO: 80546 - DNA, 1611 bp, Artificial Sequence
  Description of Artificial Sequence: Synthetic coding sequence
atgagcgagatcgccgacctgacctacaacgtggtggccttcagcgagatcatgagcatgatctggaagagactgaacgaccacggcaagaactggagacacgtgtacaaggccatgaccctgatggagtacctgatcaagaccggcagcgagagagtgagccagcagtgcaaggagaacatgtacgccgtgcagaccctgaaggacttccagtacgtggacagagacggcaaggaccagggcgtgaacgtgagagagaaggccaagcagctggtggccctgctgagagacgaggacagactgagagaggagagagcccacgccctgaagaccaaggagaagctggcccagaccgccaccgccagcagcgccgccgtgggcagcggccccccccccgaggccgagcaggcctggccccagagcagcggcgaggaggagctgcagctgcagctggccctggccatgagcaaggaggaggccgaccagccccccagctgcggccccgaggacgacgcccagctgcagctggccctgagcctgagcagagaggagcacgacaaggaggagagaatcagaagaggcgacgacctgagactgcagatggccatcgaggagagcaagagagagaccggcggcaaggaggagagcagcctgatggacctggccgacgtgttcaccgcccccgcccccgcccccaccaccgacccctggggcggccccgcccccatggccgccgccgtgcccaccgccgcccccaccagcgacccctggggcggcccccccgtgccccccgccgccgacccctggggcggccccgcccccacccccgccagcggcgacccctggagacccgccgcccccgccggccccagcgtggacccctggggcggcacccccgcccccgccgccggcgagggccccacccccgacccctggggcagcagcgacggcggcgtgcccgtgagcggccccagcgccagcgacccctggacccccgcccccgccttcagcgacccctggggcggcagccccgccaagcccagcaccaacggcaccaccgccggcggcttcgacaccgagcccgacgagttcagcgacttcgacagactgagaaccgccctgcccaccagcggcagcagcgccggcgagctggagctgctggccggcgaggtgcccgccagaagccccggcgccttcgacatgagcggcgtgagaggcagcctggccgaggccgtgggcagccccccccccgccgccacccccacccccaccccccccaccagaaagacccccgagagcttcctgggccccaacgccgccctggtggacctggacagcctggtgagcagacccggccccaccccccccggcgccaaggccagcaaccccttcctgcccggcggcggccccgccaccggccccagcgtgaccaaccccttccagcccgccccccccgccaccctgaccctgaaccagctgagactgagccccgtgccccccgtgcccggcgccccccccacctacatcagccccctgggcggcggccccggcctgccccccatgatgccccccggcccccccgcccccaacaccaaccccttcctgctgtag

SEQ ID NO: 80547 - DNA, 1926 bp, Artificial Sequence
  Description of Artificial Sequence: Synthetic coding sequence
atgaccaccagcagcatcagaagacagatgaagaacatcgtgaacaactacagcgaggccgagatcaaggtgagagaggccaccagcaacgacccctggggccccagcagcagcctgatgaccgagatcgccgacctgacctacaacgtggtggccttcagcgagatcatgagcatggtgtggaagagactgaacgaccacggcaagaactggagacacgtgtacaaggccctgaccctgctggactacctgatcaagaccggcagcgagagagtggcccagcagtgcagagagaacatcttcgccatccagaccctgaaggacttccagtacatcgacagagacggcaaggaccagggcatcaacgtgagagagaagagcaagcagctggtggccctgctgaaggacgaggagagactgaaggccgagagagcccaggccctgaagaccaaggagagaatggcccaggtggccaccggcatgggcagcaaccagatcaccttcggcagaggcagcagccagcccaacctgagcaccagccacagcgagcaggagtacggcaaggccggcggcagccccgccagctaccacggcagccccgaggccagcctgtgcccccagcacagaaccggcgcccccctgggccagagcgaggagctgcagcccctgagccagagacaccccttcctgccccacctgggcctggccagcagacccaacggcgactggagccagccctgcctgacctgcgacagagccgccagagccaccagccccagagtgagcagcgagctggagcaggccagaccccagaccagcggcgaggaggagctgcagctgcagctggccctggccatgagcagagaggtggccgagcaggaggagagactgagaagaggcgacgacctgagactgcagatggccctggaggagagcagaagagacaccgtgaagatccccaagaagaaggagcacggcagcctgccccagcagaccaccctgctggacctgatggacgccctgcccagcagcggccccgccgcccagaaggccgagccctggggccccagcgccagcaccaaccagaccaacccctggggcggccccgccgcccccgccagcaccagcgacccctggcccagcttcggcaccaagcccgccgccagcatcgacccctggggcgtgcccaccggcgccaccgtgcagagcgtgcccaagaacagcgacccctgggccgccagccagcagcccgccagcagcgccggcaagagagccagcgacgcctggggcgccgtgagcaccaccaagcccgtgagcgtgagcggcagcttcgagctgttcagcaacctgaacggcaccatcaaggacgacttcagcgagttcgacaacctgagaaccagcaagaagaccgccgagagcgtgaccagcctgcccagccagaacaacggcaccaccagccccgaccccttcgagagccagcccctgaccgtggccagcagcaagcccagcagcgccagaaagacccccgagagcttcctgggccccaacgccgccctggtgaacctggacagcctggtgaccagacccgccccccccgcccagagcctgaaccccttcctggcccccggcgcccccgccaccagcgcccccgtgaaccccttccaggtgaaccagccccagcccctgaccctgaaccagctgagaggcagccccgtgctgggcaccagcaccagcttcggccccggccccggcgtggagagcatggccgtggccagcatgaccagcgccgccccccagcccgccctgggcgccaccggcagcagcctgacccccctgggccccgccatgatgaacatggtgggcagcgtgggcatcccccccagcgccgcccaggccaccggcaccaccaaccccttcctgctgtag

SEQ ID NO: 80548 - DNA, 1755 bp, Artificial Sequence
  Description of Artificial Sequence: Synthetic coding sequence
atgaccaccagcagcatcagaagacagatgaagaacatcgtgaacaactacagcgaggccgagatcaaggtgagagaggccaccagcaacgacccctggggccccagcagcagcctgatgaccgagatcgccgacctgacctacaacgtggtggccttcagcgagatcatgagcatggtgtggaagagactgaacgaccacggcaagaactggagacacgtgtacaaggccctgaccctgctggactacctgatcaagaccggcagcgagagagtggcccagcagtgcagagagaacatcttcgccatccagaccctgaaggacttccagtacatcgacagagacggcaaggaccagggcatcaacgtgagagagaagagcaagcagctggtggccctgctgaaggacgaggagagactgaaggccgagagagcccaggccctgaagaccaaggagagaatggcccaggtggccaccggcatgggcagcaaccagatcaccttcggcagaggcagcagccagcccaacctgagcaccagccacagcgagcaggagtacggcaaggccggcggcagccccgccagctaccacggcagcaccagccccagagtgagcagcgagctggagcaggccagaccccagaccagcggcgaggaggagctgcagctgcagctggccctggccatgagcagagaggtggccgagcaggaggagagactgagaagaggcgacgacctgagactgcagatggccctggaggagagcagaagagacaccgtgaagatccccaagaagaaggagcacggcagcctgccccagcagaccaccctgctggacctgatggacgccctgcccagcagcggccccgccgcccagaaggccgagccctggggccccagcgccagcaccaaccagaccaacccctggggcggccccgccgcccccgccagcaccagcgacccctggcccagcttcggcaccaagcccgccgccagcatcgacccctggggcgtgcccaccggcgccaccgtgcagagcgtgcccaagaacagcgacccctgggccgccagccagcagcccgccagcagcgccggcaagagagccagcgacgcctggggcgccgtgagcaccaccaagcccgtgagcgtgagcggcagcttcgagctgttcagcaacctgaacggcaccatcaaggacgacttcagcgagttcgacaacctgagaaccagcaagaagaccgccgagagcgtgaccagcctgcccagccagaacaacggcaccaccagccccgaccccttcgagagccagcccctgaccgtggccagcagcaagcccagcagcgccagaaagacccccgagagcttcctgggccccaacgccgccctggtgaacctggacagcctggtgaccagacccgccccccccgcccagagcctgaaccccttcctggcccccggcgcccccgccaccagcgcccccgtgaaccccttccaggtgaaccagccccagcccctgaccctgaaccagctgagaggcagccccgtgctgggcaccagcaccagcttcggccccggccccggcgtggagagcatggccgtggccagcatgaccagcgccgccccccagcccgccctgggcgccaccggcagcagcctgacccccctgggccccgccatgatgaacatggtgggcagcgtgggcatcccccccagcgccgcccaggccaccggcaccaccaaccccttcctgctgtag

SEQ ID NO: 80549 - DNA, 1071 bp, Artificial Sequence
  Description of Artificial Sequence: Synthetic coding sequence
atgagcagagaggtggccgagcaggaggagagactgagaagaggcgacgacctgagactgcagatggccctggaggagagcagaagagacaccgtgaagatccccaagaagaaggagcacggcagcctgccccagcagaccaccctgctggacctgatggacgccctgcccagcagcggccccgccgcccagaaggccgagccctggggccccagcgccagcaccaaccagaccaacccctggggcggccccgccgcccccgccagcaccagcgacccctggcccagcttcggcaccaagcccgccgccagcatcgacccctggggcgtgcccaccggcgccaccgtgcagagcgtgcccaagaacagcgacccctgggccgccagccagcagcccgccagcagcgccggcaagagagccagcgacgcctggggcgccgtgagcaccaccaagcccgtgagcgtgagcggcagcttcgagctgttcagcaacctgaacggcaccatcaaggacgacttcagcgagttcgacaacctgagaaccagcaagaagaccgccgagagcgtgaccagcctgcccagccagaacaacggcaccaccagccccgaccccttcgagagccagcccctgaccgtggccagcagcaagcccagcagcgccagaaagacccccgagagcttcctgggccccaacgccgccctggtgaacctggacagcctggtgaccagacccgccccccccgcccagagcctgaaccccttcctggcccccggcgcccccgccaccagcgcccccgtgaaccccttccaggtgaaccagccccagcccctgaccctgaaccagctgagaggcagccccgtgctgggcaccagcaccagcttcggccccggccccggcgtggagagcatggccgtggccagcatgaccagcgccgccccccagcccgccctgggcgccaccggcagcagcctgacccccctgggccccgccatgatgaacatggtgggcagcgtgggcatcccccccagcgccgcccaggccaccggcaccaccaaccccttcctgctgtag

SEQ ID NO: 80550 - DNA, 1755 bp, Artificial Sequence; identical to SEQ ID NO: 80548
  Description of Artificial Sequence: Synthetic coding sequence

SEQ ID NO: 80551 - DNA, 1455 bp, Artificial Sequence
  Description of Artificial Sequence: Synthetic coding sequence
atgaccaccagcagcatcagaagacagatgaagaacatcgtgaacaactacagcgaggccgagatcaaggtgagagaggccaccagcaacgacccctggggccccagcagcagcctgatgaccgagatcgccgacctgacctacaacgtggtggccttcagcgagatcatgagcatggtgtggaagagactgaacgaccacggcaagaactggagacacgtgtacaaggccctgaccctgctggactacctgatcaagaccggcagcgagagagtggcccagcagtgcagagagaacatcttcgccatccagaccctgaaggacttccagtacatcgacagagacggcaaggaccagggcatcaacgtgagagagaagagcaagcagctggtggccctgctgaaggacgaggagagactgaaggccgagagagcccaggccctgaagaccaaggagagaatggcccaggtggccaccggcatgggcagcaaccagatcaccttcggcagaggcagcagccagcccaacctgagcaccagccacagcgagcaggagtacggcaaggccggcggcagccccgccagctaccacggcagccccgaggccagcctgtgcccccagcacagaaccggcgcccccctgggccagagcgaggagctgcagcccctgagccagagacaccccttcctgccccacctgggcctggccagcagacccaacggcgactggagccagccctgcctgacctgcgacagagccgccagagccaccagccccagagtgagcagcgagctggagcaggccagaccccagaccagcggcgaggaggagctgcagctgcagctggccctggccatgagcagagaggtggccgagcaggaggagagactgagaagaggcgacgacctgagactgcagatggccctggaggagagcagaagagacaccgtgaagatccccaagaagaaggagcacggcagcctgccccagcagaccaccctgctggacctgatggacgccctgcccagcagcggccccgccgcccagaaggccgagccctggggccccagcgccagcaccaaccagaccaacccctggggcggccccgccgcccccgccagcaccagcgacccctggcccagcttcggcaccaagcccgccgccagcatcgacccctggggcgtgcccaccggcgccaccgtgcagagcgtgcccaagaacagcgacccctgggccgccagccagcagcccgccagcagcgccggcaagagagccagcgacgcctggggcgccgtgagcaccaccaagcccgtgagcgtgagcggcagcttcgagctgttcagcaacctgaacggcaccatcaaggacgacttcagcgagttcgacaacctgagaaccagcaagaagaccggcatgcagggcctgaccggcctgctgttcaccatggagatctag

SEQ ID NO: 80552 - DNA, 1500 bp, Artificial Sequence
  Description of Artificial Sequence: Synthetic coding sequence
atgaccaccagcagcatcagaagacagatgaagaacatcgtgaacaactacagcgaggccgagatcaaggtgagagaggccaccagcaacgacccctggggccccagcagcagcctgatgaccgagatcgccgacctgacctacaacgtggtggccttcagcgagatcatgagcatggtgtggaagagactgaacgaccacggcaagaactggagacacgtgtacaaggccctgaccctgctggactacctgatcaagaccggcagcgagagagtggcccagcagtgcagagagaacatcttcgccatccagaccctgaaggacttccagtacatcgacagagacggcaaggaccagggcatcaacgtgagagagaagagcaagcagctggtggccctgctgaaggacgaggagagactgaaggccgagagagcccaggccctgaagaccaaggagagaatggcccaggtggccaccggcatgggcagcaaccagatcaccttcggcagaggcagcagccagcccaacctgagcaccagccacagcgagcaggagtacggcaaggccggcggcagccccgccagctaccacggcagcaccagccccagagtgagcagcgagctggagcaggccagaccccagaccagcggcgaggaggagctgcagctgcagctggccctggccatgagcagagaggtggccgagcaggaggagagactgagaagaggcgacgacctgagactgcagatggccctggaggagagcagaagagacaccgtgaagatccccaagaagaaggagcacggcagcctgccccagcagaccaccctgctggacctgatggacgccctgcccagcagcggccccgccgcccagaaggccgagccctggggccccagcgccagcaccaaccagaccaacccctggggcggccccgccgcccccgccagcaccagcgacccctggcccagcttcggcaccaagcccgccgccagcatcgacccctggggcgtgcccaccggcgccaccgtgcagagcgtgcccaagaacagcgacccctgggccgccagccagcagcccgccagcagcgccggcaagagagccagcgacgcctggggcgccgtgagcaccaccaagcccgtgagcgtgagcggcagcttcgagctgttcagcaacctgaacggcaccatcaaggacgacttcagcgagttcgacaacctgagaaccagcaagaagaccgccgagagcgtgaccagcctgcccagccagaacaacggcaccaccagccccgaccccttcgagagccagcccctgaccgtggccagcagcaagcccagcagcgccagaaagacccccgagagcttcctgggccccaacgccgccctggtgaacctggacagcctggtgaccagacccgccccccccgcccagagcctgaaccccttcctggcccccggcatgcagggcctgaccggcctgctgttcaccatggagatctag

SEQ ID NO: 80553 - DNA, 1899 bp, Artificial Sequence
  Description of Artificial Sequence: Synthetic coding sequence
atgaccaccagcgccctgagaagacaggtgaagaacatcgtgcacaactacagcgaggccgagatcaaggtgagagaggccaccagcaacgacccctggggcccccccagcagcctgatgagcgagatcgccgacctgaccttcaacaccgtggccttcaccgaggtgatgggcatgctgtggagaagactgaacgacagcggcaagaactggagacacgtgtacaaggccctgaccctgctggactacctgctgaagaccggcagcgagagagtggcccaccagtgcagagagaacctgtacaccatccagaccctgaaggacttccagtacatcgacagagacggcaaggaccagggcgtgaacgtgagagagaaggtgaagcaggtgatggccctgctgaaggacgaggagagactgagacaggagagaacccacgccctgaagaccaaggagagaatggccctggagggcatcggcatcggcagcggccagctgggcttcagcagaagatacggcgaggactacagcagaagcagaggcagccccagcagctacaacagcagcagcagcagccccagatacaccagcgacctggagcaggccagaccccagaccagcggcgaggaggagctgcagctgcagctggccctggccatgagcagagaggaggccgagaagcccgtgccccccgccagccacagagacgaggacctgcagctgcagctggccctgagactgagcagacaggagcacgagaaggaggtgagaagctggcagggcgacggcagccccatggccaacggcgccggcgccgtggtgcaccaccagagagacagagagcccgagagagaggagagaaaggaggaggagaagctgaagaccagccagagcagcatcctggacctggccgacatcttcgtgcccgccctggccccccccagcacccactgcagcgccgacccctgggacatccccggcttcagacccaacaccgaggccagcggcagcagctggggccccagcgccgacccctggagccccatccccagcggcaccgtgctgagcagaagccagccctgggacctgacccccatgctgagcagcagcgagccctggggcagaacccccgtgctgcccgccggcccccccaccaccgacccctgggccctgaacagcccccaccacaagctgcccagcaccggcgccgacccctggggcgccagcctggagaccagcgacacccccggcggcgccagcaccttcgaccccttcgccaagccccccgagagcaccgagaccaaggagggcctggagcaggccctgcccagcggcaagcccagcagccccgtggagctggacctgttcggcgaccccagccccagcagcaagcagaacggcaccaaggagcccgacgccctggacctgggcatcctgggcgaggccctgacccagcccagcaaggaggccagagcctgcagaacccccgagagcttcctgggccccagcgccagcagcctggtgaacctggacagcctggtgaaggccccccaggtggccaagaccagaaaccccttcctgaccggcctgagcgcccccagccccaccaaccccttcggcgccggcgagcccggcagacccaccctgaaccagatgagaaccggcagccccgccctgggcctggccggcggccccgtgggcgcccccctgggcagcatgacctacagcgccagcctgcccctgcccctgagcagcgtgcccgccggcctgaccctgcccgccagcgtgagcgtgttcccccaggccggcgccttcgccccccagcccctgctgcccacccccagcagcgccggccccagacccccccccccccagaccggcaccaaccccttcctgtag

SEQ ID NO: 80554 - DNA, 957 bp, Artificial Sequence
  Description of Artificial Sequence: Synthetic coding sequence
atgaccaccagcgccctgagaagacaggtgaagaacatcgtgcacaactacagcgaggccgagatcaaggtgagagaggccaccagcaacgacccctggggcccccccagcagcctgatgagcgagatcgccgacctgaccttcaacaccgtggccttcaccgaggtgatgggcatgctgtggagaagactgaacgacagcggcaagaactggagacacgtgtacaaggccctgaccctgctggactacctgctgaagaccggcagcgagagagtggcccaccagtgcagagagaacctgtacaccatccagaccctgaaggacttccagtacatcgacagagacggcaaggaccagggcgtgaacgtgagagagaaggtgaagcaggtgatggccctgctgaaggacgaggagagactgagacaggagagaacccacgccctgaagaccaaggagagaatggccctggagggcatcggcatcggcagcggccagctgggcttcagcagaagatacggcgaggactacagcagaagcagaggcagccccagcagctacaacagcagcagcagcagccccagatacaccagcgacctggagcaggccagaccccagaccagcggcgaggaggagctgcagctgcagctggccctggccatgagcagagaggaggccgagaagcccgtgccccccgccagccacagagacgaggacctgcagctgcagctggccctgagactgagcagacaggagcacgagaaggaggtgagaagctggcagggcgacggcagccccatggccaacggcgccggcgccgtggtgcaccaccagagagacagagagcccgagagagaggagagaaaggaggaggagaagctgaagaccagccaggccccccccaccagcgagcccagactgcccctgcccagcaccgtgctgcaccccggcctgggctag

SEQ ID NO: 80555 - DNA, 1725 bp, Artificial Sequence
  Description of Artificial Sequence: Synthetic coding sequence
atggccctggagaccctgcccagactgtgcagacccgccgccgcccaggtgggcggcagcccccagagactgctgggcctgggcctgggccccagagagcccgccctggagccccacgtggagcccaaggacgccgccgccctgctgaccagacagcccatcctgcaggactgcgacctggccaccgtggccctgagcccccccccccccgccggcgccagagccacccacctgcaggtgagcagccacgacgacctgagaacccccgcccccggcgaggagcacagagcccagctgctgagaggcagaaaccaggtggccttcaccgaggtgatgggcatgctgtggagaagactgaacgacagcggcaagaactggagacacgtgtacaaggccctgaccctgctggactacctgctgaagaccggcagcgagagagtggcccaccagtgcagagagaacctgtacaccatccagaccctgaaggacttccagtacatcgacagagacggcaaggaccagggcgtgaacgtgagagagaaggtgaagcaggtgatggccctgctgaaggacgaggagagactgagacaggagagaacccacgccctgaagaccaaggagagaatggccctggagggcatcggcatcggcagcggccagctgggcttcagcagaagatacggcgaggactacagcagaagcagaggcagccccagcagctacaacagcagcagcagcagccccagatacaccagcgacctggagcaggccagaccccagaccagcggcgaggaggagctgcagctgcagctggccctggccatgagcagagaggaggccgagaaggaggtgagaagctggcagggcgacggcagccccatggccaacggcgccggcgccgtggtgcaccaccagagagacagagagcccgagagagaggagagaaaggaggaggagaagctgaagaccagccagagcagcatcctggacctggccgacatcttcgtgcccgccctggccccccccagcacccactgcagcgccgacccctgggacatccccggcttcagacccaacaccgaggccagcggcagcagctggggccccagcgccgacccctggagccccatccccagcggcaccgtgctgagcagaagccagccctgggacctgacccccatgctgagcagcagcgagccctggggcagaacccccgtgctgcccgccggcccccccaccaccgacccctgggccctgaacagcccccaccacaagctgcccagcaccggcgccgacccctggggcgccagcctggagaccagcgacacccccggcggcgccagcaccttcgaccccttcgccaagccccccgagagcaccgagaccaaggagggcctggagcaggccctgcccagcggcaagcccagcagccccgtggagctggacctgttcggcgaccccagccccagcagcaagcagaacggcaccaaggagcccgacgccctggacctgggcatcctgggcgaggccctgacccagcccagcaaggaggccagagcctgcagaacccccgagagcttcctgggccccagcgccagcagcctggtgaacctggacagcctggtgaaggccccccaggtggccaagaccagaaaccccttcctgaccggcctgagcgccccccccagactgagaaccagaggctgggccggcagaagatgctag

SEQ ID NO: 80556 - DNA, 507 bp, Artificial Sequence
  Description of Artificial Sequence: Synthetic coding sequence
atgaccaccagcgccctgagaagacaggtgaagaacatcgtgcacaactacagcgaggccgagatcaaggtgagagaggccaccagcaacgacccctggggcccccccagcagcctgatgagcgagatcgccgacctgaccttcaacaccgtggccttcaccgaggtgatgggcatgctgtggagaagactgaacgacagcggcaagaactggagacacgtgtacaaggccctgaccctgctggactacctgctgaagaccggcagcgagagagtggcccaccagtgcagagagaacctgtacaccatccagaccctgaaggacttccagtacatcgacagagacggcaaggaccagggcgtgaacgtgagagagaaggtgaagcaggtgatggccctgctgaaggacgaggagagactgagacaggagagaacccacgccctgaagaccaaggagagaatggccctggagggcatcggcatcggcagcggccagctgggcttctag

SEQ ID NO: 80557 - DNA, 36 bp, Artificial Sequence
  Description of Artificial Sequence: Synthetic coding sequence
atgaccaccagcgccctgagaagacaggtgaagtag

SEQ ID NO: 80558 - DNA, 411 bp, Artificial Sequence
  Description of Artificial Sequence: Synthetic coding sequence
atgaccaccagcgccctgagaagacaggtgaagaacatcgtgcacaactacagcgaggccgagatcaaggtgagagaggccaccagcaacgacccctggggcccccccagcagcctgatgagcgagatcgccgacctgaccttcaacaccgtggccttcaccgaggtgatgggcatgctgtggagaagactgaacgacagcggcaagaactggagacacgtgtacaaggccctgaccctgctggactacctgctgaagaccggcagcgagagagtggcccaccagtgcagagagaacctgtacaccatccagaccctgaaggacttccagtacatcgacagagacggcaaggaccagggcgtgaacgtgagagagaaggtgaagcaggtgatggccctgctgaaggactag

SEQ ID NO: 80559 - DNA, 156 bp, Artificial Sequence
  Description of Artificial Sequence: Synthetic coding sequence
atgaccaccagcgccctgagaagacaggtgaagaacatcgtgcacaactacagcgaggccgagatcaaggtgagagaggccaccagcaacgacccctggggcccccccagcagcctgatgagcgagatcgccgacctgaccttcaacaccgtgtag

SEQ ID NO: 80560 - DNA, 327 bp, Artificial Sequence
  Description of Artificial Sequence: Synthetic coding sequence
atgaccaccagcgccctgagaagacaggtgaagaacatcgtgcacaactacagcgaggccgagatcaaggtgagagaggccaccagcaacgacccctggggcccccccagcagcctgatgagcgagatcgccgacctgaccttcaacaccgtggccttcaccgaggtgatgggcatgctgtggagaagactgaacgacagcggcaagaactggagacacgtgtacaaggccctgaccctgctggactacctgctgaagaccggcagcgagagagtggcccaccagtgcagagagaacctgtacaccatccagaccctgaaggactag

SEQ ID NO: 80561 - DNA, 1983 bp, Artificial Sequence
  Description of Artificial Sequence: Synthetic coding sequence
atggccctggagaccctgcccagactgtgcagacccgccgccgcccaggtgggcggcagcccccagagactgctgggcctgggcctgggccccagagagcccgccctggagccccacgtggagcccaaggacgccgccgccctgctgaccagacagcccatcctgcaggactgcgacctggccaccgtggccctgagcccccccccccccgccggcgccagagccacccacctgcaggtgagcagccacgacgacctgagaacccccgcccccggcgaggagcacagagcccagctgctgagaggcagaaaccaggtggccttcaccgaggtgatgggcatgctgtggagaagactgaacgacagcggcaagaactggagacacgtgtacaaggccctgaccctgctggactacctgctgaagaccggcagcgagagagtggcccaccagtgcagagagaacctgtacaccatccagaccctgaaggacttccagtacatcgacagagacggcaaggaccagggcgtgaacgtgagagagaaggtgaagcaggtgatggccctgctgaaggacgaggagagactgagacaggagagaacccacgccctgaagaccaaggagagaatggccctggagggcatcggcatcggcagcggccagctgggcttcagcagaagatacggcgaggactacagcagaagcagaggcagccccagcagctacaacagcagcagcagcagccccagatacaccagcgacctggagcaggccagaccccagaccagcggcgaggaggagctgcagctgcagctggccctggccatgagcagagaggaggccgagaaggaggtgagaagctggcagggcgacggcagccccatggccaacggcgccggcgccgtggtgcaccaccagagagacagagagcccgagagagaggagagaaaggaggaggagaagctgaagaccagccagagcagcatcctggacctggccgacatcttcgtgcccgccctggccccccccagcacccactgcagcgccgacccctgggacatccccggcttcagacccaacaccgaggccagcggcagcagctggggccccagcgccgacccctggagccccatccccagcggcaccgtgctgagcagaagccagccctgggacctgacccccatgctgagcagcagcgagccctggggcagaacccccgtgctgcccgccggcccccccaccaccgacccctgggccctgaacagcccccaccacaagctgcccagcaccggcgccgacccctggggcgccagcctggagaccagcgacacccccggcggcgccagcaccttcgaccccttcgccaagccccccgagagcaccgagaccaaggagggcctggagcaggccctgcccagcggcaagcccagcagccccgtggagctggacctgttcggcgaccccagccccagcagcaagcagaacggcaccaaggagcccgacgccctggacctgggcatcctgggcgaggccctgacccagcccagcaaggaggccagagcctgcagaacccccgagagcttcctgggccccagcgccagcagcctggtgaacctggacagcctggtgaaggccccccaggtggccaagaccagaaaccccttcctgaccggcctgagcgcccccagccccaccaaccccttcggcgccggcgagcccggcagacccaccctgaaccagatgagaaccggcagccccgccctgggcctggccggcggccccgtgggcgcccccctgggcagcatgacctacagcgccagcctgcccctgcccctgagcagcgtgcccgccggcctgaccctgcccgccagcgtgagcgtgttcccccaggccggcgccttcgccccccagcccctgctgcccacccccagcagcgccggccccagacccccccccccccagaccggcaccaaccccttcctgtag

SEQ ID NO: 80562 - DNA, 753 bp, Artificial Sequence
  Description of Artificial Sequence: Synthetic coding sequence
atgggcatgctgtggagaagactgaacgacagcggcaagaactggagacacgtgtacaaggccctgaccctgctggactacctgctgaagaccggcagcgagagagtggcccaccagtgcagagagaacctgtacaccatccagaccctgaaggacttccagtacatcgacagagacggcaaggaccagggcgtgaacgtgagagagaaggtgaagcaggtgatggccctgctgaaggacgaggagagactgagacaggagagaacccacgccctgaagaccaaggagagaatggccctggagggcatcggcatcggcagcggccagctgggcttcagcagaagatacggcgaggactacagcagaagcagaggcagccccagcagctacaacagcagcagcagcagccccagatacaccagcgacctggagcaggccagaccccagaccagcggcgaggaggagctgcagctgcagctggccctggccatgagcagagaggaggccgagaaggaggtgagaagctggcagggcgacggcagccccatggccaacggcgccggcgccgtggtgcaccaccagagagacagagagcccgagagagaggagagaaaggaggaggagaagctgaagaccagccaggtgctgggcagaacccagagacccgtggacccccccggcggcctgctgcagacccccggcctgagaagcccccaggagcccagctgccccgaggccagccccggcatctag

SEQ ID NO: 80563 - DNA, 429 bp, Artificial Sequence
  Description of Artificial Sequence: Synthetic coding sequence
atgagcctgctgcccgtgccctacaccgaggccgccagcctgagcaccggcagcaccgtgaccatcaagggcagacccctggcctgcttcctgaacgagccctacctgcaggtggacttccacaccgagatgaaggaggagagcgacatcgtgttccacttccaggtgtgcttcggcagaagagtggtgatgaacagcagagagtacggcgcctggaagcagcaggtggagagcaagaacatgcccttccaggacggccaggagttcgagctgagcatcagcgtgctgcccgacaagtaccaggtgatggtgaacggccagagcagctacaccttcgaccacagaatcaagcccgaggccgtgaagatggtgcaggtgtggagagacatcagcctgaccaagttcaacgtgagctacctgaagagatag

SEQ ID NO: 80564 - DNA, 828 bp, Artificial Sequence
  Description of Artificial Sequence: Synthetic coding sequence
atgaacatgacccaggccagagtgctggtggccgccgtggtgggcctggtggccgtgctgctgtacgccagcatccacaagatcgaggagggccacctggccgtgtactacagaggcggcgccctgctgaccagccccagcggccccggctaccacatcatgctgcccttcatcaccaccttcagaagcgtgcagaccaccctgcagaccgacgaggtgaagaacgtgccctgcggcaccagcggcggcgtgatgatctacatcgacagaatcgaggtggtgaacatgctggccccctacgccgtgttcgacatcgtgagaaactacaccgccgactacgacaagaccctgatcttcaacaagatccaccacgagctgaaccagttctgcagcgcccacaccctgcaggaggtgtacatcgagctgttcgaccagatcgacgagaacctgaagcaggccctgcagaaggacctgaacctgatggcccccggcctgaccatccaggccgtgagagtgaccaagcccaagatccccgaggccatcagaagaaacttcgagctgatggaggccgagaagaccaagctgctgatcgccgcccagaagcagaaggtggtggagaaggaggccgagaccgagagaaagaaggccgtgatcgaggccgagaagatcgcccaggtggccaagatcagattccagcagaaggtgatggagaaggagaccgagaagagaatcagcgagatcgaggacgccgccttcctggccagagagaaggccaaggccgacgccgagtactacgccgcccacaagtacgccaccagcaacaagtag

SEQ ID NO: 80565 - DNA, 699 bp, Artificial Sequence
  Description of Artificial Sequence: Synthetic coding sequence
atgatctacatcgacagaatcgaggtggtgaacatgctggccccctacgccgtgttcgacatcgtgagaaactacaccgccgactacgacaagaccctgatcttcaacaagatccaccacgagctgaaccagttctgcagcgcccacaccctgcaggaggtgtacatcgagctgttcgaccagatcgacgagaacctgaagcaggccctgcagaaggacctgaacctgatggcccccggcctgaccatccaggccgtgagagtgaccaagcccaagatccccgaggccatcagaagaaacttcgagctgatggaggccgagaagaccaagctgctgatcgccgcccagaagcagaaggtggtggagaaggaggccgagaccgagagaaagaaggccgtgatcgaggccgagaagatcgcccaggtggccaagatcagattccagcagaaggtgatggagaaggagaccgagaagagaatcagcgagatcgaggacgccgccttcctggccagagagaaggccaaggccgacgccgagtactacgccgcccacaagtacgccaccagcaacaagcacaagctgacccccgagtacctggagctgaagaagtaccaggccatcgccagcaacagcaagatctacttcggcagcaacatccccaacatgttcagcatcagcagatgcggccccagaggctag

SEQ ID NO: 80566 - DNA, 1047 bp, Artificial Sequence
  Description of Artificial Sequence: Synthetic coding sequence
atgaacatgacccaggccagagtgctggtggccgccgtggtgggcctggtggccgtgctgctgtacgccagcatccacaagatcgaggagggccacctggccgtgtactacagaggcggcgccctgctgaccagccccagcggccccggctaccacatcatgctgcccttcatcaccaccttcagaagcgtgcagaccaccctgcagaccgacgaggtgaagaacgtgccctgcggcaccagcggcggcgtgatgatctacatcgacagaatcgaggtggtgaacatgctggccccctacgccgtgttcgacatcgtgagaaactacaccgccgactacgacaagaccctgatcttcaacaagatccaccacgagctgaaccagttctgcagcgcccacaccctgcaggaggtgtacatcgagctgttcgaccagatcgacgagaacctgaagcaggccctgcagaaggacctgaacctgatggcccccggcctgaccatccaggccgtgagagtgaccaagcccaagatccccgaggccatcagaagaaacttcgagctgatggaggccgagaagaccaagctgctgatcgccgcccagaagcagaaggtggtggagaaggaggccgagaccgagagaaagaaggccgtgatcgaggccgagaagatcgcccaggtggccaagatcagattccagcagaaggtgatggagaaggagaccgagaagagaatcagcgagatcgaggacgccgccttcctggccagagagaaggccaaggccgacgccgagtactacgccgcccacaagtacgccaccagcaacaagcacaagctgacccccgagtacctggagctgaagaagtaccaggccatcgccagcaacagcaagatctacttcggcagcaacatccccaacatgttcgtggacagcagctgcgccctgaagtacagcgacatcagaaccggcagagagagcagcctgcccagcaaggaggccctggagcccagcggcgagaacgtgatccagaacaaggagagcaccggctag

SEQ ID NO: 80567 - DNA, 1047 bp, Artificial Sequence; identical to SEQ ID NO: 80566
  Description of Artificial Sequence: Synthetic coding sequence

SEQ ID NO: 80568 - DNA, 1020 bp, Artificial Sequence
  Description of Artificial Sequence: Synthetic coding sequence
atggcccagctgggcgccgtggtggccgtggccagcagcttcttctgcgccagcctgttcagcgccgtgcacaagatcgaggagggccacatcggcgtgtactacagaggcggcgccctgctgaccagcaccagcggccccggcttccacctgatgctgcccttcatcaccagctacaagagcgtgcagaccaccctgcagaccgacgaggtgaagaacgtgccctgcggcaccagcggcggcgtgatgatctacttcgacagaatcgaggtggtgaacttcctggtgcccaacgccgtgtacgacatcgtgaagaactacaccgccgactacgacaaggccctgatcttcaacaagatccaccacgagctgaaccagttctgcagcgtgcacaccctgcaggaggtgtacatcgagctgttcgaccagatcgacgagaacctgaagctggccctgcagcaggacctgaccagcatggcccccggcctggtgatccaggccgtgagagtgaccaagcccaacatccccgaggccatcagaagaaactacgagctgatggagagcgagaagaccaagctgctgatcgccgcccagaagcagaaggtggtggagaaggaggccgagaccgagagaaagaaggccctgatcgaggccgagaaggtggcccaggtggccgagatcacctacggccagaaggtgatggagaaggagaccgagaagaagatcagcgagatcgaggacgccgccttcctggccagagagaaggccaaggccgacgccgagtgctacaccgccatgaagatcgccgaggccaacaagctgaagctgacccccgagtacctgcagctgatgaagtacaaggccatcgccagcaacagcaagatctacttcggcaaggacatccccaacatgttcatggacagcgccggcagcgtgagcaagcagttcgagggcctggccgacaagctgagcttcggcctggaggacgagcccctggagaccgccaccaaggagaactag

SEQ ID NO: 80569 - DNA, 459 bp, Artificial Sequence
  Description of Artificial Sequence: Synthetic coding sequence
atggcccagctgggcgccgtggtggccgtggccagcagcttcttctgcgccagcctgttcagcgccgtgcacaagatcgaggagggccacatcggcgtgtactacagaggcggcgccctgctgaccagcaccagcggccccggcttccacctgatgctgcccttcatcaccagctacaagagcgtgcagaccaccctgcagaccgacgaggtgaagaacgtgccctgcggcaccagcggcggcgtgatgatctacttcgacagaatcgaggtggtgaacttcctggtgcccaacgccgtgtacgacatcgtgaagaactacaccgccgactacgacaaggccctgatcttcaacaagatccaccacgagctgaaccagttctgcagcgtgcacaccctgcaggaggtgtacatcgagctgttcggcctggagaacgacttcagccaggagagcagctag

SEQ ID NO: 80570 - DNA, 1020 bp, Artificial Sequence; identical to SEQ ID NO: 80568
  Description of Artificial Sequence: Synthetic coding sequence

SEQ ID NO: 80571 - DNA, 621 bp, Artificial Sequence
  Description of Artificial Sequence: Synthetic coding sequence
atggcccagctgggcgccgtggtggccgtggccagcagcttcttctgcgccagcctgttcagcgccgtgcacaagatcgaggagggccacatcggcgtgtactacagaggcggcgccctgctgaccagcaccagcggccccggcttccacctgatgctgcccttcatcaccagctacaagagcgtgcagaccaccctgcagaccgacgaggtgaagaacgtgccctgcggcaccagcggcggcgtgatgatctacttcgacagaatcgaggtggtgaacttcctggtgcccaacgccgtgtacgacatcgtgaagaactacaccgccgactacgacaaggccctgatcttcaacaagatccaccacgagctgaaccagttctgcagcgtgcacaccctgcaggaggtgtacatcgagctgttcggcaagaaggtgagccccgagcacgccgtgctgaagcagggcagctggaaccccgccagcctgcactgcctgaagcccggctgcctgcagggcgtgatggtgacctacggccaggagatgctgaagaacctggtgctgagaagctggagccagagaagcagctggagaatgctgatcgccatgcagcaggacccctag

SEQ ID NO: 80572 - DNA, 459 bp, Artificial Sequence; identical to SEQ ID NO: 80569
  Description of Artificial Sequence: Synthetic coding sequence

SEQ ID NO: 80573 - DNA, 4239 bp, Artificial Sequence
  Description of Artificial Sequence: Synthetic coding sequence
atgaccaccaagagaagcctgttcgtgagactggtgccctgcagatgcctgagaggcgaggaggagaccgtgaccaccctggactacagccactgcagcctggagcaggtgcccaaggagatcttcaccttcgagaagaccctggaggagctgtacctggacgccaaccagatcgaggagctgcccaagcagctgttcaactgccagagcctgcacaagctgagcctgcccgacaacgacctgaccaccctgcccgccagcatcgccaacctgatcaacctgagagagctggacgtgagcaagaacggcatccaggagttccccgagaacatcaagaactgcaaggtgctgaccatcgtggaggccagcgtgaaccccatcagcaagctgcccgacggcttcagccagctgctgaacctgacccagctgtacctgaacgacgccttcctggagttcctgcccgccaacttcggcagactgaccaagctgcagatcctggagctgagagagaaccagctgaagatgctgcccaagaccatgaacagactgacccagctggagagactggacctgggcagcaacgagttcaccgaggtgcccgaggtgctggagcagctgagcggcctgaaggagttctggatggacgccaacagactgaccttcatccccggcttcatcggcagcctgaagcagctgacctacctggacgtgagcaagaacaacatcgagatggtggaggagggcatcagcacctgcgagaacctgcaggacctgctgctgagcagcaacagcctgcagcagctgcccgagaccatcggcagcctgaagaacatcaccaccctgaagatcgacgagaaccagctgatgtacctgcccgacagcatcggcggcctgatcagcgtggaggagctggactgcagcttcaacgaggtggaggccctgcccagcagcatcggccagctgaccaacctgagaaccttcgccgccgaccacaactacctgcagcagctgccccccgagatcggcagctggaagaacatcaccgtgctgttcctgcacagcaacaagctggagaccctgcccgaggagatgggcgacatgcagaagctgaaggtgatcaacctgagcgacaacagactgaagaacctgcccttcagcttcaccaagctgcagcagctgaccgccatgtggctgagcgacaaccagagcaagcccctgatccccctgcagaaggagaccgacagcgagacccagaagatggtgctgaccaactacatgttcccccagcagcccagaaccgaggacgtgatgttcatcagcgacaacgagagcttcaaccccagcctgtgggaggagcagagaaagcagagagcccaggtggccttcgagtgcgacgaggacaaggacgagagagaggccccccccagagagggcaacctgaagagataccccaccccctaccccgacgagctgaagaacatggtgaagaccgtgcagaccatcgtgcacagactgaaggacgaggagaccaacgaggacagcggcagagacctgaagccccacgaggaccagcaggacatcaacaaggacgtgggcgtgaagaccagcgagagcaccaccaccgtgaagagcaaggtggacgagagagagaagtacatgatcggcaacagcgtgcagaagatcagcgagcccgaggccgagatcagccccggcagcctgcccgtgaccgccaacatgaaggccagcgagaacctgaagcacatcgtgaaccacgacgacgtgttcgaggagagcgaggagctgagcagcgacgaggagatgaagatggccgagatgagaccccccctgatcgagaccagcatcaaccagcccaaggtggtggccctgagcaacaacaagaaggacgacaccaaggagaccgacagcctgagcgacgaggtgacccacaacagcaaccagaacaacagcaactgcagcagccccagcagaatgagcgacagcgtgagcctgaacaccgacagcagccaggacaccagcctgtgcagccccgtgaagcagacccacatcgacatcaacagcaagatcagacaggaggacgagaacttcaacagcctgctgcagaacggcgacatcctgaacagcagcaccgaggagaagttcaaggcccacgacaagaaggacttcaacctgcccgagtacgacctgaacgtggaggagagactggtgctgatcgagaagagcgtggacagcaccgccaccgccgacgacacccacaagctggaccacatcaacatgaacctgaacaagctgatcaccaacgacaccttccagcccgagatcatggagagaagcaagacccaggacatcgtgctgggcaccagcttcctgagcatcaacagcaaggaggagaccgagcacctggagaacggcaacaagtaccccaacctggagagcgtgaacaaggtgaacggccacagcgaggagaccagccagagccccaacagaaccgagccccacgacagcgactgcagcgtggacctgggcatcagcaagagcaccgaggacctgagcccccagaagagcggccccgtgggcagcgtggtgaagagccacagcatcaccaacatggagatcggcggcctgaagatctacgacatcctgagcgacaacggcccccagcagcccagcaccaccgtgaagatcaccagcgccgtggacggcaagaacatcgtgagaagcaagagcgccaccctgctgtacgaccagcccctgcaggtgttcaccggcagcagcagcagcagcgacctgatcagcggcaccaaggccatcttcaagttcgacagcaaccacaaccccgaggagcccaacatcatcagaggccccaccagcggcccccagagcgccccccagatctacggccccccccagtacaacatccagtacagcagcagcgccgccgtgaaggacaccctgtggcacagcaagcagaacccccagatcgaccacgccagcttccccccccagctgctgcccagaagcgagagcaccgagaaccagagctacgccaagcacagcgccaacatgaacttcagcaaccacaacaacgtgagagccaacaccgcctaccacctgcaccagagactgggccccgccagacacggcgagatgtgggccatcagccccaacgacagactgatccccgccgtgaccagaagcaccatccagagacagagcagcgtgagcagcaccgccagcgtgaacctgggcgaccccggcagcaccagaagagcccagatccccgagggcgactacctgagctacagagagttccacagcgccggcagaaccccccccatgatgcccggcagccagagacccctgagcgccagaacctacagcatcgacggccccaacgccagcagaccccagagcgccagacccagcatcaacgagatccccgagagaaccatgagcgtgagcgacttcaactacagcagaaccagccccagcaagagacccaacgccagagtgggcagcgagcacagcctgctggacccccccggcaagagcaaggtgcccagagactggagagagcaggtgctgagacacatcgaggccaagaagctggagaagaagcacccccagaccagcagcagcggcgacccctgccaggacggcatcttcatcagcggccagcagaactacagcagcgccaccctgagccacaaggacgtgccccccgacagcctgatgaagatgcccctgagcaacggccagatgggccagcccctgagaccccaggccaactacagccagatccaccaccccccccaggccagcgtggccagacaccccagcagagagcagctgatcgactacctgatgctgaaggtggcccaccagcccccctacacccagccccactgcagccccagacagggccacgagctggccaagcaggagatcagagtgagagtggagaaggaccccgagctgggcttcagcatcagcggcggcgtgggcggcagaggcaaccccttcagacccgacgacgacggcatcttcgtgaccagagtgcagcccgagggccccgccagcaagctgctgcagcccggcgacaagatcatccaggccaacggctacagcttcatcaacatcgagcacggccaggccgtgagcctgctgaagaccttccagaacaccgtggagctgatcatcgtgagagaggtgagcagctag

SEQ ID NO: 80574 - DNA, 3909 bp, Artificial Sequence
  Description of Artificial Sequence: Synthetic coding sequence
atgaccaccaagagaagcctgttcgtgagactggtgccctgcagatgcctgagaggcgaggaggagaccgtgaccaccctggactacagccactgcagcctggagcaggtgcccaaggagatcttcaccttcgagaagaccctggaggagctgtacctggacgccaaccagatcgaggagctgcccaagcagctgttcaactgccagagcctgcacaagctgagcctgcccgacaacgacctgaccaccctgcccgccagcatcgccaacctgatcaacctgagagagctggacgtgagcaagaacggcatccaggagttccccgagaacatcaagaactgcaaggtgctgaccatcgtggaggccagcgtgaaccccatcagcaagctgcccgacggcttcagccagctgctgaacctgacccagctgtacctgaacgacgccttcctggagttcctgcccgccaacttcggcagactgaccaagctgcagatcctggagctgagagagaaccagctgaagatgctgcccaagaccatgaacagactgacccagctggagagactggacctgggcagcaacgagttcaccgaggtgcccgaggtgctggagcagctgagcggcctgaaggagttctggatggacgccaacagactgaccttcatccccggcttcatcggcagcctgaagcagctgacctacctggacgtgagcaagaacaacatcgagatggtggaggagggcatcagcacctgcgagaacctgcaggacctgctgctgagcagcaacagcctgcagcagctgcccgagaccatcggcagcctgaagaacatcaccaccctgaagatcgacgagaaccagctgatgtacctgcccgacagcatcggcggcctgatcagcgtggaggagctggactgcagcttcaacgaggtggaggccctgcccagcagcatcggccagctgaccaacctgagaaccttcgccgccgaccacaactacctgcagcagctgccccccgagatcggcagctggaagaacatcaccgtgctgttcctgcacagcaacaagctggagaccctgcccgaggagatgggcgacatgcagaagctgaaggtgatcaacctgagcgacaacagactgaagaacctgcccttcagcttcaccaagctgcagcagctgaccgccatgtggctgagcgacaaccagagcaagcccctgatccccctgcagaaggagaccgacagcgagacccagaagatggtgctgaccaactacatgttcccccagcagcccagaaccgaggacgtgatgttcatcagcgacaacgagagcttcaaccccagcctgtgggaggagcagagaaagcagagagcccaggtggccttcgagtgcgacgaggacaaggacgagagagaggccccccccagagagggcaacctgaagagataccccaccccctaccccgacgagctgaagaacatggtgaagaccgtgcagaccatcgtgcacagactgaaggacgaggagaccaacgaggacagcggcagagacctgaagccccacgaggaccagcaggacatcaacaaggacgtgggcgtgaagaccagcgagagcaccaccaccgtgaagagcaaggtggacgagagagagaagtacatgatcggcaacagcgtgcagaagatcagcgagcccgaggccgagatcagccccggcagcctgcccgtgaccgccaacatgaaggccagcgagaacctgaagcacatcgtgaaccacgacgacgtgttcgaggagagcgaggagctgagcagcgacgaggagatgaagatggccgagatgagaccccccctgatcgagaccagcatcaaccagcccaaggtggtggccctgagcaacaacaagaaggacgacaccaaggagaccgacagcctgagcgacgaggtgacccacaacagcaaccagaacaacagcaactgcagcagccccagcagaatgagcgacagcgtgagcctgaacaccgacagcagccaggacaccagcctgtgcagccccgtgaagcagacccacatcgacatcaacagcaagatcagacaggaggacgagaacttcaacagcctgctgcagaacggcgacatcctgaacagcagcaccgaggagaagttcaaggcccacgacaagaaggacttcaacctgcccgagtacgacctgaacgtggaggagagactggtgctgatcgagaagagcgtggacagcaccgccaccgccgacgacacccacaagctggaccacatcaacatgaacctgaacaagctgatcaccaacgacaccttccagcccgagatcatggagagaagcaagacccaggacatcgtgctgggcaccagcttcctgagcatcaacagcaaggaggagaccgagcacctggagaacggcaacaagtaccccaacctggagagcgtgaacaaggtgaacggccacagcgaggagaccagccagagccccaacagaaccgagccccacgacagcgactgcagcgtggacctgggcatcagcaagagcaccgaggacctgagcccccagaagagcggccccgtgggcagcgtggtgaagagccacagcatcaccaacatggagatcggcggcctgaagatctacgacatcctgagcgacaacggcccccagcagcccagcaccaccgtgaagatcaccagcgccgtggacggcaagaacatcgtgagaagcaagagcgccaccctgctgtacgaccagcccctgcaggtgttcaccggcagcagcagcagcagcgacctgatcagcggcaccaaggccatcttcaagttcgacagcaaccacaaccccgaggagcccaacatcatcagaggccccaccagcggcccccagagcgccccccagatctacggccccccccagtacaacatccagtacagcagcagcgccgccgtgaaggacaccctgtggcacagcaagcagaacccccagatcgaccacgccagcttccccccccagctgctgcccagaagcgagagcaccgagaaccagagctacgccaagcacagcgccaacatgaacttcagcaaccacaacaacgtgagagccaacaccgcctaccacctgcaccagagactgggccccgccagacacggcgagatgtgggccatcagccccaacgacagactgatccccgccgtgaccagaagcaccatccagagacagagcagcgtgagcagcaccgccagcgtgaacctgggcgaccccggcagcaccagaagagcccagatccccgagggcgactacctgagctacagagagttccacagcgccggcagaaccccccccatgatgcccggcagccagagacccctgagcgccagaacctacagcatcgacggccccaacgccagcagaccccagagcgccagacccagcatcaacgagatccccgagagaaccatgagcgtgagcgacttcaactacagcagaaccagccccagcaagagacccaacgccagagtgggcagcgagcacagcctgctggacccccccggcaagagcaaggtgcccagagactggagagagcaggtgctgagacacatcgaggccaagaagctggagaagatcagagtgagagtggagaaggaccccgagctgggcttcagcatcagcggcggcgtgggcggcagaggcaaccccttcagacccgacgacgacggcatcttcgtgaccagagtgcagcccgagggccccgccagcaagctgctgcagcccggcgacaagatcatccaggccaacggctacagcttcatcaacatcgagcacggccaggccgtgagcctgctgaagaccttccagaacaccgtggagctgatcatcgtgagagaggtgagcagctag

SEQ ID NO: 80575 - DNA, 4023 bp, Artificial Sequence
  Description of Artificial Sequence: Synthetic coding sequence
atgaccaccaagagaagcctgttcgtgagactggtgccctgcagatgcctgagaggcgaggaggagaccgtgaccaccctggactacagccactgcagcctggagcaggtgcccaaggagatcttcaccttcgagaagaccctggaggagctgtacctggacgccaaccagatcgaggagctgcccaagcagctgttcaactgccagagcctgcacaagctgagcctgcccgacaacgacctgaccaccctgcccgccagcatcgccaacctgatcaacctgagagagctggacgtgagcaagaacggcatccaggagttccccgagaacatcaagaactgcaaggtgctgaccatcgtggaggccagcgtgaaccccatcagcaagctgcccgacggcttcagccagctgctgaacctgacccagctgtacctgaacgacgccttcctggagttcctgcccgccaacttcggcagactgaccaagctgcagatcctggagctgagagagaaccagctgaagatgctgcccaagaccatgaacagactgacccagctggagagactggacctgggcagcaacgagttcaccgaggtgcccgaggtgctggagcagctgagcggcctgaaggagttctggatggacgccaacagactgaccttcatccccggcttcatcggcagcctgaagcagctgacctacctggacgtgagcaagaacaacatcgagatggtggaggagggcatcagcacctgcgagaacctgcaggacctgctgctgagcagcaacagcctgcagcagctgcccgagaccatcggcagcctgaagaacatcaccaccctgaagatcgacgagaaccagctgatgtacctgcccgacagcatcggcggcctgatcagcgtggaggagctggactgcagcttcaacgaggtggaggccctgcccagcagcatcggccagctgaccaacctgagaaccttcgccgccgaccacaactacctgcagcagctgccccccgagatcggcagctggaagaacatcaccgtgctgttcctgcacagcaacaagctggagaccctgcccgaggagatgggcgacatgcagaagctgaaggtgatcaacctgagcgacaacagactgaagaacctgcccttcagcttcaccaagctgcagcagctgaccgccatgtggctgagcgacaaccagagcaagcccctgatccccctgcagaaggagaccgacagcgagacccagaagatggtgctgaccaactacatgttcccccagcagcccagaaccgaggacgtgatgttcatcagcgacaacgagagcttcaaccccagcctgtgggaggagcagagaaagcagagagcccaggtggccttcgagtgcgacgaggacaaggacgagagagaggccccccccagagagggcaacctgaagagataccccaccccctaccccgacgagctgaagaacatggtgaagaccgtgcagaccatcgtgcacagactgaaggacgaggagaccaacgaggacagcggcagagacctgaagccccacgaggaccagcaggacatcaacaaggacgtgggcgtgaagaccagcgagagcaccaccaccgtgaagagcaaggtggacgagagagagaagtacatgatcggcaacagcgtgcagaagatcagcgagcccgaggccgagatcagccccggcagcctgcccgtgaccgccaacatgaaggccagcgagaacctgaagcacatcgtgaaccacgacgacgtgttcgaggagagcgaggagctgagcagcgacgaggagatgaagatggccgagatgagaccccccctgatcgagaccagcatcaaccagcccaaggtggtggccctgagcaacaacaagaaggacgacaccaaggagaccgacagcctgagcgacgaggtgacccacaacagcaaccagaacaacagcaactgcagcagccccagcagaatgagcgacagcgtgagcctgaacaccgacagcagccaggacaccagcctgtgcagccccgtgaagcagacccacatcgacatcaacagcaagatcagacaggaggacgagaacttcaacagcctgctgcagaacggcgacatcctgaacagcagcaccgaggagaagttcaaggcccacgacaagaaggacttcaacctgcccgagtacgacctgaacgtggaggagagactggtgctgatcgagaagagcgtggacagcaccgccaccgccgacgacacccacaagctggaccacatcaacatgaacctgaacaagctgatcaccaacgacaccttccagcccgagatcatggagagaagcaagacccaggacatcgtgctgggcaccagcttcctgagcatcaacagcaaggaggagaccgagcacctggagaacggcaacaagtaccccaacctggagagcgtgaacaaggtgaacggccacagcgaggagaccagccagagccccaacagaaccgagccccacgacagcgactgcagcgtggacctgggcatcagcaagagcaccgaggacctgagcccccagaagagcggccccgtgggcagcgtggtgaagagccacagcatcaccaacatggagatcggcggcctgaagatctacgacatcctgagcgacaacggcccccagcagcccagcaccaccgtgaagatcaccagcgccgtggacggcaagaacatcgtgagaagcaagagcgccaccctgctgtacgaccagcccctgcaggtgttcaccggcagcagcagcagcagcgacctgatcagcggcaccaaggccatcttcaagttcgacagcaaccacaaccccgaggagcccaacatcatcagaggccccaccagcggcccccagagcgccccccagatctacggccccccccagtacaacatccagtacagcagcagcgccgccgtgaaggacaccctgtggcacagcaagcagaacccccagatcgaccacgccagcttccccccccagctgctgcccagaagcgagagcaccgagaaccagagctacgccaagcacagcgccaacatgaacttcagcaaccacaacaacgtgagagccaacaccgcctaccacctgcaccagagactgggccccgccagacacggcgagatgtgggccatcagccccaacgacagactgatccccgccgtgaccagaagcaccatccagagacagagcagcgtgagcagcaccgccagcgtgaacctgggcgaccccggcagcaccagaagagcccagatccccgagggcgactacctgagctacagagagttccacagcgccggcagaaccccccccatgatgcccggcagccagagacccctgagcgccagaacctacagcatcgacggccccaacgccagcagaccccagagcgccagacccagcatcaacgagatccccgagagaaccatgagcgtgagcgacttcaactacagcagaaccagccccagcaagagacccaacgccagagtgggcagcgagcacagcctgctggacccccccggcaagagcaaggtgcccagagactggagagagcaggtgctgagacacatcgaggccaagaagctggagaagatgcccctgagcaacggccagatgggccagcccctgagaccccaggccaactacagccagatccaccaccccccccaggccagcgtggccagacaccccagcagagagcagctgatcgactacctgatgctgaaggtggcccaccagcccccctacacccagccccactgcagccccagacagggccacgagctggccaagcaggagggcatcttcgtgaccagagtgcagcccgagggccccgccagcaagctgctgcagcccggcgacaagatcatccaggccaacggctacagcttcatcaacatcgagcacggccaggccgtgagcctgctgaagaccttccagaacaccgtggagctgatcatcgtgagagaggtgagcagctag

SEQ ID NO: 80576 - DNA, 4041 bp, Artificial Sequence
  Description of Artificial Sequence: Synthetic coding sequence
atgaccaccaagagaagcctgttcgtgagactggtgccctgcagatgcctgagaggcgaggaggagaccgtgaccaccctggactacagccactgcagcctggagcaggtgcccaaggagatcttcaccttcgagaagaccctggaggagctgtacctggacgccaaccagatcgaggagctgcccaagcagctgttcaactgccagagcctgcacaagctgagcctgcccgacaacgacctgaccaccctgcccgccagcatcgccaacctgatcaacctgagagagctggacgtgagcaagaacggcatccaggagttccccgagaacatcaagaactgcaaggtgctgaccatcgtggaggccagcgtgaaccccatcagcaagctgcccgacggcttcagccagctgctgaacctgacccagctgtacctgaacgacgccttcctggagttcctgcccgccaacttcggcagactgaccaagctgcagatcctggagctgagagagaaccagctgaagatgctgcccaagaccatgaacagactgacccagctggagagactggacctgggcagcaacgagttcaccgaggtgcccgaggtgctggagcagctgagcggcctgaaggagttctggatggacgccaacagactgaccttcatccccggcttcatcggcagcctgaagcagctgacctacctggacgtgagcaagaacaacatcgagatggtggaggagggcatcagcacctgcgagaacctgcaggacctgctgctgagcagcaacagcctgcagcagctgcccgagaccatcggcagcctgaagaacatcaccaccctgaagatcgacgagaaccagctgatgtacctgcccgacagcatcggcggcctgatcagcgtggaggagctggactgcagcttcaacgaggtggaggccctgcccagcagcatcggccagctgaccaacctgagaaccttcgccgccgaccacaactacctgcagcagctgccccccgagatcggcagctggaagaacatcaccgtgctgttcctgcacagcaacaagctggagaccctgcccgaggagatgggcgacatgcagaagctgaaggtgatcaacctgagcgacaacagactgaagaacctgcccttcagcttcaccaagctgcagcagctgaccgccatgtggctgagcgacaaccagagcaagcccctgatccccctgcagaaggagaccgacagcgagacccagaagatggtgctgaccaactacatgttcccccagcagcccagaaccgaggacgtgatgttcatcagcgacaacgagagcttcaaccccagcctgtgggaggagcagagaaagcagagagcccaggtggccttcgagtgcgacgaggacaaggacgagagagaggccccccccagagagggcaacctgaagagataccccaccccctaccccgacgagctgaagaacatggtgaagaccgtgcagaccatcgtgcacagactgaaggacgaggagaccaacgaggacagcggcagagacctgaagccccacgaggaccagcaggacatcaacaaggacgtgggcgtgaagaccagcgagagcaccaccaccgtgaagagcaaggtggacgagagagagaagtacatgatcggcaacagcgtgcagaagatcagcgagcccgaggccgagatcagccccggcagcctgcccgtgaccgccaacatgaaggccagcgagaacctgaagcacatcgtgaaccacgacgacgtgttcgaggagagcgaggagctgagcagcgacgaggagatgaagatggccgagatgagaccccccctgatcgagaccagcatcaaccagcccaaggtggtggccctgagcaacaacaagaaggacgacaccaaggagaccgacagcctgagcgacgaggtgacccacaacagcaaccagaacaacagcaactgcagcagccccagcagaatgagcgacagcgtgagcctgaacaccgacagcagccaggacaccagcctgtgcagccccgtgaagcagacccacatcgacatcaacagcaagatcagacaggaggacgagaacttcaacagcctgctgcagaacggcgacatcctgaacagcagcaccgaggagaagttcaaggcccacgacaagaaggacttcaacctgcccgagtacgacctgaacgtggaggagagactggtgctgatcgagaagagcgtggacagcaccgccaccgccgacgacacccacaagctggaccacatcaacatgaacctgaacaagctgatcaccaacgacaccttccagcccgagatcatggagagaagcaagacccaggacatcgtgctgggcaccagcttcctgagcatcaacagcaaggaggagaccgagcacctggagaacggcaacaagtaccccaacctggagagcgtgaacaaggtgaacggccacagcgaggagaccagccagagccccaacagaaccgagccccacgacagcgactgcagcgtggacctgggcatcagcaagagcaccgaggacctgagcccccagaagagcggccccgtgggcagcgtggtgaagagccacagcatcaccaacatggagatcggcggcctgaagatctacgacatcctgagcgacaacggcccccagcagcccagcaccaccgtgaagatcaccagcgccgtggacggcaagaacatcgtgagaagcaagagcgccaccctgctgtacgaccagcccctgcaggtgttcaccggcagcagcagcagcagcgacctgatcagcggcaccaaggccatcttcaagttcgacagcaaccacaaccccgaggagcccaacatcatcagaggccccaccagcggcccccagagcgccccccagatctacggccccccccagtacaacatccagtacagcagcagcgccgccgtgaaggacaccctgtggcacagcaagcagaacccccagatcgaccacgccagcttccccccccagctgctgcccagaagcgagagcaccgagaaccagagctacgccaagcacagcgccaacatgaacttcagcaaccacaacaacgtgagagccaacaccgcctaccacctgcaccagagactgggccccgccagacacggcgagatgtgggccatcagccccaacgacagactgatccccgccgtgaccagaagcaccatccagagacagagcagcgtgagcagcaccgccagcgtgaacctgggcgaccccggcagcaccagaagagcccagatccccgagggcgactacctgagctacagagagttccacagcgccggcagaaccccccccatgatgcccggcagccagagacccctgagcgccagaacctacagcatcgacggccccaacgccagcagaccccagagcgccagacccagcatcaacgagatccccgagagaaccatgagcgtgagcgacttcaactacagcagaaccagccccagcaagagacccaacgccagagtgggcagcgagcacagcctgctggacccccccggcaagagcaaggtgcccagagactggagagagcaggtgctgagacacatcgaggccaagaagctggagaagatgcccctgagcaacggccagatgggccagcccctgagaccccaggccaactacagccagatccaccaccccccccaggccagcgtggccagacaccccagcagagagcagctgatcgactacctgatgctgaaggtggcccaccagcccccctacacccagccccactgcagccccagacagggccacgagctggccaagcaggagatcagagtgagagtggagaaggaccccgagctgggcttcagcatcagcggcggcgtgggcggcagaggcaaccccttcagacccgacgacgacgccaacggctacagcttcatcaacatcgagcacggccaggccgtgagcctgctgaagaccttccagaacaccgtggagctgatcatcgtgagagaggtgagcagctag

SEQ ID NO: 80577 - DNA, 4083 bp, Artificial Sequence
  Description of Artificial Sequence: Synthetic coding sequence
atgaccaccaagagaagcctgttcgtgagactggtgccctgcagatgcctgagaggcgaggaggagaccgtgaccaccctggactacagccactgcagcctggagcaggtgcccaaggagatcttcaccttcgagaagaccctggaggagctgtacctggacgccaaccagatcgaggagctgcccaagcagctgttcaactgccagagcctgcacaagctgagcctgcccgacaacgacctgaccaccctgcccgccagcatcgccaacctgatcaacctgagagagctggacgtgagcaagaacggcatccaggagttccccgagaacatcaagaactgcaaggtgctgaccatcgtggaggccagcgtgaaccccatcagcaagctgcccgacggcttcagccagctgctgaacctgacccagctgtacctgaacgacgccttcctggagttcctgcccgccaacttcggcagactgaccaagctgcagatcctggagctgagagagaaccagctgaagatgctgcccaagaccatgaacagactgacccagctggagagactggacctgggcagcaacgagttcaccgaggtgcccgaggtgctggagcagctgagcggcctgaaggagttctggatggacgccaacagactgaccttcatccccggcttcatcggcagcctgaagcagctgacctacctggacgtgagcaagaacaacatcgagatggtggaggagggcatcagcacctgcgagaacctgcaggacctgctgctgagcagcaacagcctgcagcagctgcccgagaccatcggcagcctgaagaacatcaccaccctgaagatcgacgagaaccagctgatgtacctgcccgacagcatcggcggcctgatcagcgtggaggagctggactgcagcttcaacgaggtggaggccctgcccagcagcatcggccagctgaccaacctgagaaccttcgccgccgaccacaactacctgcagcagctgccccccgagatcggcagctggaagaacatcaccgtgctgttcctgcacagcaacaagctggagaccctgcccgaggagatgggcgacatgcagaagctgaaggtgatcaacctgagcgacaacagactgaagaacctgcccttcagcttcaccaagctgcagcagctgaccgccatgtggctgagcgacaaccagagcaagcccctgatccccctgcagaaggagaccgacagcgagacccagaagatggtgctgaccaactacatgttcccccagcagcccagaaccgaggacgtgatgttcatcagcgacaacgagagcttcaaccccagcctgtgggaggagcagagaaagcagagagcccaggtggccttcgagtgcgacgaggacaaggacgagagagaggccccccccagagagggcaacctgaagagataccccaccccctaccccgacgagctgaagaacatggtgaagaccgtgcagaccatcgtgcacagactgaaggacgaggagaccaacgaggacagcggcagagacctgaagccccacgaggaccagcaggacatcaacaaggacgtgggcgtgaagaccagcgagagcaccaccaccgtgaagagcaaggtggacgagagagagaagtacatgatcggcaacagcgtgcagaagatcagcgagcccgaggccgagatcagccccggcagcctgcccgtgaccgccaacatgaaggccagcgagaacctgaagcacatcgtgaaccacgacgacgtgttcgaggagagcgaggagctgagcagcgacgaggagatgaagatggccgagatgagaccccccctgatcgagaccagcatcaaccagcccaaggtggtggccctgagcaacaacaagaaggacgacaccaaggagaccgacagcctgagcgacgaggtgacccacaacagcaaccagaacaacagcaactgcagcagccccagcagaatgagcgacagcgtgagcctgaacaccgacagcagccaggacaccagcctgtgcagccccgtgaagcagacccacatcgacatcaacagcaagatcagacaggaggacgagaacttcaacagcctgctgcagaacggcgacatcctgaacagcagcaccgaggagaagttcaaggcccacgacaagaaggacttcaacctgcccgagtacgacctgaacgtggaggagagactggtgctgatcgagaagagcgtggacagcaccgccaccgccgacgacacccacaagctggaccacatcaacatgaacctgaacaagctgatcaccaacgacaccttccagcccgagatcatggagagaagcaagacccaggacatcgtgctgggcaccagcttcctgagcatcaacagcaaggaggagaccgagcacctggagaacggcaacaagtaccccaacctggagagcgtgaacaaggtgaacggccacagcgaggagaccagccagagccccaacagaaccgagccccacgacagcgactgcagcgtggacctgggcatcagcaagagcaccgaggacctgagcccccagaagagcggccccgtgggcagcgtggtgaagagccacagcatcaccaacatggagatcggcggcctgaagatctacgacatcctgagcgacaacggcccccagcagcccagcaccaccgtgaagatcaccagcgccgtggacggcaagaacatcgtgagaagcaagagcgccaccctgctgtacgaccagcccctgcaggtgttcaccggcagcagcagcagcagcgacctgatcagcggcaccaaggccatcttcaagttcgacagcaaccacaaccccgaggagcccaacatcatcagaggccccaccagcggcccccagagcgccccccagatctacggccccccccagtacaacatccagtacagcagcagcgccgccgtgaaggacaccctgtggcacagcaagcagaacccccagatcgaccacgccagcttccccccccagctgctgcccagaagcgagagcaccgagaaccagagctacgccaagcacagcgccaacatgaacttcagcaaccacaacaacgtgagagccaacaccgcctaccacctgcaccagagactgggccccgccagacacggcgagatgtgggccatcagccccaacgacagactgatccccgccgtgaccagaagcaccatccagagacagagcagcgtgagcagcaccgccagcgtgaacctgggcgaccccggcagcaccagaagagcccagatccccgagggcgactacctgagctacagagagttccacagcgccggcagaaccccccccatgatgcccggcagccagagacccctgagcgccagaacctacagcatcgacggccccaacgccagcagaccccagagcgccagacccagcatcaacgagatccccgagagaaccatgagcgtgagcgacttcaactacagcagaaccagccccagcaagagacccaacgccagagtgggcagcgagcacagcctgctggacccccccggcaagagcaaggtgcccagagactggagagagcaggtgctgagacacatcgaggccaagaagctggagaagatgcccctgagcaacggccagatgggccagcccctgagaccccaggccagcgtggccagacaccccagcagagagcagctgatcgactacctgatgctgaaggtggcccaccagcccccctacacccagccccactgcagccccagacagggccacgagctggccaagcaggagatcagagtgagagtggagaaggaccccgagctgggcttcagcatcagcggcggcgtgggcggcagaggcaaccccttcagacccgacgacgacggcatcttcgtgaccagagtgcagcccgagggccccgccagcaagctgctgcagcccggcgacaagatcatccaggccaacggctacagcttcatcaacatcgagcacggccaggccgtgagcctgctgaagaccttccagaacaccgtggagctgatcatcgtgagagaggtgagcagctag

SEQ ID NO: 80578 - DNA, 4116 bp, Artificial Sequence
  Description of Artificial Sequence: Synthetic coding sequence
atgaccaccaagagaagcctgttcgtgagactggtgccctgcagatgcctgagaggcgaggaggagaccgtgaccaccctggactacagccactgcagcctggagcaggtgcccaaggagatcttcaccttcgagaagaccctggaggagctgtacctggacgccaaccagatcgaggagctgcccaagcagctgttcaactgccagagcctgcacaagctgagcctgcccgacaacgacctgaccaccctgcccgccagcatcgccaacctgatcaacctgagagagctggacgtgagcaagaacggcatccaggagttccccgagaacatcaagaactgcaaggtgctgaccatcgtggaggccagcgtgaaccccatcagcaagctgcccgacggcttcagccagctgctgaacctgacccagctgtacctgaacgacgccttcctggagttcctgcccgccaacttcggcagactgaccaagctgcagatcctggagctgagagagaaccagctgaagatgctgcccaagaccatgaacagactgacccagctggagagactggacctgggcagcaacgagttcaccgaggtgcccgaggtgctggagcagctgagcggcctgaaggagttctggatggacgccaacagactgaccttcatccccggcttcatcggcagcctgaagcagctgacctacctggacgtgagcaagaacaacatcgagatggtggaggagggcatcagcacctgcgagaacctgcaggacctgctgctgagcagcaacagcctgcagcagctgcccgagaccatcggcagcctgaagaacatcaccaccctgaagatcgacgagaaccagctgatgtacctgcccgacagcatcggcggcctgatcagcgtggaggagctggactgcagcttcaacgaggtggaggccctgcccagcagcatcggccagctgaccaacctgagaaccttcgccgccgaccacaactacctgcagcagctgccccccgagatcggcagctggaagaacatcaccgtgctgttcctgcacagcaacaagctggagaccctgcccgaggagatgggcgacatgcagaagctgaaggtgatcaacctgagcgacaacagactgaagaacctgcccttcagcttcaccaagctgcagcagctgaccgccatgtggctgagcgacaaccagagcaagcccctgatccccctgcagaaggagaccgacagcgagacccagaagatggtgctgaccaactacatgttcccccagcagcccagaaccgaggacgtgatgttcatcagcgacaacgagagcttcaaccccagcctgtgggaggagcagagaaagcagagagcccaggtggccttcgagtgcgacgaggacaaggacgagagagaggccccccccagagagggcaacctgaagagataccccaccccctaccccgacgagctgaagaacatggtgaagaccgtgcagaccatcgtgcacagactgaaggacgaggagaccaacgaggacagcggcagagacctgaagccccacgaggaccagcaggacatcaacaaggacgtgggcgtgaagaccagcgagagcaccaccaccgtgaagagcaaggtggacgagagagagaagtacatgatcggcaacagcgtgcagaagatcagcgagcccgaggccgagatcagccccggcagcctgcccgtgaccgccaacatgaaggccagcgagaacctgaagcacatcgtgaaccacgacgacgtgttcgaggagagcgaggagctgagcagcgacgaggagatgaagatggccgagatgagaccccccctgatcgagaccagcatcaaccagcccaaggtggtggccctgagcaacaacaagaaggacgacaccaaggagaccgacagcctgagcgacgaggtgacccacaacagcaaccagaacaacagcaactgcagcagccccagcagaatgagcgacagcgtgagcctgaacaccgacagcagccaggacaccagcctgtgcagccccgtgaagcagacccacatcgacatcaacagcaagatcagacaggaggacgagaacttcaacagcctgctgcagaacggcgacatcctgaacagcagcaccgaggagaagttcaaggcccacgacaagaaggacttcaacctgcccgagtacgacctgaacgtggaggagagactggtgctgatcgagaagagcgtggacagcaccgccaccgccgacgacacccacaagctggaccacatcaacatgaacctgaacaagctgatcaccaacgacaccttccagcccgagatcatggagagaagcaagacccaggacatcgtgctgggcaccagcttcctgagcatcaacagcaaggaggagaccgagcacctggagaacggcaacaagtaccccaacctggagagcgtgaacaaggtgaacggccacagcgaggagaccagccagagccccaacagaaccgagccccacgacagcgactgcagcgtggacctgggcatcagcaagagcaccgaggacctgagcccccagaagagcggccccgtgggcagcgtggtgaagagccacagcatcaccaacatggagatcggcggcctgaagatctacgacatcctgagcgacaacggcccccagcagcccagcaccaccgtgaagatcaccagcgccgtggacggcaagaacatcgtgagaagcaagagcgccaccctgctgtacgaccagcccctgcaggtgttcaccggcagcagcagcagcagcgacctgatcagcggcaccaaggccatcttcaagttcgacagcaaccacaaccccgaggagcccaacatcatcagaggccccaccagcggcccccagagcgccccccagatctacggccccccccagtacaacatccagtacagcagcagcgccgccgtgaaggacaccctgtggcacagcaagcagaacccccagatcgaccacgccagcttccccccccagctgctgcccagaagcgagagcaccgagaaccagagctacgccaagcacagcgccaacatgaacttcagcaaccacaacaacgtgagagccaacaccgcctaccacctgcaccagagactgggccccgccagacacggcgagatgtgggccatcagccccaacgacagactgatccccgccgtgaccagaagcaccatccagagacagagcagcgtgagcagcaccgccagcgtgaacctgggcgaccccggcagcaccagaagagcccagatccccgagggcgactacctgagctacagagagttccacagcgccggcagaaccccccccatgatgcccggcagccagagacccctgagcgccagaacctacagcatcgacggccccaacgccagcagaccccagagcgccagacccagcatcaacgagatccccgagagaaccatgagcgtgagcgacttcaactacagcagaaccagccccagcaagagacccaacgccagagtgggcagcgagcacagcctgctggacccccccggcaagagcaaggtgcccagagactggagagagcaggtgctgagacacatcgaggccaagaagctggagaagatgcccctgagcaacggccagatgggccagcccctgagaccccaggccaactacagccagatccaccaccccccccaggccagcgtggccagacaccccagcagagagcagctgatcgactacctgatgctgaaggtggcccaccagcccccctacacccagccccactgcagccccagacagggccacgagctggccaagcaggagatcagagtgagagtggagaaggaccccgagctgggcttcagcatcagcggcggcgtgggcggcagaggcaaccccttcagacccgacgacgacggcatcttcgtgaccagagtgcagcccgagggccccgccagcaagctgctgcagcccggcgacaagatcatccaggccaacggctacagcttcatcaacatcgagcacggccaggccgtgagcctgctgaagaccttccagaacaccgtggagctgatcatcgtgagagaggtgagcagctag

SEQ ID NO: 80579 - DNA, 3909 bp, Artificial Sequence; identical to SEQ ID NO: 80574
  Description of Artificial Sequence: Synthetic coding sequence

SEQ ID NO: 80580 - DNA, 4260 bp, Artificial Sequence
  Description of Artificial Sequence: Synthetic coding sequence
atgaccaccaagagaagcctgttcgtgagactggtgccctgcagatgcctgagaggcgaggaggagaccgtgaccaccctggactacagccactgcagcctggagcaggtgcccaaggagatcttcaccttcgagaagaccctggaggagctgtacctggacgccaaccagatcgaggagctgcccaagcagctgttcaactgccagagcctgcacaagctgagcctgcccgacaacgacctgaccaccctgcccgccagcatcgccaacctgatcaacctgagagagctggacgtgagcaagaacggcatccaggagttccccgagaacatcaagaactgcaaggtgctgaccatcgtggaggccagcgtgaaccccatcagcaagctgcccgacggcttcagccagctgctgaacctgacccagctgtacctgaacgacgccttcctggagttcctgcccgccaacttcggcagactgaccaagctgcagatcctggagctgagagagaaccagctgaagatgctgcccaagaccatgaacagactgacccagctggagagactggacctgggcagcaacgagttcaccgaggtgcccgaggtgctggagcagctgagcggcctgaaggagttctggatggacgccaacagactgaccttcatccccggcttcatcggcagcctgaagcagctgacctacctggacgtgagcaagaacaacatcgagatggtggaggagggcatcagcacctgcgagaacctgcaggacctgctgctgagcagcaacagcctgcagcagctgcccgagaccatcggcagcctgaagaacatcaccaccctgaagatcgacgagaaccagctgatgtacctgcccgacagcatcggcggcctgatcagcgtggaggagctggactgcagcttcaacgaggtggaggccctgcccagcagcatcggccagctgaccaacctgagaaccttcgccgccgaccacaactacctgcagcagctgccccccgagatcggcagctggaagaacatcaccgtgctgttcctgcacagcaacaagctggagaccctgcccgaggagatgggcgacatgcagaagctgaaggtgatcaacctgagcgacaacagactgaagaacctgcccttcagcttcaccaagctgcagcagctgaccgccatgtggctgagcgacaaccagagcaagcccctgatccccctgcagaaggagaccgacagcgagacccagaagatggtgctgaccaactacatgttcccccagcagcccagaaccgaggacgtgatgttcatcagcgacaacgagagcttcaaccccagcctgtgggaggagcagagaaagcagagagcccaggtggccttcgagtgcgacgaggacaaggacgagagagaggccccccccagagagggcaacctgaagagataccccaccccctaccccgacgagctgaagaacatggtgaagaccgtgcagaccatcgtgcacagactgaaggacgaggagaccaacgaggacagcggcagagacctgaagccccacgaggaccagcaggacatcaacaaggacgtgggcgtgaagaccagcgagagcaccaccaccgtgaagagcaaggtggacgagagagagaagtacatgatcggcaacagcgtgcagaagatcagcgagcccgaggccgagatcagccccggcagcctgcccgtgaccgccaacatgaaggccagcgagaacctgaagcacatcgtgaaccacgacgacgtgttcgaggagagcgaggagctgagcagcgacgaggagatgaagatggccgagatgagaccccccctgatcgagaccagcatcaaccagcccaaggtggtggccctgagcaacaacaagaaggacgacaccaaggagaccgacagcctgagcgacgaggtgacccacaacagcaaccagaacaacagcaactgcagcagccccagcagaatgagcgacagcgtgagcctgaacaccgacagcagccaggacaccagcctgtgcagccccgtgaagcagacccacatcgacatcaacagcaagatcagacaggaggacgagaacttcaacagcctgctgcagaacggcgacatcctgaacagcagcaccgaggagaagttcaaggcccacgacaagaaggacttcaacctgcccgagtacgacctgaacgtggaggagagactggtgctgatcgagaagagcgtggacagcaccgccaccgccgacgacacccacaagctggaccacatcaacatgaacctgaacaagctgatcaccaacgacaccttccagcccgagatcatggagagaagcaagacccaggacatcgtgctgggcaccagcttcctgagcatcaacagcaaggaggagaccgagcacctggagaacggcaacaagtaccccaacctggagagcgtgaacaaggtgaacggccacagcgaggagaccagccagagccccaacagaaccgagccccacgacagcgactgcagcgtggacctgggcatcagcaagagcaccgaggacctgagcccccagaagagcggccccgtgggcagcgtggtgaagagccacagcatcaccaacatggagatcggcggcctgaagatctacgacatcctgagcgacaacggcccccagcagcccagcaccaccgtgaagatcaccagcgccgtggacggcaagaacatcgtgagaagcaagagcgccaccctgctgtacgaccagcccctgcaggtgttcaccggcagcagcagcagcagcgacctgatcagcggcaccaaggccatcttcaagttcgacagcaaccacaaccccgaggagcccaacatcatcagaggccccaccagcggcccccagagcgccccccagatctacggccccccccagtacaacatccagtacagcagcagcgccgccgtgaaggacaccctgtggcacagcaagcagaacccccagatcgaccacgccagcttccccccccagctgctgcccagaagcgagagcaccgagaaccagagctacgccaagcacagcgccaacatgaacttcagcaaccacaacaacgtgagagccaacaccgcctaccacctgcaccagagactgggccccgccagacacggcgagatgtgggccatcagccccaacgacagactgatccccgccgtgaccagaagcaccatccagagacagagcagcgtgagcagcaccgccagcgtgaacctgggcgaccccggcagcaccagaagagcccagatccccgagggcgactacctgagctacagagagttccacagcgccggcagaaccccccccatgatgcccggcagccagagacccctgagcgccagaacctacagcatcgacggccccaacgccagcagaccccagagcgccagacccagcatcaacgagatccccgagagaaccatgagcgtgagcgacttcaactacagcagaaccagccccagcaagagacccaacgccagagtgggcagcgagcacagcctgctggacccccccggcaagagcaaggtgcccagagactggagagagcaggtgctgagacacatcgaggccaagaagctggagaagagcatgctgagcagaagcttcaacagcaacttcaccaccgtgagcagcttccactgcggcagcagcagagacctgcacggcagccagggcagcctggccctgagcgtggccgacagaagaggcagcggcggccacatcttcagaatgcccctgagcaacggccagatgggccagcccctgagaccccaggccaactacagccagatccaccaccccccccaggccagcgtggccagacaccccagcagagagcagctgatcgactacctgatgctgaaggtggcccaccagcccccctacacccagccccactgcagccccagacagggccacgagctggccaagcaggagatcagagtgagagtggagaaggaccccgagctgggcttcagcatcagcggcggcgtgggcggcagaggcaaccccttcagacccgacgacgacggcatcttcgtgaccagagtgcagcccgagggccccgccagcaagctgctgcagcccggcgacaagatcatccaggccaacggctacagcttcatcaacatcgagcacggccaggccgtgagcctgctgaagaccttccagaacaccgtggagctgatcatcgtgagagaggtgagcagctag

SEQ ID NO: 80581 - DNA, 1158 bp, Artificial Sequence
  Description of Artificial Sequence: Synthetic coding sequence
atgaaggaggaggagggcttccccgaggacgaggccaccgagagcgagaccctgagcctggtgaaggagctggacgccttccccaaggtgcccgagagctacgtggagaccagcgccagcggcggcaccgtgagcctgatcgccttcaccaccatggccctgctgaccatcatggagttcagcgtgtaccaggacacctggatgaagtacgagtacgaggtggacaaggacttcagcagcaagctgagaatcaacatcgacatcaccgtggccatgaagtgccagtacgtgggcgccgacgtgctggacctggccgagaccatggtggccagcgccgacggcctggtgtacgagcccaccgtgttcgacctgagcccccagcagaaggagtggcagagaatgctgcagctgatccagagcagactgcaggaggagcacagcctgcaggacgtgatcttcaagagcgccttcaagagcaccagcaccgccctgccccccagagaggacgacagcagccagagccccaacgcctgcagaatccacggccacctgtacgtgaacaaggtggccggcaacttccacatcaccgtgggcaaggccatcccccaccccagaggccacgcccacctggccgccctggtgaaccacgagagctacaacttcagccacagaatcgaccacctgagcttcggcgagctggtgcccgccatcatcaaccccctggacggcaccgagaagatcgccatcgaccacaaccagatgttccagtacttcatcaccgtggtgcccaccaagctgcacacctacaagatcagcgccgacacccaccagttcagcgtgaccgagagagagagaatcatcaaccacgccgccggcagccacggcgtgagcggcatcttcatgaagtacgacctgagcagcctgatggtgaccgtgaccgaggagcacatgcccttctggcagttcttcgtgagactgtgcggcatcgtgggcggcatcttcagcaccaccggcatgctgcacggcatcggcaagttcatcgtggagatcatctgctgcagattcagactgggcagctacaagcccgtgaacagcgtgcccttcgaggacggccacaccgacaaccacctgcccctgctggagaacaacacccactag

SEQ ID NO: 80582 - DNA, 1134 bp, Artificial Sequence
  Description of Artificial Sequence: Synthetic coding sequence
atgagaagactgaacagaaagaagaccctgagcctggtgaaggagctggacgccttccccaaggtgcccgagagctacgtggagaccagcgccagcggcggcaccgtgagcctgatcgccttcaccaccatggccctgctgaccatcatggagttcagcgtgtaccaggacacctggatgaagtacgagtacgaggtggacaaggacttcagcagcaagctgagaatcaacatcgacatcaccgtggccatgaagtgccagtacgtgggcgccgacgtgctggacctggccgagaccatggtggccagcgccgacggcctggtgtacgagcccaccgtgttcgacctgagcccccagcagaaggagtggcagagaatgctgcagctgatccagagcagactgcaggaggagcacagcctgcaggacgtgatcttcaagagcgccttcaagagcaccagcaccgccctgccccccagagaggacgacagcagccagagccccaacgcctgcagaatccacggccacctgtacgtgaacaaggtggccggcaacttccacatcaccgtgggcaaggccatcccccaccccagaggccacgcccacctggccgccctggtgaaccacgagagctacaacttcagccacagaatcgaccacctgagcttcggcgagctggtgcccgccatcatcaaccccctggacggcaccgagaagatcgccatcgaccacaaccagatgttccagtacttcatcaccgtggtgcccaccaagctgcacacctacaagatcagcgccgacacccaccagttcagcgtgaccgagagagagagaatcatcaaccacgccgccggcagccacggcgtgagcggcatcttcatgaagtacgacctgagcagcctgatggtgaccgtgaccgaggagcacatgcccttctggcagttcttcgtgagactgtgcggcatcgtgggcggcatcttcagcaccaccggcatgctgcacggcatcggcaagttcatcgtggagatcatctgctgcagattcagactgggcagctacaagcccgtgaacagcgtgcccttcgaggacggccacaccgacaaccacctgcccctgctggagaacaacacccactag

SEQ ID NO: 80583 - DNA, 663 bp, Artificial Sequence
  Description of Artificial Sequence: Synthetic coding sequence
atgagaagactgaacagaaagaagaccctgagcctggtgaaggagctggacgccttccccaaggtgcccgagagctacgtggagaccagcgccagcggcggcaccgtgagcctgatcgccttcaccaccatggccctgctgaccatcatggagttcagcgtgtaccaggacacctggatgaagtacgagtacgaggtggacaaggacttcagcagcaagctgagaatcaacatcgacatcaccgtggccatgaagtgccagtacgtgggcgccgacgtgctggacctggccgagaccatggtggccagcgccgacggcctggtgtacgagcccaccgtgttcgacctgagcccccagcagaaggagtggcagagaatgctgcagctgatccagagcagactgcaggaggagcacagcctgcaggacgtgatcttcaagagcgccttcaagagcaccagcaccgccctgccccccagagaggacgacagcagccagagccccaacgcctgcagaatccacggccacctgtacgtgaacaaggtggccggcaacttccacatcaccgtgggcaaggccatcccccaccccagaggccacgcccacctggccgccctggtgaaccacgagagctacaacttcagccacagaatcgaccacctgtag

SEQ ID NO: 80584 - DNA, 216 bp, Artificial Sequence
  Description of Artificial Sequence: Synthetic coding sequence
atgagaagactgaacagaaagaagaccctgagcctggtgaaggagctggacgccttccccaaggtgcccgagagctacgtggagaccagcgccagcggcggcaccgtgagcctgatcgccttcaccaccatggccctgctgaccatcatggagttcagcgtgtaccaggacacctggatgaagtacgagtacgaggtggacaaggacttcagctag

SEQ ID NO: 80585 - DNA, 528 bp, Artificial Sequence
  Description of Artificial Sequence: Synthetic coding sequence
atgagaagactgaacagaaagaagaccctgagcctggtgaaggagctggacgccttccccaaggtgcccgagagctacgtggagaccagcgccagcggcggcaccgtgagcctgatcgccttcaccaccatggccctgctgaccatcatggagttcagcgtgtaccaggacacctggatgaagtacgagtacgaggtggacaaggacttcagcagcaagctgagaatcaacatcgacatcaccgtggccatgaagtgccagtacgtgggcgccgacgtgctggacctggccgagaccatggtggccagcgccgacggcctggtgtacgagcccaccgtgttcgacctgagcccccagcagaaggagtggcagagaatgctgcagctgatccagagcagactgcaggaggagcacagcctgcaggacgtgatcttcaagagcgccttcaagagcaccagcaccgccctgccccccagagaggacgacagcagccagagccccaacgcctgcagaatccacggccactag

SEQ ID NO: 80586 - DNA, 1158 bp, Artificial Sequence
  Description of Artificial Sequence: Synthetic coding sequence
atgcccgagtacaagggcagaaccgtgctggtgagagacgcccaggagggcagcgtgaccctgcagatcctggacgtgagactggaggaccagggcagctacagatgcctgatccaggtgggcaacctgagcaaggaggacaccgtgatcctgcaggtggccgcccccagcgtgggcagcctgagccccagcgccgtggccctggccgtgatcctgcccgtgctggtgctgctgatcatggtgtgcctgtgcctgatctggaagcagagaagagccaaggagaagctgctgtacgagcacgtgaccgaggtggacaacctgctgagcgaccacgccaaggagaagggcaagctgcacaaggccgtgaagaagctgagaagcgagctgaagctgaagagagccgccgccaacagcggctggagaagagccagactgcacttcgtggccgtgaccctggaccccgacaccgcccaccccaagctgatcctgagcgaggaccagagatgcgtgagactgggcgacagaagacagcccgtgcccgacaacccccagagattcgacttcgtggtgagcatcctgggcagcgagtacttcaccaccggctgccactactgggaggtgtacgtgggcgacaagaccaagtggatcctgggcgtgtgcagcgagagcgtgagcagaaagggcaaggtgaccgccagccccgccaacggccactggctgctgagacagagcagaggcaacgagtacgaggccctgaccagcccccagaccagcttcagactgaaggagccccccagatgcgtgggcatcttcctggactacgaggccggcgtgatcagcttctacaacgtgaccaacaagagccacatcttcaccttcacccacaacttcagcggccccctgagacccttcttcgagccctgcctgcacgacggcggcaagaacaccgcccccctggtgatctgcagcgagctgcacaagagcgaggagagcatcgtgcccagacccgagggcaagggccacgccaacggcgacgtgagcctgaaggtgaacagcagcctgctgccccccaaggcccccgagctgaaggacatcatcctgagcctgccccccgacctgggccccgccctgcaggagctgaaggcccccagcttctag

SEQ ID NO: 80587 - DNA, 1428 bp, Artificial Sequence
  Description of Artificial Sequence: Synthetic coding sequence
atggagatggccagcagcgccggcagctggctgagcggctgcctgatccccctggtgttcctgagactgagcgtgcacgtgagcggccacgccggcgacgccggcaagttccacgtggccctgctgggcggcaccgccgagctgctgtgccccctgagcctgtggcccggcaccgtgcccaaggaggtgagatggctgagaagccccttcccccagagaagccaggccgtgcacatcttcagagacggcaaggaccaggacgaggacctgatgcccgagtacaagggcagaaccgtgctggtgagagacgcccaggagggcagcgtgaccctgcagatcctggacgtgagactggaggaccagggcagctacagatgcctgatccaggtgggcaacctgagcaaggaggacaccgtgatcctgcaggtggccgcccccagcgtgggcagcctgagccccagcgccgtggccctggccgtgatcctgcccgtgctggtgctgctgatcatggtgtgcctgtgcctgatctggaagcagagaagagccaaggagaagctgctgtacgagcacgtgaccgaggtggacaacctgctgagcgaccacgccaaggagaagggcaagctgcacaaggccgtgaagaagctgagaagcgagctgaagctgaagagagccgccgccaacagcggctggagaagagccagactgcacttcgtggccgtgaccctggaccccgacaccgcccaccccaagctgatcctgagcgaggaccagagatgcgtgagactgggcgacagaagacagcccgtgcccgacaacccccagagattcgacttcgtggtgagcatcctgggcagcgagtacttcaccaccggctgccactactgggaggtgtacgtgggcgacaagaccaagtggatcctgggcgtgtgcagcgagagcgtgagcagaaagggcaaggtgaccgccagccccgccaacggccactggctgctgagacagagcagaggcaacgagtacgaggccctgaccagcccccagaccagcttcagactgaaggagccccccagatgcgtgggcatcttcctggactacgaggccggcgtgatcagcttctacaacgtgaccaacaagagccacatcttcaccttcacccacaacttcagcggccccctgagacccttcttcgagccctgcctgcacgacggcggcaagaacaccgcccccctggtgatctgcagcgagctgcacaagagcgaggagagcatcgtgcccagacccgagggcaagggccacgccaacggcgacgtgagcctgaaggtgaacagcagcctgctgccccccaaggcccccgagctgaaggacatcatcctgagcctgccccccgacctgggccccgccctgcaggagctgaaggcccccagcttctag

SEQ ID NO: 80588 - DNA, 1428 bp, Artificial Sequence; identical to SEQ ID NO: 80587
  Description of Artificial Sequence: Synthetic coding sequence

SEQ ID NO: 80589 - DNA, 2595 bp, Artificial Sequence
  Description of Artificial Sequence: Synthetic coding sequence
atgaccaccgagaagagcctggtgaccgaggccgagaacagccagcaccagcagaaggaggagggcgaggaggccatcaacagcggccagcaggagccccagcaggaggagagctgccagaccgccgccgagggcgacaactggtgcgagcagaagctgaaggccagcaacggcgacacccccacccacgaggacctgaccaagaacaaggagagaaccagcgagagcagaggcctgagcagactgttcagcagcttcctgaagagacccaagagccaggtgagcgaggaggagggcaaggaggtggagagcgacaaggagaagggcgagggcggccagaaggagatcgagttcggcaccagcctggacgaggagatcatcctgaaggcccccatcgccgcccccgagcccgagctgaagaccgaccccagcctggacctgcacagcctgagcagcgccgagacccagcccgcccaggaggagctgagagaggaccccgacttcgagatcaaggagggcgagggcctggaggagtgcagcaagatcgaggtgaaggaggagagcccccagagcaaggccgagaccgagctgaaggccagccagaagcccatcagaaagcacagaaacatgcactgcaaggtgagcctgctggacgacaccgtgtacgagtgcgtggtggagaagcacgccaagggccaggacctgctgaagagagtgtgcgagcacctgaacctgctggaggaggactacttcggcctggccatctgggacaacgccaccagcaagacctggctggacagcgccaaggagatcaagaagcaggtgagaggcgtgccctggaacttcaccttcaacgtgaagttctacccccccgaccccgcccagctgaccgaggacatcaccagatactacctgtgcctgcagctgagacaggacatcgtggccggcagactgccctgcagcttcgccaccctggccctgctgggcagctacaccatccagagcgagctgggcgactacgaccccgagctgcacggcgtggactacgtgagcgacttcaagctggcccccaaccagaccaaggagctggaggagaaggtgatggagctgcacaagagctacagaagcatgacccccgcccaggccgacctggagttcctggagaacgccaagaagctgagcatgtacggcgtggacctgcacaaggccaaggacctggagggcgtggacatcatcctgggcgtgtgcagcagcggcctgctggtgtacaaggacaagctgagaatcaacagattcccctggcccaaggtgctgaagatcagctacaagagaagcagcttcttcatcaagatcagacccggcgagcaggagcagtacgagagcaccatcggcttcaagctgcccagctacagagccgccaagaagctgtggaaggtgtgcgtggagcaccacaccttcttcagactgaccagcaccgacaccatccccaagagcaagttcctggccctgggcagcaagttcagatacagcggcagaacccaggcccagaccagacaggccagcgccctgatcgacagacccgccccccacttcgagagaaccgccagcaagagagccagcagaagcctggacggcgccgccgccgtggacagcgccgacagaagccccagacccaccagcgcccccgccatcacccagggccaggtggccgagggcggcgtgctggacgccagcgccaagaagaccgtggtgcccaaggcccagaaggagaccgtgaaggccgaggtgaagaaggaggacgagccccccgagcaggccgagcccgagcccaccgaggcctggaaggtggagaagacccacatcgaggtgaccgtgcccaccagcaacggcgaccagacccagaagctggccgagaagaccgaggacctgatcagaatgagaaagaagaagagagagagactggacggcgagaacatctacatcagacacagcaacctgatgctggaggacctggacaagagccaggaggagatcaagaagcaccacgccagcatcagcgagctgaagaagaacttcatggagagcgtgcccgagcccagacccagcgagtgggacaagagactgagcacccacagccccttcagaaccctgaacatcaacggccagatccccaccggcgagggcccccccctggtgaagacccagaccgtgaccatcagcgacaacgccaacgccgtgaagagcgagatccccaccaaggacgtgcccatcgtgcacaccgagaccaagaccatcacctacgaggccgcccagaccgacgacaacagcggcgacctggaccccggcgtgctgctgaccgcccagaccatcaccagcgagacccccagcagcaccaccaccacccagatcaccaagaccgtgaagggcggcatcagcgagaccagaatcgagaagagaatcgtgatcaccggcgacgccgacatcgaccacgaccaggtgctggtgcaggccatcaaggaggccaaggagcagcaccccgacatgagcgtgaccaaggtggtggtgcaccaggagaccgagatcgccgacgagtag

SEQ ID NO: 80590 - DNA, 2328 bp, Artificial Sequence
  Description of Artificial Sequence: Synthetic coding sequence
atgaccaccgagaagagcctggtgaccgaggccgagaacagccagcaccagcagaaggaggagggcgaggaggccatcaacagcggccagcaggagccccagcaggaggagagctgccagaccgccgccgagggcgacaactggtgcgagcagaagctgaaggccagcaacggcgacacccccacccacgaggacctgaccaagaacaaggagagaaccagcgagagcagaggcctgagcagactgttcagcagcttcctgaagagacccaagagccaggtgagcgaggaggagggcaaggaggtggagagcgacaaggagaagggcgagggcggccagaaggagatcgagttcggcaccagcctggacgaggagatcatcctgaaggcccccatcgccgcccccgagcccgagctgaagaccgaccccagcctggacctgcacagcctgagcagcgccgagacccagcccgcccaggaggagctgagagaggaccccgacttcgagatcaaggagggcgagggcctggaggagtgcagcaagatcgaggtgaaggaggagagcccccagagcaaggccgagaccgagctgaaggccagccagaagcccatcagaaagcacagaaacatgcactgcaaggtgagcctgctggacgacaccgtgtacgagtgcgtggtggagacctggctggacagcgccaaggagatcaagaagcaggtgagaggcgtgccctggaacttcaccttcaacgtgaagttctacccccccgaccccgcccagctgaccgaggacatcaccagatactacctgtgcctgcagctgagacaggacatcgtggccggcagactgccctgcagcttcgccaccctggccctgctgggcagctacaccatccagagcgagctgggcgactacgaccccgagctgcacggcgtggactacgtgagcgacttcaagctggcccccaaccagaccaaggagctggaggagaaggtgatggagctgcacaagagctacagaagcatgacccccgcccaggccgacctggagttcctggagaacgccaagaagctgagcatgtacggcgtggacctgcacaaggccaaggacctggagggcgtggacatcatcctgggcgtgtgcagcagcggcctgctggtgtacaaggacaagctgagaatcaacagattcccctggcccaaggtgctgaagatcagctacaagagaagcagcttcttcatcaagatcagacccggcgagcaggagcagtacgagagcaccatcggcttcaagctgcccagctacagagccgccaagaagctgtggaaggtgtgcgtggagcaccacaccttcttcagactgaccagcaccgacaccatccccaagagcaagttcctggccctgggcagcaagttcagatacagcggcagaacccaggcccagaccagacaggccagcgccctgatcgacagacccgccccccacttcgagagaaccgccagcaagagagccagcagaagcctggacggcgccgccgccgtggacagcgccgacagaagccccagacccaccagcgcccccgccatcacccagggccaggtggccgagggcggcgtgctggacgccagcgccaagaagaccgtggtgcccaaggcccagaaggagaccgtgaaggccgaggtgaagaaggaggacgagccccccgagcaggccgagcccgagcccaccgaggcctggaaggacctggacaagagccaggaggagatcaagaagcaccacgccagcatcagcgagctgaagaagaacttcatggagagcgtgcccgagcccagacccagcgagtgggacaagagactgagcacccacagccccttcagaaccctgaacatcaacggccagatccccaccggcgagggcccccccctggtgaagacccagaccgtgaccatcagcgacaacgccaacgccgtgaagagcgagatccccaccaaggacgtgcccatcgtgcacaccgagaccaagaccatcacctacgaggccgcccagaccgacgacaacagcggcgacctggaccccggcgtgctgctgaccgcccagaccatcaccagcgagacccccagcagcaccaccaccacccagatcaccaagaccgtgaagggcggcatcagcgagaccagaatcgagaagagaatcgtgatcaccggcgacgccgacatcgaccacgaccaggtgctggtgcaggccatcaaggaggccaaggagcagcaccccgacatgagcgtgaccaaggtggtggtgcaccaggagaccgagatcgccgacgagtag

SEQ ID NO: 80591 - DNA, 1926 bp, Artificial Sequence
  Description of Artificial Sequence: Synthetic coding sequence
atgcactgcaaggtgagcctgctggacgacaccgtgtacgagtgcgtggtggagaagcacgccaagggccaggacctgctgaagagagtgtgcgagcacctgaacctgctggaggaggactacttcggcctggccatctgggacaacgccaccagcaagacctggctggacagcgccaaggagatcaagaagcaggtgagaggcgtgccctggaacttcaccttcaacgtgaagttctacccccccgaccccgcccagctgaccgaggacatcaccagatactacctgtgcctgcagctgagacaggacatcgtggccggcagactgccctgcagcttcgccaccctggccctgctgggcagctacaccatccagagcgagctgggcgactacgaccccgagctgcacggcgtggactacgtgagcgacttcaagctggcccccaaccagaccaaggagctggaggagaaggtgatggagctgcacaagagctacagaagcatgacccccgcccaggccgacctggagttcctggagaacgccaagaagctgagcatgtacggcgtggacctgcacaaggccaaggacctggagggcgtggacatcatcctgggcgtgtgcagcagcggcctgctggtgtacaaggacaagctgagaatcaacagattcccctggcccaaggtgctgaagatcagctacaagagaagcagcttcttcatcaagatcagacccggcgagcaggagcagtacgagagcaccatcggcttcaagctgcccagctacagagccgccaagaagctgtggaaggtgtgcgtggagcaccacaccttcttcagactgaccagcaccgacaccatccccaagagcaagttcctggccctgggcagcaagttcagatacagcggcagaacccaggcccagaccagacaggccagcgccctgatcgacagacccgccccccacttcgagagaaccgccagcaagagagccagcagaagcctggacggcgccgccgccgtggacagcgccgacagaagccccagacccaccagcgcccccgccatcacccagggccaggtggccgagggcggcgtgctggacgccagcgccaagaagaccgtggtgcccaaggcccagaaggagaccgtgaaggccgaggtgaagaaggaggacgagccccccgagcaggccgagcccgagcccaccgaggcctggaaggtggagaagacccacatcgaggtgaccgtgcccaccagcaacggcgaccagacccagaagaagagagagagactggacggcgagaacatctacatcagacacagcaacctgatgctggaggacctggacaagagccaggaggagatcaagaagcaccacgccagcatcagcgagctgaagaagaacttcatggagagcgtgcccgagcccagacccagcgagtgggacaagagactgagcacccacagccccttcagaaccctgaacatcaacggccagatccccaccggcgagggcccccccctggtgaagacccagaccgtgaccatcagcgacaacgccaacgccgtgaagagcgagatccccaccaaggacgtgcccatcgtgcacaccgagaccaagaccatcacctacgaggccgcccagaccgacgacaacagcggcgacctggaccccggcgtgctgctgaccgcccagaccatcaccagcgagacccccagcagcaccaccaccacccagatcaccaagaccgtgaagggcggcatcagcgagaccagaatcgagaagagaatcgtgatcaccggcgacgccgacatcgaccacgaccaggtgctggtgcaggccatcaaggaggccaaggagcagcaccccgacatgagcgtgaccaaggtggtggtgcaccaggagaccgagatcgccgacgagtag

SEQ ID NO: 80592 - DNA, 2496 bp, Artificial Sequence
  Description of Artificial Sequence: Synthetic coding sequence
atgaccaccgagaagagcctggtgaccgaggccgagaacagccagcaccagcagaaggaggagggcgaggaggccatcaacagcggccagcaggagccccagcaggaggagagctgccagaccgccgccgagggcgacaactggtgcgagcagaagctgaaggccagcaacggcgacacccccacccacgaggacctgaccaagaacaaggagagaaccagcgagagcagaggcctgagcagactgttcagcagcttcctgaagagacccaagagccaggtgagcgaggaggagggcaaggaggtggagagcgacaaggagaagggcgagggcggccagaaggagatcgagttcggcaccagcctggacgaggagatcatcctgaaggcccccatcgccgcccccgagcccgagctgaagaccgaccccagcctggacctgcacagcctgagcagcgccgagacccagcccgcccaggaggagctgagagaggaccccgacttcgagatcaaggagggcgagggcctggaggagtgcagcaagatcgaggtgaaggaggagagcccccagagcaaggccgagaccgagctgaaggccagccagaagcccatcagaaagcacagaaacatgcactgcaaggtgagcctgctggacgacaccgtgtacgagtgcgtggtggagaagcacgccaagggccaggacctgctgaagagagtgtgcgagcacctgaacctgctggaggaggactacttcggcctggccatctgggacaacgccaccagcaagacctggctggacagcgccaaggagatcaagaagcaggtgagaggcgtgccctggaacttcaccttcaacgtgaagttctacccccccgaccccgcccagctgaccgaggacatcaccagatactacctgtgcctgcagctgagacaggacatcgtggccggcagactgccctgcagcttcgccaccctggccctgctgggcagctacaccatccagagcgagctgggcgactacgaccccgagctgcacggcgtggactacgtgagcgacttcaagctggcccccaaccagaccaaggagctggaggagaaggtgatggagctgcacaagagctacagaagcatgacccccgcccaggccgacctggagttcctggagaacgccaagaagctgagcatgtacggcgtggacctgcacaaggccaaggacctggagggcgtggacatcatcctgggcgtgtgcagcagcggcctgctggtgtacaaggacaagctgagaatcaacagattcccctggcccaaggtgctgaagatcagctacaagagaagcagcttcttcatcaagatcagacccggcgagcaggagcagtacgagagcaccatcggcttcaagctgcccagctacagagccgccaagaagctgtggaaggtgtgcgtggagcaccacaccttcttcagactgaccagcaccgacaccatccccaagagcaagttcctggccctgggcagcaagttcagatacagcggcagaacccaggcccagaccagacaggccagcgccctgatcgacagacccgccccccacttcgagagaaccgccagcaagagagccagcagaagcctggacggcgccgccgccgtggacagcgccgacagaagccccagacccaccagcgcccccgccatcacccagggccaggtggccgagggcggcgtgctggacgccagcgccaagaagaccgtggtgcccaaggcccagaaggagaccgtgaaggccgaggtgaagaaggaggacgagccccccgagcaggccgagcccgagcccaccgaggcctggaagaagaagagagagagactggacggcgagaacatctacatcagacacagcaacctgatgctggaggacctggacaagagccaggaggagatcaagaagcaccacgccagcatcagcgagctgaagaagaacttcatggagagcgtgcccgagcccagacccagcgagtgggacaagagactgagcacccacagccccttcagaaccctgaacatcaacggccagatccccaccggcgagggcccccccctggtgaagacccagaccgtgaccatcagcgacaacgccaacgccgtgaagagcgagatccccaccaaggacgtgcccatcgtgcacaccgagaccaagaccatcacctacgaggccgcccagaccgacgacaacagcggcgacctggaccccggcgtgctgctgaccgcccagaccatcaccagcgagacccccagcagcaccaccaccacccagatcaccaagaccgtgaagggcggcatcagcgagaccagaatcgagaagagaatcgtgatcaccggcgacgccgacatcgaccacgaccaggtgctggtgcaggccatcaaggaggccaaggagcagcaccccgacatgagcgtgaccaaggtggtggtgcaccaggagaccgagatcgccgacgagtag

SEQ ID NO: 80593 - DNA, 2484 bp, Artificial Sequence
  Description of Artificial Sequence: Synthetic coding sequence
agagccagagccgccagaagccagaacgccgtgggccccgtgcccgccgcccccagccccgagaagagcctggtgaccgaggccgagaacagccagcaccagcagaaggaggagggcgaggaggccatcaacagcggccagcaggagccccagcaggaggagagctgccagaccgccgccgagggcgacaactggtgcgagcagaagctgaaggccagcaacggcgacacccccacccacgaggacctgaccaagaacaaggagagaaccagcgagagcagaggcctgagcagactgttcagcagcttcctgaagagacccaagagccaggtgagcgaggaggagggcaaggaggtggagagcgacaaggagaagggcgagggcggccagaaggagatcgagttcggcaccagcctggacgaggagatcatcctgaaggcccccatcgccgcccccgagcccgagctgaagaccgaccccagcctggacctgcacagcctgagcagcgccgagacccagcccgcccaggaggagctgagagaggaccccgacttcgagatcaaggagggcgagggcctggaggagtgcagcaagatcgaggtgaaggaggagagcccccagagcaaggccgagaccgagctgaaggccagccagaagcccatcagaaagcacagaaacatgcactgcaaggtgagcctgctggacgacaccgtgtacgagtgcgtggtggagaagcacgccaagggccaggacctgctgaagagagtgtgcgagcacctgaacctgctggaggaggactacttcggcctggccatctgggacaacgccaccagcaagacctggctggacagcgccaaggagatcaagaagcaggtgagaggcgtgccctggaacttcaccttcaacgtgaagttctacccccccgaccccgcccagctgaccgaggacatcaccagatactacctgtgcctgcagctgagacaggacatcgtggccggcagactgccctgcagcttcgccaccctggccctgctgggcagctacaccatccagagcgagctgggcgactacgaccccgagctgcacggcgtggactacgtgagcgacttcaagctggcccccaaccagaccaaggagctggaggagaaggtgatggagctgcacaagagctacagaagcatgacccccgcccaggccgacctggagttcctggagaacgccaagaagctgagcatgtacggcgtggacctgcacaaggccaaggacctggagggcgtggacatcatcctgggcgtgtgcagcagcggcctgctggtgtacaaggacaagctgagaatcaacagattcccctggcccaaggtgctgaagatcagctacaagagaagcagcttcttcatcaagatcagacccggcgagcaggagcagtacgagagcaccatcggcttcaagctgcccagctacagagccgccaagaagctgtggaaggtgtgcgtggagcaccacaccttcttcagactgaccagcaccgacaccatccccaagagcaagttcctggccctgggcagcaagttcagatacagcggcagaacccaggcccagaccagacaggccagcgccctgatcgacagacccgccccccacttcgagagaaccgccagcaagagagccagcagaagcctggacggcgccgccgccgtggacagcgccgacagaagccccagacccaccagcgcccccgccatcacccagggccaggtggccgagggcggcgtgctggacgccagcgccaagaagaccgtggtgcccaaggcccagaaggagaccgtgaaggccgaggtgaagaaggaggacgagccccccgagcaggccgagcccgagcccaccgaggcctggaaggacctggacaagagccaggaggagatcaagaagcaccacgccagcatcagcgagctgaagaagaacttcatggagagcgtgcccgagcccagacccagcgagtgggacaagagactgagcacccacagccccttcagaaccctgaacatcaacggccagatccccaccggcgagggcccccccctggtgaagacccagaccgtgaccatcagcgacaacgccaacgccgtgaagagcgagatccccaccaaggacgtgcccatcgtgcacaccgagaccaagaccatcacctacgaggccgcccagaccgacgacaacagcggcgacctggaccccggcgtgctgctgaccgcccagaccatcaccagcgagacccccagcagcaccaccaccacccagatcaccaagaccgtgaagggcggcatcagcgagaccagaatcgagaagagaatcgtgatcaccggcgacgccgacatcgaccacgaccaggtgctggtgcaggccatcaaggaggccaaggagcagcaccccgacatgagcgtgaccaaggtggtggtgcaccaggagaccgagatcgccgacgagtag

SEQ ID NO: 80594 - DNA, 2163 bp, Artificial Sequence
  Description of Artificial Sequence: Synthetic coding sequence
atgaccaccgagaagagcctggtgaccgaggccgagaacagccagcaccagcagaaggaggagggcgaggaggccatcaacagcggccagcaggagccccagcaggaggagagctgccagaccgccgccgagggcgacaactggtgcgagcagaagctgaaggccagcaacggcgacacccccacccacgaggacctgaccaagaacaaggagagaaccagcgagagcagaggcctgagcagactgttcagcagcttcctgaagagacccaagagccaggtgagcgaggaggagggcaaggaggtggagagcgacaaggagaagggcgagggcggccagaaggagatcgagttcggcaccagcctggacgaggagatcatcctgaaggcccccatcgccgcccccgagcccgagctgaagaccgaccccagcctggacctgcacagcctgagcagcgccgagacccagcccgcccaggaggagctgagagaggaccccgacttcgagatcaaggagggcgagggcctggaggagtgcagcaagatcgaggtgaaggaggagagcccccagagcaaggccgagaccgagctgaaggccagccagaagcccatcagaaagcacagaaacatgcactgcaaggtgagcctgctggacgacaccgtgtacgagtgcgtggtggagaagcacgccaagggccaggacctgctgaagagagtgtgcgagcacctgaacctgctggaggaggactacttcggcctggccatctgggacaacgccaccagcaagacctggctggacagcgccaaggagatcaagaagcaggtgagaggcgtgccctggaacttcaccttcaacgtgaagttctacccccccgaccccgcccagctgaccgaggacatcaccagatactacctgtgcctgcagctgagacaggacatcgtggccggcagactgccctgcagcttcgccaccctggccctgctgggcagctacaccatccagagcgagctgggcgactacgaccccgagctgcacggcgtggactacgtgagcgacttcaagctggcccccaaccagaccaaggagctggaggagaaggtgatggagctgcacaagagctacagaagcatgacccccgcccaggccgacctggagttcctggagaacgccaagaagctgagcatgtacggcgtggacctgcacaaggccaaggacctggagggcgtggacatcatcctgggcgtgtgcagcagcggcctgctggtgtacaaggacaagctgagaatcaacagattcccctggcccaaggtgctgaagatcagctacaagagaagcagcttcttcatcaagatcagacccggcgagcaggagcagtacgagagcaccatcggcttcaagctgcccagctacagagccgccaagaagctgtggaaggtgtgcgtggagcaccacaccttcttcagactgaccagcaccgacaccatccccaagagcaagttcctggccctgggcagcaagttcagatacagcggcagaacccaggcccagaccagacaggccagcgccctgatcgacagacccgccccccacttcgagagaaccgccagcaagagagccagcagaagcctggacggcgccgccgccgtggacagcgccgacagaagccccagacccaccagcgcccccgccatcacccagggccaggtggccgagggcggcgtgctggacgccagcgccaagaagaccgtggtgcccaaggcccagaaggagaccgtgaaggccgaggtgaagaaggaggacgagccccccgagcaggccgagcccgagcccaccgaggcctggaaggtggagaagacccacatcgaggtgaccgtgcccaccagcaacggcgaccagacccagaagaagagagagagactggacggcgagaacatctacatcagacacagcaacctgatgctggaggacctggacaagagccaggaggagatcaagaagcaccacgccagcatcagcgagctgaagaagaacttcatggagagcgtgcccgagcccagacccagcgagtgggacaagagactgagcacccacagccccttcagaaccctgaacatcaacggccagatccccaccggcgagggcgtgagcaccctgagcacctag

SEQ ID NO: 80595 - DNA, 2595 bp, Artificial Sequence; identical to SEQ ID NO: 80589
  Description of Artificial Sequence: Synthetic coding sequence

SEQ ID NO: 80596 - DNA, 1767 bp, Artificial Sequence
  Description of Artificial Sequence: Synthetic coding sequence
atgcactgcaaggtgagcctgctggacgacaccgtgtacgagtgcgtggtggagaagcacgccaagggccaggacctgctgaagagagtgtgcgagcacctgaacctgctggaggaggactacttcggcctggccatctgggacaacgccaccagcaagacctggctggacagcgccaaggagatcaagaagcaggtgagaggcgtgccctggaacttcaccttcaacgtgaagttctacccccccgaccccgcccagctgaccgaggacatcaccagatactacctgtgcctgcagctgagacaggacatcgtggccggcagactgccctgcagcttcgccaccctggccctgctgggcagctacaccatccagagcgagctgggcgactacgaccccgagctgcacggcgtggactacgtgagcgacttcaagctggcccccaaccagaccaaggagctggaggagaaggtgatggagctgcacaagagctacagaagcatgacccccgcccaggccgacctggagttcctggagaacgccaagaagctgagcatgtacggcgtggacctgcacaaggccaaggacctggagggcgtggacatcatcctgggcgtgtgcagcagcggcctgctggtgtacaaggacaagctgagaatcaacagattcccctggcccaaggtgctgaagatcagctacaagagaagcagcttcttcatcaagatcagacccggcgagcaggagcagtacgagagcaccatcggcttcaagctgcccagctacagagccgccaagaagctgtggaaggtgtgcgtggagcaccacaccttcttcagactgaccagcaccgacaccatccccaagagcaagttcctggccctgggcagcaagttcagatacagcggcagaacccaggcccagaccagacaggccagcgccctgatcgacagacccgccccccacttcgagagaaccgccagcaagagagccagcagaagcctggacggcgccgccgccgtggacagcgccgacagaagccccagacccaccagcgcccccgccatcacccagggccaggtggccgagggcggcgtgctggacgccagcgccaagaagaccgtggtgcccaaggcccagaaggagaccgtgaaggccgaggtgaagaaggaggacgagccccccgagcaggccgagcccgagcccaccgaggcctggaagaagaagagagagagactggacggcgagaacatctacatcagacacagcaacctgatgctggaggacctggacaagagccaggaggagatcaagaagcaccacgccagcatcagcgagctgaagaagaacttcatggagagcgtgcccgagcccagacccagcgagtgggacaagagactgagcacccacagccccttcagaaccctgaacatcaacggccagatccccaccggcgagggcccccccctggtgaagacccagaccgtgaccatcagcgacaacgccaacgccgtgaagagcgagatccccaccaaggacgtgcccatcgtgcacaccgagaccaagaccatcacctacgaggccgcccagaccgtgaagggcggcatcagcgagaccagaatcgagaagagaatcgtgatcaccggcgacgccgacatcgaccacgaccaggtgctggtgcaggccatcaaggaggccaaggagcagcaccccgacatgagcgtgaccaaggtggtggtgcaccaggagaccgagatcgccgacgagtag

SEQ ID NO: 80597 - DNA, 2115 bp, Artificial Sequence
  Description of Artificial Sequence: Synthetic coding sequence
atgaccaccgagaagagcctggtgaccgaggccgagaacagccagcaccagcagaaggaggagggcgaggaggccatcaacagcggccagcaggagccccagcaggaggagagctgccagaccgccgccgagggcgacaactggtgcgagcagaagctgaaggccagcaacggcgacacccccacccacgaggacctgaccaagaacaaggagagaaccagcgagagcagaggcctgagcagactgttcagcagcttcctgaagagacccaagagccaggtgagcgaggaggagggcaaggaggtggagagcgacaaggagaagggcgagggcggccagaaggagatcgagttcggcaccagcctggacgaggagatcatcctgaaggcccccatcgccgcccccgagcccgagctgaagaccgaccccagcctggacctgcacagcctgagcagcgccgagacccagacctggctggacagcgccaaggagatcaagaagcaggtgagaggcgtgccctggaacttcaccttcaacgtgaagttctacccccccgaccccgcccagctgaccgaggacatcaccagatactacctgtgcctgcagctgagacaggacatcgtggccggcagactgccctgcagcttcgccaccctggccctgctgggcagctacaccatccagagcgagctgggcgactacgaccccgagctgcacggcgtggactacgtgagcgacttcaagctggcccccaaccagaccaaggagctggaggagaaggtgatggagctgcacaagagctacagaagcatgacccccgcccaggccgacctggagttcctggagaacgccaagaagctgagcatgtacggcgtggacctgcacaaggccaaggacctggagggcgtggacatcatcctgggcgtgtgcagcagcggcctgctggtgtacaaggacaagctgagaatcaacagattcccctggcccaaggtgctgaagatcagctacaagagaagcagcttcttcatcaagatcagacccggcgagcaggagcagtacgagagcaccatcggcttcaagctgcccagctacagagccgccaagaagctgtggaaggtgtgcgtggagcaccacaccttcttcagactgaccagcaccgacaccatccccaagagcaagttcctggccctgggcagcaagttcagatacagcggcagaacccaggcccagaccagacaggccagcgccctgatcgacagacccgccccccacttcgagagaaccgccagcaagagagccagcagaagcctggacggcgccgccgccgtggacagcgccgacagaagccccagacccaccagcgcccccgccatcacccagggccaggtggccgagggcggcgtgctggacgccagcgccaagaagaccgtggtgcccaaggcccagaaggagaccgtgaaggccgaggtgaagaaggaggacgagccccccgagcaggccgagcccgagcccaccgaggcctggaaggacctggacaagagccaggaggagatcaagaagcaccacgccagcatcagcgagctgaagaagaacttcatggagagcgtgcccgagcccagacccagcgagtgggacaagagactgagcacccacagccccttcagaaccctgaacatcaacggccagatccccaccggcgagggcccccccctggtgaagacccagaccgtgaccatcagcgacaacgccaacgccgtgaagagcgagatccccaccaaggacgtgcccatcgtgcacaccgagaccaagaccatcacctacgaggccgcccagaccgacgacaacagcggcgacctggaccccggcgtgctgctgaccgcccagaccatcaccagcgagacccccagcagcaccaccaccacccagatcaccaagaccgtgaagggcggcatcagcgagaccagaatcgagaagagaatcgtgatcaccggcgacgccgacatcgaccacgaccaggtgctggtgcaggccatcaaggaggccaaggagcagcaccccgacatgagcgtgaccaaggtggtggtgcaccaggagaccgagatcgccgacgagtag

SEQ ID NO: 80598 - DNA, 2304 bp, Artificial Sequence
  Description of Artificial Sequence: Synthetic coding sequence
atgaccaccgagaagagcctggtgaccgaggccgagaacagccagcaccagcagaaggaggagggcgaggaggccatcaacagcggccagcaggagccccagcaggaggagagctgccagaccgccgccgagggcgacaactggtgcgagcagaagctgaaggccagcaacggcgacacccccacccacgaggacctgaccaagaacaaggagagaaccagcgagagcagaggcctgagcagactgttcagcagcttcctgaagagacccaagagccaggtgagcgaggaggagggcaaggaggtggagagcgacaaggagaagggcgagggcggccagaaggagatcgagttcggcaccagcctggacgaggagatcatcctgaaggcccccatcgccgcccccgagcccgagctgaagaccgaccccagcctggacctgcacagcctgagcagcgccgagacccagcccgcccaggaggagctgagagaggaccccgacttcgagatcaaggagggcgagggcctggaggagtgcagcaagatcgaggtgaaggaggagagcccccagagcaaggccgagaccgagctgaaggccagccagaagcccatcagaaagcacagaaacatgcactgcaaggtgagcctgctggacgacaccgtgtacgagtgcgtggtggagaagcacgccaagggccaggacctgctgaagagagtgtgcgagcacctgaacctgctggaggaggactacttcggcctggccatctgggacaacgccaccagcaagacctggctggacagcgccaaggagatcaagaagcaggtgagaggcgtgccctggaacttcaccttcaacgtgaagttctacccccccgaccccgcccagctgaccgaggacatcaccagatactacctgtgcctgcagctgagacaggacatcgtggccggcagactgccctgcagcttcgccaccctggccctgctgggcagctacaccatccagagcgagctgggcgactacgaccccgagctgcacggcgtggactacgtgagcgacttcaagctggcccccaaccagaccaaggagctggaggagaaggtgatggagctgcacaagagctacagaagcatgacccccgcccaggccgacctggagttcctggagaacgccaagaagctgagcatgtacggcgtggacctgcacaaggccaaggacctggagggcgtggacatcatcctgggcgtgtgcagcagcggcctgctggtgtacaaggacaagctgagaatcaacagattcccctggcccaaggtgctgaagatcagctacaagagaagcagcttcttcatcaagatcagacccggcgagcaggagcagtacgagagcaccatcggcttcaagctgcccagctacagagccgccaagaagctgtggaaggtgtgcgtggagcaccacaccttcttcagactgaccagcaccgacaccatccccaagagcaagttcctggccctgggcagcaagttcagatacagcggcagaacccaggcccagaccagacaggccagcgccctgatcgacagacccgccccccacttcgagagaaccgccagcaagagagccagcagaagcctggacggcgccgccgccgtggacagcgccgacagaagccccagacccaccagcgcccccgccatcacccagggccaggtggccgagggcggcgtgctggacgccagcgccaagaagaccgtggtgcccaaggcccagaaggagaccgtgaaggccgaggtgaagaaggaggacgagccccccgagcaggccgagcccgagcccaccgaggcctggaaggacctggacaagagccaggaggagatcaagaagcaccacgccagcatcagcgagctgaagaagaacttcatggagagcgtgcccgagcccagacccagcgagtgggacaagagactgagcacccacagccccttcagaaccctgaacatcaacggccagatccccaccggcgagggcaccgacgacaacagcggcgacctggaccccggcgtgctgctgaccgcccagaccatcaccagcgagacccccagcagcaccaccaccacccagatcaccaagaccgtgaagggcggcatcagcgagaccagaatcgagaagagaatcgtgatcaccggcgacgccgacatcgaccacgaccaggtgctggtgcaggccatcaaggaggccaaggagcagcaccccgacatgagcgtgaccaaggtggtggtgcaccaggagaccgagatcgccgacgagtag

SEQ ID NO: 80599 - DNA, 2145 bp, Artificial Sequence
  Description of Artificial Sequence: Synthetic coding sequence
atgaccaccgagaagagcctggtgaccgaggccgagaacagccagcaccagcagaaggaggagggcgaggaggccatcaacagcggccagcaggagccccagcaggaggagagctgccagaccgccgccgagggcgacaactggtgcgagcagaagctgaaggccagcaacggcgacacccccacccacgaggacctgaccaagaacaaggagagaaccagcgagagcagaggcctgagcagactgttcagcagcttcctgaagagacccaagagccaggtgagcgaggaggagggcaaggaggtggagagcgacaaggagaagggcgagggcggccagaaggagatcgagttcggcaccagcctggacgaggagatcatcctgaaggcccccatcgccgcccccgagcccgagctgaagaccgaccccagcctggacctgcacagcctgagcagcgccgagacccagcccgcccaggaggagctgagagaggaccccgacttcgagatcaaggagggcgagggcctggaggagtgcagcaagatcgaggtgaaggaggagagcccccagagcaaggccgagaccgagctgaaggccagccagaagcccatcagaaagcacagaaacatgcactgcaaggtgagcctgctggacgacaccgtgtacgagtgcgtggtggagaagcacgccaagggccaggacctgctgaagagagtgtgcgagcacctgaacctgctggaggaggactacttcggcctggccatctgggacaacgccaccagcaagacctggctggacagcgccaaggagatcaagaagcaggtgagaggcgtgccctggaacttcaccttcaacgtgaagttctacccccccgaccccgcccagctgaccgaggacatcaccagatactacctgtgcctgcagctgagacaggacatcgtggccggcagactgccctgcagcttcgccaccctggccctgctgggcagctacaccatccagagcgagctgggcgactacgaccccgagctgcacggcgtggactacgtgagcgacttcaagctggcccccaaccagaccaaggagctggaggagaaggtgatggagctgcacaagagctacagaagcatgacccccgcccaggccgacctggagttcctggagaacgccaagaagctgagcatgtacggcgtggacctgcacaaggccaaggacctggagggcgtggacatcatcctgggcgtgtgcagcagcggcctgctggtgtacaaggacaagctgagaatcaacagattcccctggcccaaggtgctgaagatcagctacaagagaagcagcttcttcatcaagatcagacccggcgagcaggagcagtacgagagcaccatcggcttcaagctgcccagctacagagccgccaagaagctgtggaaggtgtgcgtggagcaccacaccttcttcagactgaccagcaccgacaccatccccaagagcaagttcctggccctgggcagcaagttcagatacagcggcagaacccaggcccagaccagacaggccagcgccctgatcgacagacccgccccccacttcgagagaaccgccagcaagagagccagcagaagcctggacggcgccgccgccgtggacagcgccgacagaagccccagacccaccagcgcccccgccatcacccagggccaggtggccgagggcggcgtgctggacgccagcgccaagaagaccgtggtgcccaaggcccagaaggagaccgtgaaggccgaggtgaagaaggaggacgagccccccgagcaggccgagcccgagcccaccgaggcctggaaggtggagaagacccacatcgaggtgaccgtgcccaccagcaacggcgaccagacccagaagaagagagagagactggacggcgagaacatctacatcagacacagcaacctgatgctggaggacctggacaagagccaggaggagatcaagaagcaccacgccagcatcagcgagctgaagaagaacttcatggagagcgtgcccgagcccagacccagcgagtgggacaagagactgagcacccacagccccttcagaaccctgaacatcaacggccagatccccaccggcgagggctag

SEQ ID NO: 80600 - DNA, 2061 bp, Artificial Sequence
  Description of Artificial Sequence: Synthetic coding sequence
atgggctgcttctgcgccgtgcccgaggagttctactgcgaggtgctgctgctggacgagagcaagctgaccctgaccacccagcagcagggcatcaagaagagcaccaagggcagcgtggtgctggaccacgtgttccaccacgtgaacctggtggagatcgactacttcggcctgagatactgcgacagaagccaccagacctactggctggaccccgccaagaccctggccgagcacaaggagctgatcaacaccggccccccctacaccctgtacttcggcatcaagttctacgccgaggacccctgcaagctgaaggaggagatcaccagataccagttcttcctgcaggtgaagcaggacgtgctgcagggcagactgccctgccccgtgaacaccgccgcccagctgggcgcctacgccatccagagcgagctgggcgactacgacccctacaagcacaccgccggctacgtgagcgagtacagattcgtgcccgaccagaaggaggagctggaggaggccatcgagagaatccacaagaccctgatgggccagatccccagcgaggccgagctgaactacctgagaaccgccaagagcctggagatgtacggcgtggacctgcaccccgtgtacggcgagaacaagagcgagtacttcctgggcctgacccccgtgggcgtggtggtgtacaagaacaagaagcaggtgggcaagtacttctggcccagaatcaccaaggtgcacttcaaggagacccagttcgagctgagagtgctgggcaaggactgcaacgagaccagcttcttcttcgaggccagaagcaagaccgcctgcaagcacctgtggaagtgcagcgtggagcaccacaccttcttcagaatgcccgagaacgagagcaacagcctgagcagaaagctgagcaagttcggcagcatcagatacaagcacagatacagcggcagaaccgccctgcagatgagcagagacctgagcatccagctgcccagacccgaccagaacgtgaccagaagcagaagcaagacctaccccaagagaatcgcccagacccagcccgccgagagcaacagcatcagcagaatcaccgccaacatggagaacggcgagaacgagggcaccatcaagatcatcgcccccagccccgtgaagagcttcaagaaggccaagaacgagaacagccccgacacccagagaagcaagagccacgccccctgggaggagaacggcccccagagcggcctgtacaacagccccagcgacagaaccaagagccccaagttcccctacaccagaagaagaaaccccagctgcggcagcgacaacgacagcgtgcagcccgtgagaagaagaaaggcccacaacagcggcgaggacagcgacctgaagcagagaagaagaagcagaagcagatgcaacaccagcagcggcagcgagagcgagaacagcaacagagagtacagaaagaagagaaacagaatcagacaggagaacgacatggtggacagcgccccccagtgggaggccgtgctgagaagacagaaggagaagaaccaggccgaccccaacaacagaagaagcagacacagaagcagaagcagaagccccgacatccaggccaaggaggagctgtggaagcacatccagaaggagctggtggaccccagcggcctgagcgaggagcagctgaaggagatcccctacaccaagatcgagacccagggcgaccccatcagaatcagacacagccacagccccagaagctacagacagtacagaagaagccagtgcagcgacggcgagagaagcgtgctgagcgaggtgaacagcaagaccgacctggtgccccccctgcccgtgaccagaagcagcgacgcccagggcagcggcgacgccaccgtgcaccagagaagaaacggcagcaaggacagcctgatggaggagaagccccagaccagcaccaacaacctggccggcaagcacaccgccaagaccatcaagaccatccaggccagcagactgaagaccgagacctag

SEQ ID NO: 80601 - DNA, 1836 bp, Artificial Sequence
  Description of Artificial Sequence: Synthetic coding sequence
atggacttcaagaagagcaagctgaccctggtggtggtggaggacgacgaccagggcagagagcaggagcacaccttcgtgttcagactggacagcgccagaacctgcaagcacctgtggaagtgcgccgtggagcaccacgccttcttcagactgagaacccccggcaacagcaagagcaacagaagcgacttcatcagactgggcagcagattcagattcagcggcagaaccgagtaccaggccacccacggcagcagactgagaagaaccagcaccttcgagagaaagcccagcaagagataccccagcagaagacacagcaccttcaaggccagcaaccccgtgatcgccgcccagctgtgcagcaagaccaaccccgaggtgcacaactaccagccccagtaccaccccaacatccaccccagccagcccagatggcacccccacagccccaacgtgagctaccccctgcccagccccgtgctgagcagcagcgacagactgcccttcggcatcgaggagaacggcggcacccccttcctgaccgccgccagcggcagacaccaccaccagcaccagcaccagcaccagcaccagcaccacagcaactacagcctgagcctgaccctggagaacaaggagggccccctgagaagccccaacagcagcagcaagagcctgaccaagctgagccccggcacccccgccctgttcagcgaggccgccgcccacctgaagaagctggagctggagaccgtgaaggccgccggcccctggccccccctgcacatcaacatcaacaaggccgaggagaagaaggtgagcgagaagaccctgcagacccccctgctgcccagccccgtggccgaccacgtgaagtgcaacatcctgaaggcccagctggagaacgccagcagagtgaacatccagggcggcaaggaggagagccccttcgtgaacatcaacaagaagagcagcctgcaggacgccagcgtgagaagccccatccccatcagagtggagaccgcccagcccgccgtggagaagcccgagatcaagccccccagagtgagaaagctgaccagacagtacagcttcgacgaggacgacctgccccccgacctggccgaggccgtgggcgtgaccaccagcaccaccaccaacaccaccaccgccgccacccaggtgagcgtgcccctgcccagccccaaggtgcagaacgtgagcagcccccacaagagcgagggcaagggcctgctgagccccggcgccaagagccccagcgacagaggcggcgccttcaccctggagcccggcgacctgctgatggacttcaccgaggccacccccctggccgagcccgccagcaacccccactgcgcccacagcagatgcagcccccccctgagcctgcccatgaaggaggagaccaccggcgtgtgcatgtacccccccatcaagaccagactgatcaagaccttccccgtggacaccatgaaccccttccccgacaccttcaccaccggcccccagttcaccgccgacttcagagacagcaagctgcagtgctgccccggccccaccagccccctgatccccgccgccaccctgagacccctgaccgagaccgtgcacagcgccgaccacctgcaccaccccgagacctgcttcagcggcagccagtgcagagacacccccgccggcaccggcgagagagaggacgacgagaagaccgtggacgacagaaccgtgaagttcagcccctgccacctggaggacggcatggtgcccagcgtgagactgctgagcagcggcttcgtgtgcagcctgtag

SEQ ID NO: 80602 - DNA, 1323 bp, Artificial Sequence
  Description of Artificial Sequence: Synthetic coding sequence
atgaagttcctgctgatcaaggacgcccccggcaagaagaagagaaagaacctgatgctgagcttcaagagaaagcacgccaagggccaggacctgttcgaccagatcgtgtaccacctggacctggtggagaccgactacttcggcctgcagttcctggacagcgcccaggtggcccactggctggaccacgccaagcccatcaagaagcagatgaagatcggccccgcctacgccctgcacttcagagtgaagtactacagcagcgagcccaacaacctgagagaggagttcaccagatacctgttcgtgctgcagctgagacacgacatcctgagcggcaagctgaagtgcccctacgagaccgccgtggagctggccgccctgtgcctgcaggccgagctgggcgagtgcgagctgcccgagcacacccccgagctggtgagcgagttcagattcatccccaaccagaccgaggccatggagttcgacatcttccagagatggaaggagtgcagaggcaagagccccgcccaggccgagctgagctacctgaacaaggccaagtggctggagatgtacggcgtggacatgcacgtggtgagaggcagagacggctgcgagtacagcctgggcctgacccccaccggcatcctgatcttcgagggcgccaacaagatcggcctgttcttctggcccaagatcaccaagatggacttcaagaagagcaagctgaccctggtggtggtggaggacgacgaccagggcagagagcaggagcacaccttcgtgttcagactggacagcgccagaacctgcaagcacctgtggaagtgcgccgtggagcaccacgccttcttcagactgagaacccccggcaacagcaagagcaacagaagcgacttcatcagactgggcagcagattcagattcagcggcagaaccgagtaccaggccacccacggcagcagactgagaagaaccagcaccttcgagagaaagcccagcaagagataccccagcagaagacacagcaccttcaaggccagcaaccccgtgatcgccgcccagctgtgcagcaagaccaaccccgaggtgcacaactaccagccccagtaccaccccaacatccaccccagccagcccagatggcacccccacagccccaacgtgagacccagcttccaggacgacagaagccactggaaggccagcgccagcggcgacgacagccacttcgactacgtgcacgaccagaaccagaagaacctgggcggcatgcagagcatgatgtacagagacaagctgatgaccgccctgtag

SEQ ID NO: 80603 - DNA, 1557 bp, Artificial Sequence
  Description of Artificial Sequence: Synthetic coding sequence
atgctgagattcctgagaagaaccttcggcagaagaagcatgcagagatacgccagaggcgccgccggcagaggcgccgccggcctgggcgacgagagagacggcggccccagaggcggccccgccgccgccgccagcagcagcgccctgcccgccgcccccggcggcagcgtgttccccgccggcggcggccccctgctgaccggcggcgccgccgtgcacatcagcgccgccggcgccgccaaggccaccctgtactgcagagtgttcctgctggacggcaccgaggtgagcgtggacctgcccaagcacgccaagggccaggacctgttcgaccagatcgtgtaccacctggacctggtggagaccgactacttcggcctgcagttcctggacagcgcccaggtggcccactggctggaccacgccaagcccatcaagaagcagatgaagatcggccccgcctacgccctgcacttcagagtgaagtactacagcagcgagcccaacaacctgagagaggagttcaccagatacctgttcgtgctgcagctgagacacgacatcctgagcggcaagctgaagtgcccctacgagaccgccgtggagctggccgccctgtgcctgcaggccgagctgggcgagtgcgagctgcccgagcacacccccgagctggtgagcgagttcagattcatccccaaccagaccgaggccatggagttcgacatcttccagagatggaaggagtgcagaggcaagagccccgcccaggccgagctgagctacctgaacaaggccaagtggctggagatgtacggcgtggacatgcacgtggtgagaggcagagacggctgcgagtacagcctgggcctgacccccaccggcatcctgatcttcgagggcgccaacaagatcggcctgttcttctggcccaagatcaccaagatggacttcaagaagagcaagctgaccctggtggtggtggaggacgacgaccagggcagagagcaggagcacaccttcgtgttcagactggacagcgccagaacctgcaagcacctgtggaagtgcgccgtggagcaccacgccttcttcagactgagaacccccggcaacagcaagagcaacagaagcgacttcatcagactgggcagcagattcagattcagcggcagaaccgagtaccaggccacccacggcagcagactgagaagaaccagcaccttcgagagaaagcccagcaagagataccccagcagaagacacagcaccttcaaggccagcaaccccgtgatcgccgcccagctgtgcagcaagaccaaccccgaggtgcacaactaccagccccagtaccaccccaacatccaccccagccagcccagatggcacccccacagccccaacgtgagacccagcttccaggacgacagaagccactggaaggccagcgccagcggcgacgacagccacttcgactacgtgcacgaccagaaccagaagaacctgggcggcatgcagagcatgatgtacagagacaagctgatgaccgccctgtag

SEQ ID NO: 80604 - DNA, 2703 bp, Artificial Sequence
  Description of Artificial Sequence: Synthetic coding sequence
atgctgagattcctgagaagaaccttcggcagaagaagcatgcagagatacgccagaggcgccgccggcagaggcgccgccggcctgggcgacgagagagacggcggccccagaggcggccccgccgccgccgccagcagcagcgccctgcccgccgcccccggcggcagcgtgttccccgccggcggcggccccctgctgaccggcggcgccgccgtgcacatcagcgccgccggcgccgccaaggccaccctgtactgcagagtgttcctgctggacggcaccgaggtgagcgtggacctgcccaagcacgccaagggccaggacctgttcgaccagatcgtgtaccacctggacctggtggagaccgactacttcggcctgcagttcctggacagcgcccaggtggcccactggctggaccacgccaagcccatcaagaagcagatgaagatcggccccgcctacgccctgcacttcagagtgaagtactacagcagcgagcccaacaacctgagagaggagttcaccagatacctgttcgtgctgcagctgagacacgacatcctgagcggcaagctgaagtgcccctacgagaccgccgtggagctggccgccctgtgcctgcaggccgagctgggcgagtgcgagctgcccgagcacacccccgagctggtgagcgagttcagattcatccccaaccagaccgaggccatggagttcgacatcttccagagatggaaggagtgcagaggcaagagccccgcccaggccgagctgagctacctgaacaaggccaagtggctggagatgtacggcgtggacatgcacgtggtgagaggcagagacggctgcgagtacagcctgggcctgacccccaccggcatcctgatcttcgagggcgccaacaagatcggcctgttcttctggcccaagatcaccaagatggacttcaagaagagcaagctgaccctggtggtggtggaggacgacgaccagggcagagagcaggagcacaccttcgtgttcagactggacagcgccagaacctgcaagcacctgtggaagtgcgccgtggagcaccacgccttcttcagactgagaacccccggcaacagcaagagcaacagaagcgacttcatcagactgggcagcagattcagattcagcggcagaaccgagtaccaggccacccacggcagcagactgagaagaaccagcaccttcgagagaaagcccagcaagagataccccagcagaagacacagcaccttcaaggccagcaaccccgtgatcgccgcccagctgtgcagcaagaccaaccccgaggtgcacaactaccagccccagtaccaccccaacatccaccccagccagcccagatggcacccccacagccccaacgtgagctaccccctgcccagccccgtgctgagcagcagcgacagactgcccttcggcatcgaggagaacggcggcacccccttcctgaccgccgccagcggcagacaccaccaccagcaccagcaccagcaccagcaccagcaccacagcaactacagcctgagcctgaccctggagaacaaggagggccccctgagaagccccaacagcagcagcaagagcctgaccaagctgagccccggcacccccgccctgttcagcgaggccgccgcccacctgaagaagctggagctggagaccgtgaaggccgccggcccctggccccccctgcacatcaacatcaacaaggccgaggagaagaaggtgagcgagaagaccctgcagacccccctgctgcccagccccgtggccgaccacgtgaagtgcaacatcctgaaggcccagctggagaacgccagcagagtgaacatccagggcggcaaggaggagagccccttcgtgaacatcaacaagaagagcagcctgcaggacgccagcgtgagaagccccatccccatcagagtggagaccgcccagcccgccgtggagaagcccgagatcaagccccccagagtgagaaagctgaccagacagtacagcttcgacgaggacgacctgccccccgacctggccgaggccgtgggcgtgaccaccagcaccaccaccaacaccaccaccgccgccacccaggtgagcgtgcccctgcccagccccaaggtgcagaacgtgagcagcccccacaagagcgagggcaagggcctgctgagccccggcgccaagagccccagcgacagaggcggcgccttcaccctggagcccggcgacctgctgatggacttcaccgaggccacccccctggccgagcccgccagcaacccccactgcgcccacagcagatgcagcccccccctgagcctgcccatgaaggaggagaccaccggcgtgtgcatgtacccccccatcaagaccagactgatcaagaccttccccgtggacaccatgaaccccttccccgacaccttcaccaccggcccccagttcaccgccgacttcagagacagcaagctgcagtgctgccccggccccaccagccccctgatccccgccgccaccctgagacccctgaccgagaccgtgagcaccgtgcagaccatctacaccaccagaaagcccgtgagcctggccgccagcgccgagaccctgagacaggagctggagagagagaagatgatgaagagactgctgatgaccgagctgtag

SEQ ID NO: 80605 - DNA, 2202 bp, Artificial Sequence
  Description of Artificial Sequence: Synthetic coding sequence
atgctgagcttcttcagaagaaccctgggcagaagaagcatgagaaagcacgccgagaaggagagactgagagaggcccagagagccgccacccacatccccgccgccggcgacagcaagagcatcatcacctgcagagtgagcctgctggacggcaccgacgtgagcgtggacctgcccaagaaggccaagggccaggagctgttcgaccagatcatgtaccacctggacctgatcgagagcgactacttcggcctgagattcatggacagcgcccaggtggcccactggctggacggcaccaagagcatcaagaagcaggtgaagatcggcagcccctactgcctgcacctgagagtgaagttctacagcagcgagcccaacaacctgagagaggagctgaccagatacctgttcgtgctgcagctgaagcaggacatcctgagcggcaagctggactgccccttcgacaccgccgtgcagctggccgcctacaacctgcaggccgagctgggcgactacgacctggccgagcacagccccgagctggtgagcgagttcagattcgtgcccatccagaccgaggagatggagctggccatcttcgagaagtggaaggagtacagaggccagacccccgcccaggccgagaccaactacctgaacaaggccaagtggctggagatgtacggcgtggacatgcacgtggtgaaggccagagacggcaacgactacagcctgggcctgacccccaccggcgtgctggtgttcgagggcgacaccaagatcggcctgttcttctggcccaagatcaccagactggacttcaagaagaacaagctgaccctggtggtggtggaggacgacgaccagggcaaggagcaggagcacaccttcgtgttcagactggaccaccccaaggcctgcaagcacctgtggaagtgcgccgtggagcaccacgccttcttcagactgagaggccccgtgcagaagagcagccacagaagcggcttcatcagactgggcagcagattcagatacagcggcaagaccgagtaccagaccaccaagaccaacaaggccagaagaagcaccagcttcgagagaagacccagcaagagatacagcagaagaaccctgcagatgaaggcctgcgccaccaagcccgaggagctgagcgtgcacaacaacgtgagcacccagagcaacggcagccagcaggcctggggcatgagaagcgccctgcccgtgagccccagcatcagcagcgcccccgtgcccgtggagatcgagaacctgccccagagccccggcaccgaccagcacgacagaaagtgcatccccctgaacatcgacctgctgaacagccccgacctgctggaggccaccatcggcgacgtgatcggcgccagcgacaccatggagaccagccaggccctgaacgacgtgaacgtggccaccagactgcccggcctgggcgagcccgaggtggagtacgagaccctgaaggacaccagcgagaagctgaagcagctggagatggagaacagccccctgctgagccccagaagcaacatcgacgtgaacatcaacagccaggaggaggtggtgaagctgaccgagaagtgcctgaacaacgtgatcgagagccccggcctgaacgtgatgagagtgccccccgacttcaagagcaacatcctgaaggcccaggtggaggccgtgcacaaggtgaccaaggaggacagcctgctgagccacaagaacgccaacgtgcaggacgccgccaccaacagcgccgtgctgaacgagaacaacgtgcccctgcccaaggagagcctggagaccctgatgctgatcacccccgccgacagcggcagcgtgctgaaggaggccaccgacgagctggacgccctgctggccagcctgaccgagaacctgatcgaccacaccgtggccccccaggtgagcagcaccagcatgatcacccccagatggatcgtgccccagagcggcgccatgagcaacggcctggccggctgcgagatgctgctgaccggcaaggagggccacggcaacaaggacggcatcagcctgatcagcccccccgcccccttcctggtggacgccgtgaccagcagcggccccatcctggccgaggaggccgtgctgaagcagaagtgcctgctgaccaccgagctgtag

SEQ ID NO: 80606 - DNA, 1518 bp, Artificial Sequence
  Description of Artificial Sequence: Synthetic coding sequence
atgctgagcttcttcagaagaaccctgggcagaagaagcatgagaaagcacgccgagaaggagagactgagagaggcccagagagccgccacccacatccccgccgccggcgacagcaagagcatcatcacctgcagagtgagcctgctggacggcaccgacgtgagcgtggacctgcccaagaaggccaagggccaggagctgttcgaccagatcatgtaccacctggacctgatcgagagcgactacttcggcctgagattcatggacagcgcccaggtggcccactggctggacggcaccaagagcatcaagaagcaggtgaagatcggcagcccctactgcctgcacctgagagtgaagttctacagcagcgagcccaacaacctgagagaggagctgaccagatacctgttcgtgctgcagctgaagcaggacatcctgagcggcaagctggactgccccttcgacaccgccgtgcagctggccgcctacaacctgcaggccgagctgggcgactacgacctggccgagcacagccccgagctggtgagcgagttcagattcgtgcccatccagaccgaggagatggagctggccatcttcgagaagtggaaggagtacagaggccagacccccgcccaggccgagaccaactacctgaacaaggccaagtggctggagatgtacggcgtggacatgcacgtggtgaaggccagagacggcaacgactacagcctgggcctgacccccaccggcgtgctggtgttcgagggcgacaccaagatcggcctgttcttctggcccaagatcaccagactggacttcaagaagaacaagctgaccctggtggtggtggaggacgacgaccagggcaaggagcaggagcacaccttcgtgttcagactggaccaccccaaggcctgcaagcacctgtggaagtgcgccgtggagcaccacgccttcttcagactgagaggccccgtgcagaagagcagccacagaagcggcttcatcagactgggcagcagattcagatacagcggcaagaccgagtaccagaccaccaagaccaacaaggccagaagaagcaccagcttcgagagaagacccagcaagagatacagcagaagaaccctgcagatgaaggcctgcgccaccaagcccgaggagctgagcgtgcacaacaacgtgagcacccagagcaacggcagccagcaggcctggggcatgagaagcgccctgcccgtgagccccagcatcagcagcgcccccgtgcccgtggagatcgagaacctgccccagagccccggcaccgaccagcacgacagaaagtggctgagcgccgccagcgactgctgccagagaggcggcaaccagtggaacaccagagccctgccccccccccagaccgcccacagaaactacaccgacttcgtgcacgagcacaacgtgaagaacgccggcatcagacacgacgtgcacttccccggccacaccgccatgaccgagatctag

SEQ ID NO: 80607 - DNA, 1518 bp, Artificial Sequence; identical to SEQ ID NO: 80606
  Description of Artificial Sequence: Synthetic coding sequence

SEQ ID NO: 80608 - DNA, 2064 bp, Artificial Sequence
  Description of Artificial Sequence: Synthetic coding sequence
atgctgagcttcttcagaagaaccctgggcagaagaagcatgagaaagcacgccgagaaggagagactgagagaggcccagagagccgccacccacatccccgccgccggcgacagcaagagcatcatcacctgcagagtgagcctgctggacggcaccgacgtgagcgtggacctgcccaagaaggccaagggccaggagctgttcgaccagatcatgtaccacctggacctgatcgagagcgactacttcggcctgagattcatggacagcgcccaggtggcccactggctggacggcaccaagagcatcaagaagcaggtgaagatcggcagcccctactgcctgcacctgagagtgaagttctacagcagcgagcccaacaacctgagagaggagctgaccagatacctgttcgtgctgcagctgaagcaggacatcctgagcggcaagctggactgccccttcgacaccgccgtgcagctggccgcctacaacctgcaggccgagctgggcgactacgacctggccgagcacagccccgagctggtgagcgagttcagattcgtgcccatccagaccgaggagatggagctggccatcttcgagaagtggaaggagtacagaggccagacccccgcccaggccgagaccaactacctgaacaaggccaagtggctggagatgtacggcgtggacatgcacgtggtgaaggccagagacggcaacgactacagcctgggcctgacccccaccggcgtgctggtgttcgagggcgacaccaagatcggcctgttcttctggcccaagatcaccagactggacttcaagaagaacaagctgaccctggtggtggtggaggacgacgaccagggcaaggagcaggagcacaccttcgtgttcagactggaccaccccaaggcctgcaagcacctgtggaagtgcgccgtggagcaccacgccttcttcagactgagaggccccgtgcagaagagcagccacagaagcggcttcatcagactgggcagcagattcagatacagcggcaagaccgagtaccagaccaccaagaccaacaaggccagaagaagcaccagcttcgagagaagacccagcaagagatacagcagaagaaccctgcagatgaaggcctgcgccaccaagcccgaggagctgagcgtgcacaacaacgtgagcacccagagcaacggcagccagcaggcctggggcatgagaagcgccctgcccgtgagccccagcatcagcagcgcccccgtgcccgtggagatcgagaacctgccccagagccccggcaccgaccagcacgacagaaagtgcatccccctgaacatcgacctgctgaacagccccgacctgctggaggccaccatcggcgacgtgatcggcgccagcgacaccatggagaccagccaggccctgaacgacgtgaacgtggccaccagactgcccggcctgggcgagcccgaggtggagtacgagaccctgaaggacaccagcgagaagctgaagcagctggagatggagaacagccccctgctgagccccagaagcaacatcgacgtgaacatcaacagccaggaggaggtggtgaagctgaccgagaagtgcctgaacaacgtgatcgagagccccggcctgaacgtgatgagagtgccccccgacttcaagagcaacatcctgaaggcccaggtggaggccgtgcacaaggtgaccaaggaggacagcctgctgagccacaagaacgccaacgtgcaggacgccgccaccaacagcgccgtgctgaacgagaacaacgtgcccctgcccaaggagagcctggagaccctgatgctgatcacccccgccgacagcggcagcgtgctgaaggaggccaccgacgagctggacgccctgctggccagcctgaccgagaacctgatcgaccacaccgtggccccccaggtgagcagcaccagcatgatcacccccagatggatcgtgcccctgtggagccacttcggcagaagaagctgccccgaggccgaggtgttcaccgaccactag

SEQ ID NO: 80609 - DNA, 2199 bp, Artificial Sequence
  Description of Artificial Sequence: Synthetic coding sequence
atgctgagcttcttcagaagaaccctgggcagaagaagcatgagaaagcacgccgagaaggagagactgagagaggcccagagagccgccacccacatccccgccgccggcgacagcaagagcatcatcacctgcagagtgagcctgctggacggcaccgacgtgagcgtggacctgcccaagaaggccaagggccaggagctgttcgaccagatcatgtaccacctggacctgatcgagagcgactacttcggcctgagattcatggacagcgcccaggtggcccactggctggacggcaccaagagcatcaagaagcaggtgaagatcggcagcccctactgcctgcacctgagagtgaagttctacagcagcgagcccaacaacctgagagaggagctgaccagatacctgttcgtgctgcagctgaagcaggacatcctgagcggcaagctggactgccccttcgacaccgccgtgcagctggccgcctacaacctgcaggccgagctgggcgactacgacctggccgagcacagccccgagctggtgagcgagttcagattcgtgcccatccagaccgaggagatggagctggccatcttcgagaagtggaaggagtacagaggccagacccccgcccaggccgagaccaactacctgaacaaggccaagtggctggagatgtacggcgtggacatgcacgtggtgaaggccagagacggcaacgactacagcctgggcctgacccccaccggcgtgctggtgttcgagggcgacaccaagatcggcctgttcttctggcccaagatcaccagactggacttcaagaagaacaagctgaccctggtggtggtggaggacgacgaccagggcaaggagcaggagcacaccttcgtgttcagactggaccaccccaaggcctgcaagcacctgtggaagtgcgccgtggagcaccacgccttcttcagactgagaggccccgtgcagaagagcagccacagaagcggcttcatcagactgggcagcagattcagatacagcggcaagaccgagtaccagaccaccaagaccaacaaggccagaagaagcaccagcttcgagagaagacccagcaagagatacagcagaagaaccctgcagatgaaggcctgcgccaccaagcccgaggagctgagcgtgcacaacaacgtgagcacccagagcaacggcagccagcaggcctggggcatgagaagcgccctgcccgtgagccccagcatcagcagcgcccccgtgcccgtggagatcgagaacctgccccagagccccggcaccgaccagcacgacagaaagtgcatccccctgaacatcgacctgctgaacagccccgacctgctggaggccaccatcggcgacgtgatcggcgccagcgacaccatggagaccagccaggccctgaacgacgtgaacgtggccaccagactgcccggcctgggcgagcccgaggtggagtacgagaccctgaaggacaccagcgagaagctgaagcagctggagatggagaacagccccctgctgagccccagaagcaacatcgacgtgaacatcaacagccaggaggaggtggtgaagctgaccgagaagtgcctgaacaacgtgatcgagagccccggcctgaacgtgatgagagtgccccccgacttcaagagcaacatcctgaaggcccaggtggaggccgtgcacaaggtgaccaaggaggacagcctgctgagccacaagaacgccaacgtgcaggacgccgccaccaacagcgccgtgctgaacgagaacaacgtgcccctgcccaaggagagcctggagaccctgatgctgatcacccccgccgacagcggcagcgtgctgaaggaggccaccgacgagctggacgccctgctggccagcctgaccgagaacctgatcgaccacaccgtggccccccaggtgagcagcaccagcatgatcacccccagatggatcgtgcccagcggcgccatgagcaacggcctggccggctgcgagatgctgctgaccggcaaggagggccacggcaacaaggacggcatcagcctgatcagcccccccgcccccttcctggtggacgccgtgaccagcagcggccccatcctggccgaggaggccgtgctgaagcagaagtgcctgctgaccaccgagctgtag

SEQ ID NO: 80610 - DNA, 2340 bp, Artificial Sequence
  Description of Artificial Sequence: Synthetic coding sequence
atggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagaagcacggcagaggccaggtgctgttcgacctggtgtgcgagcacctgaacctgctggagaaggactacttcggcctgaccttctgcgacgccgacagccagaagaactggctggaccccagcaaggagatcaagaagcagatcagaagcagcccctggaacttcgccttcaccgtgaagttctacccccccgaccccgcccagctgaccgaggacatcaccagatactacctgtgcctgcagctgagagccgacatcatcaccggcagactgccctgcagcttcgtgacccacgccctgctgggcagctacgccgtgcaggccgagctgggcgactacgacgccgaggagcacgtgggcaactacgtgagcgagctgagattcgcccccaaccagaccagagagctggaggagagaatcatggagctgcacaagacctacagaggcatgacccccggcgaggccgagatccacttcctggagaacgccaagaagctgagcatgtacggcgtggacctgcaccacgccaaggacagcgagggcatcgacatcatgctgggcgtgtgcgccaacggcctgctgatctacagagacagactgagaatcaacagattcgcctggcccaagatcctgaagatcagctacaagagaagcaacttctacatcaagatcagacccggcgagtacgagcagttcgagagcaccatcggcttcaagctgcccaaccacagaagcgccaagagactgtggaaggtgtgcatcgagcaccacaccttcttcagactggtgagccccgagcccccccccaagggcttcctggtgatgggcagcaagttcagatacagcggcagaacccaggcccagaccagacaggccagcgccctgatcgacagacccgcccccttcttcgagagaagcagcagcaagagatacaccatgagcagaagcctggacggcgccgagttcagcagacccgccagcgtgagcgagaaccacgacgccggccccgacggcgacaagagagacgaggacggcgagagcggcggccagagaagcgaggccgaggagggcgaggtgagaacccccaccaagatcaaggagctgaagttcctggacaagcccgaggacgtgctgctgaagcaccaggccagcatcaacgagctgaagagaaccctgaaggagcccaacagcaagctgatccacagagacagagactgggagagagagagaagactgcccagcagccccgccagccccagccccaagggcacccccgagaaggccaacgagagagccggcctgagagagggcagcgaggagaaggtgaagccccccagacccagagcccccgagagcgacaccggcgacgaggaccaggaccaggagagagacaccgtgttcctgaaggacaaccacctggccatcgagagaaagtgcagcagcatcaccgtgagcagcaccagcagcctggaggccgaggtggacttcaccgtgatcggcgactaccacggcagcgccttcgaggacttcagcagaagcctgcccgagctggacagagacaagagcgacagcgacaccgagggcctgctgttcagcagagacctgaacaagggcgcccccagccaggacgacgagagcggcggcatcgaggacagccccgacagaggcgcctgcagcacccccgacatgccccagttcgagcccgtgaagaccgagaccatgaccgtgagcagcctggccatcagaaagaagatcgagcccgaggccgtgctgcagaccagagtgagcgccatggacaacacccaggagaacagcctgaagagcggcaagggcgccgccgccatgatccccggcccccagaccgtggccaccgagatcagaagcctgagccccatcatcggcaaggacgtgctgaccagcacctacggcgccaccgccgagaccctgagcaccagcaccaccacccacgtgaccaagaccgtgaagggcggcttcagcgagaccagaatcgagaagagaatcatcatcaccggcgacgaggacgtggaccaggaccaggccctggccctggccatcaaggaggccaagctgcagcaccccgacatgctggtgaccaaggccgtggtgtacagagagaccgaccccagccccgaggagagagacaagaagccccaggagagctag

SEQ ID NO: 80611 - DNA, 2646 bp, Artificial Sequence
  Description of Artificial Sequence: Synthetic coding sequence
atgaccaccgagaccggccccgacagcgaggtgaagaaggcccaggaggaggccccccagcagcccgaggccgccgccgccgtgaccacccccgtgacccccgccggccacggccaccccgaggccaacagcaacgagaagcaccccagccagcaggacaccagacccgccgagcagagcctggacatggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagaagcacggcagaggccaggtgctgttcgacctggtgtgcgagcacctgaacctgctggagaaggactacttcggcctgaccttctgcgacgccgacagccagaagaactggctggaccccagcaaggagatcaagaagcagatcagaagcagcccctggaacttcgccttcaccgtgaagttctacccccccgaccccgcccagctgaccgaggacatcaccagatactacctgtgcctgcagctgagagccgacatcatcaccggcagactgccctgcagcttcgtgacccacgccctgctgggcagctacgccgtgcaggccgagctgggcgactacgacgccgaggagcacgtgggcaactacgtgagcgagctgagattcgcccccaaccagaccagagagctggaggagagaatcatggagctgcacaagacctacagaggcatgacccccggcgaggccgagatccacttcctggagaacgccaagaagctgagcatgtacggcgtggacctgcaccacgccaaggacagcgagggcatcgacatcatgctgggcgtgtgcgccaacggcctgctgatctacagagacagactgagaatcaacagattcgcctggcccaagatcctgaagatcagctacaagagaagcaacttctacatcaagatcagacccggcgagtacgagcagttcgagagcaccatcggcttcaagctgcccaaccacagaagcgccaagagactgtggaaggtgtgcatcgagcaccacaccttcttcagactggtgagccccgagcccccccccaagggcttcctggtgatgggcagcaagttcagatacagcggcagaacccaggcccagaccagacaggccagcgccctgatcgacagacccgcccccttcttcgagagaagcagcagcaagagatacaccatgagcagaagcctggacggcgccgagttcagcagacccgccagcgtgagcgagaaccacgacgccggccccgacggcgacaagagagacgaggacggcgagagcggcggccagagaagcgaggccgaggagggcgaggtgagaacccccaccaagatcaaggagctgaagcccgagcaggagaccacccccagacacaagcaggagttcctggacaagcccgaggacgtgctgctgaagcaccaggccagcatcaacgagctgaagagaaccctgaaggagcccaacagcaagctgatccacagagacagagactgggagagagagagaagactgcccagcagccccgccagccccagccccaagggcacccccgagaaggccaacgagagagccggcctgagagagggcagcgaggagaaggtgaagccccccagacccagagcccccgagagcgacaccggcgacgaggaccaggaccaggagagagacaccgtgttcctgaaggacaaccacctggccatcgagagaaagtgcagcagcatcaccgtgagcagcaccagcagcctggaggccgaggtggacttcaccgtgatcggcgactaccacggcagcgccttcgaggacttcagcagaagcctgcccgagctggacagagacaagagcgacagcgacaccgagggcctgctgttcagcagagacctgaacaagggcgcccccagccaggacgacgagagcggcggcatcgaggacagccccgacagaggcgcctgcagcacccccgacatgccccagttcgagcccgtgaagaccgagaccatgaccgtgagcagcctggccatcagaaagaagatcgagcccgaggccgtgctgcagaccagagtgagcgccatggacaacacccagcaggtggacggcagcgccagcgtgggcagagagttcatcgccaccacccccagcatcaccaccgagaccatcagcaccaccatggagaacagcctgaagagcggcaagggcgccgccgccatgatccccggcccccagaccgtggccaccgagatcagaagcctgagccccatcatcggcaaggacgtgctgaccagcacctacggcgccaccgccgagaccctgagcaccagcaccaccacccacgtgaccaagaccgtgaagggcggcttcagcgagaccagaatcgagaagagaatcatcatcaccggcgacgaggacgtggaccaggaccaggccctggccctggccatcaaggaggccaagctgcagcaccccgacatgctggtgaccaaggccgtggtgtacagagagaccgaccccagccccgaggagagagacaagaagccccaggagagctag

SEQ ID NO: 80612 - DNA, 2877 bp, Artificial Sequence
  Description of Artificial Sequence: Synthetic coding sequence
atgagcagaagcctggacggcgccgagttcagcagacccgccagcgtgagcgagaaccacgacgccggccccgacggcgacaagagagacgaggacggcgagagcggcggccagagaagcgaggccgaggagggcgaggtgagaacccccaccaagatcaaggagctgaagcccgagcaggagaccacccccagacacaagcaggagttcctggacaagcccgaggacgtgctgctgaagcaccaggccagcatcaacgagctgaagagaaccctgaaggagcccaacagcaagctgatccacagagacagagactgggagagagagagaagactgcccagcagccccgccagccccagccccaagggcacccccgagaaggccaacgagagccagagaacccaggacatcagccagagagacctggtgcccgagcccggcgccgccgccggcctggaggtgttcacccagaagagcctggccgccagccccgagggcagcgagcactgggtgttcatcgagagagagtacaccagacccgaggagctgggcctgctgaaggtgaccaccatgcagcaggaggagagacaggccggcctggccggcatcctggccaacggcagactgagcaaggtggacgtgctggtggacaagttcaaggtggaggtggccaccgaggagatggtgggcaacagaagagccaacacccagcagcagggcaagatgatcgccagccccgaggacttcgagagcgtgggcgaggagggcccctggatcagagagagccccggcggcgccgccctggccagcggcagaaccctggccgagaagctgctggagggcagcgagctgagagccgacaccagagaggccaccatcagaaacagatgcatgagcgacggccagcccgagggccagaccgagctgagaaagggcctggaggagccccacacctgcggcagacccaccgcccccggcaccagacccgccgaggtggacgtgctgagccccgccagcgacaagggcggcctgcagagcttcctgctggaccccgcccacgccgaggccagagccgagctgagcaacgagaccgacaccagcttcgccgagagaagcttctacctgaactacgaggagaaggacagcgaggaccaggtgctgcccccccccctggaggagagaaagggcagactggacgccccccccggcggcgagcccagacccaccctgaacagcctggacctgagagtgagcgccgccgccagcagcagaagcaaggacgaggcccacatgaccagccccaaggagggcgccggcacccccaagaaccacggcggccccggcgacctgaagggcagccccgccggccagaccttcgccgagggctgggaggacgcccagtggggcgtggagggcgagttcccccacctgaccgccagcgccgccagagaggagggcacccccgtgagcggcgacctgctgggcaaggccgaggagagccccaccgaggagctgaagaagcaccccccccacagaggccagggcgtgcaccccgacccccaggcctgcgccctgcccagagccatccccctgaacgtgagaaagcccgtgaagcccgacagaggcaacttcccccccaaggagagaggcgtggtgcccacccagaagggcggcgccgagctgaaggacagagaggccagcgccttcctgcacatggaggtgatcatccccctgcccgccagccccggccacagcgaggacctggccgccctggaggaggccagccccagccccaccagccacggcagcggcgagcccagcgagctgagagagcccttcctgagacacgtgcacctgagcaaggccagccccgagcccaaggaccaggtgggcttcgtggtgagccccgccaccggcggcgagagaagacccccccccatcaccagcagaaagcccagagtggtgcccgaggaggccgagggcagaatccccctgggcttcggcttccccagcggcaagagaagagagatgaccagcttccaggccggcgaccaggagggcagcctggaggacatcagcaagaccagcgtggccaacaagatcagaatcttcgagacccacggcgccgagaccagaagaatgagcgagggcgaggccagaagcctgcccaacgacgtgagcagcgaggcccccgtgggccaggccgagcagcagagaagcaccctgagcgacctgggcttcgcccagctgcagccccccggcgacttcgccagccccaaggccacccacagcaccgtgatccccctggccaccagacacttcagagaggacaccagcgccagctaccaggaggcccacaccgagctggagcccgtgagccccaacagcggctgcgagaccaccctggccgaggccaccggcaccggcaacaagagcggcgacgccgtgagagaggagaagagaagcaccaacctggccgccaacacccccggcaagggcggcagactgagattcgccagccccagcggcccccagagagccggcctgagagagggcagcgaggagaaggtgaagccccccagacccagagcccccgagagcgacaccggcgacgaggaccaggaccaggagagagacaccgtgttcctgaaggacaaccacctggccatcgagagaaagtgcagcagcatcaccgtgagcagcaccagcagcctggaggccgaggtggacttcaccgtgatcggcgactaccacggcagcgccttcgaggacttcagcagaagcctgcccgagctggacagagacaagagcgacagcgacaccgagggcctgctgttcagcagagacctgaacaagggcgcccccagccaggactag

SEQ ID NO: 80613 - DNA, 2643 bp, Artificial Sequence
  Description of Artificial Sequence: Synthetic coding sequence
atgaccaccgagaccggccccgacagcgaggtgaagaaggcccaggaggaggccccccagcagcccgaggccgccgccgccgtgaccacccccgtgacccccgccggccacggccaccccgaggccaacagcaacgagaagcaccccagccagcaggacaccagacccgccgagcagagcctggacatggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagaagcacggcagaggccaggtgctgttcgacctggtgtgcgagcacctgaacctgctggagaaggactacttcggcctgaccttctgcgacgccgacagccagaagaactggctggaccccagcaaggagatcaagaagcagatcagaagcagcccctggaacttcgccttcaccgtgaagttctacccccccgaccccgcccagctgaccgaggacatcaccagatactacctgtgcctgcagctgagagccgacatcatcaccggcagactgccctgcagcttcgtgacccacgccctgctgggcagctacgccgtgcaggccgagctgggcgactacgacgccgaggagcacgtgggcaactacgtgagcgagctgagattcgcccccaaccagaccagagagctggaggagagaatcatggagctgcacaagacctacagaggcatgacccccggcgaggccgagatccacttcctggagaacgccaagaagctgagcatgtacggcgtggacctgcaccacgccaaggacagcgagggcatcgacatcatgctgggcgtgtgcgccaacggcctgctgatctacagagacagactgagaatcaacagattcgcctggcccaagatcctgaagatcagctacaagagaagcaacttctacatcaagatcagacccggcgagtacgagcagttcgagagcaccatcggcttcaagctgcccaaccacagaagcgccaagagactgtggaaggtgtgcatcgagcaccacaccttcttcagactggtgagccccgagcccccccccaagggcttcctggtgatgggcagcaagttcagatacagcggcagaacccaggcccagaccagacaggccagcgccctgatcgacagacccgcccccttcttcgagagaagcagcagcaagagatacaccatgagcagaagcctggacggcgccgagttcagcagacccgccagcgtgagcgagaaccacgacgccggccccgacggcgacaagagagacgaggacggcgagagcggcggccagagaagcgaggccgaggagggcgaggtgagaacccccaccaagatcaaggagctgaagcccgagcaggagaccacccccagacacaagcaggagttcctggacaagcccgaggacgtgctgctgaagcaccaggccagcatcaacgagctgaagagaaccctgaaggagcccaacagcaagctgatccacagagacagagactgggagagagagagaagactgcccagcagccccgccagccccagccccaagggcacccccgagaaggccaacgagagagccggcctgagagagggcagcgaggagaaggtgaagccccccagacccagagcccccgagagcgacaccggcgacgaggaccaggaccaggagagagacaccgtgttcctgaaggacaaccacctggccatcgagagaaagtgcagcagcatcaccgtgagcagcaccagcagcctggaggccgaggtggacttcaccgtgatcggcgactaccacggcagcgccttcgaggacttcagcagaagcctgcccgagctggacagagacaagagcgacagcgacaccgagggcctgctgttcagcagagacctgaacaagggcgcccccagccaggacgacgagagcggcggcatcgaggacagccccgacagaggcgcctgcagcacccccgacatgccccagttcgagcccgtgaagaccgagaccatgaccgtgagcagcctggccatcagaaagaagatcgagcccgaggccgtgctgcagaccagagtgagcgccatggacaacacccaggtggacggcagcgccagcgtgggcagagagttcatcgccaccacccccagcatcaccaccgagaccatcagcaccaccatggagaacagcctgaagagcggcaagggcgccgccgccatgatccccggcccccagaccgtggccaccgagatcagaagcctgagccccatcatcggcaaggacgtgctgaccagcacctacggcgccaccgccgagaccctgagcaccagcaccaccacccacgtgaccaagaccgtgaagggcggcttcagcgagaccagaatcgagaagagaatcatcatcaccggcgacgaggacgtggaccaggaccaggccctggccctggccatcaaggaggccaagctgcagcaccccgacatgctggtgaccaaggccgtggtgtacagagagaccgaccccagccccgaggagagagacaagaagccccaggagagctag

SEQ ID NO: 80614 - DNA, 600 bp, Artificial Sequence
  Description of Artificial Sequence: Synthetic coding sequence
atggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagaagcacggcagaggccaggtgctgttcgacctggtgtgcgagcacctgaacctgctggagaaggactacttcggcctgaccttctgcgacgccgacagccagaagaactggctggaccccagcaaggagatcaagaagcagatcagaagcagcccctggaacttcgccttcaccgtgaagttctacccccccgaccccgcccagctgaccgaggacatcaccagatactacctgtgcctgcagctgagagccgacatcatcaccggcagactgccctgcagcttcgtgacccacgccctgctgggcagctacgccgtgcaggccgagctgggcgactacgacgccgaggagcacgtgggcaactacgtgagcgagctgagattcgcccccaaccagaccagagagctggaggagagaatcatggagctgcacaagacctactag

SEQ ID NO: 80615 - DNA, 2106 bp, Artificial Sequence
  Description of Artificial Sequence: Synthetic coding sequence
atggtgttcctgggcagaatcaacgaggtggagcccgccaagggcctggccgagagcctggcccccaccgagagaagcgtgaagagcctggacatggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagaagcacggcagaggccaggtgctgttcgacctggtgtgcgagcacctgaacctgctggagaaggactacttcggcctgaccttctgcgacgccgacagccagaagaactggctggaccccagcaaggagatcaagaagcagatcagaagcagcccctggaacttcgccttcaccgtgaagttctacccccccgaccccgcccagctgaccgaggacatcaccagatactacctgtgcctgcagctgagagccgacatcatcaccggcagactgccctgcagcttcgtgacccacgccctgctgggcagctacgccgtgcaggccgagctgggcgactacgacgccgaggagcacgtgggcaactacgtgagcgagctgagattcgcccccaaccagaccagagagctggaggagagaatcatggagctgcacaagacctacagaggcatgacccccggcgaggccgagatccacttcctggagaacgccaagaagctgagcatgtacggcgtggacctgcaccacgccaaggacagcgagggcatcgacatcatgctgggcgtgtgcgccaacggcctgctgatctacagagacagactgagaatcaacagattcgcctggcccaagatcctgaagatcagctacaagagaagcaacttctacatcaagatcagacccggcgagtacgagcagttcgagagcaccatcggcttcaagctgcccaaccacagaagcgccaagagactgtggaaggtgtgcatcgagcaccacaccttcttcagactggtgagccccgagcccccccccaagggcttcctggtgatgggcagcaagttcagatacagcggcagaacccaggcccagaccagacaggccagcgccctgatcgacagacccgcccccttcttcgagagaagcagcagcaagagatacaccatgagcagaagcctggacggcgccgagttcagcagacccgccagcgtgagcgagaaccacgacgccggccccgacggcgacaagagagacgaggacggcgagagcggcggccagagaagcgaggccgaggagggcgaggtgagaacccccaccaagatcaaggagctgaagttcctggacaagcccgaggacgtgctgctgaagcaccaggccagcatcaacgagctgaagagaaccctgaaggagcccaacagcaagctgatccacagagacagagactgggagagagagagaagactgcccagcagccccgccagccccagccccaagggcacccccgagaaggccaacgagcccgtgaagaccgagaccatgaccgtgagcagcctggccatcagaaagaagatcgagcccgaggccgtgctgcagaccagagtgagcgccatggacaacacccagcaggtggacggcagcgccagcgtgggcagagagttcatcgccaccacccccagcatcaccaccgagaccatcagcaccaccatggagaacagcctgaagagcggcaagggcgccgccgccatgatccccggcccccagaccgtggccaccgagatcagaagcctgagccccatcatcggcaaggacgtgctgaccagcacctacggcgccaccgccgagaccctgagcaccagcaccaccacccacgtgaccaagaccgtgaagggcggcttcagcgagaccagaatcgagaagagaatcatcatcaccggcgacgaggacgtggaccaggaccaggccctggccctggccatcaaggaggccaagctgcagcaccccgacatgctggtgaccaaggccgtggtgtacagagagaccgaccccagccccgaggagagagacaagaagccccaggagagctag

SEQ ID NO: 80616 - DNA, 2319 bp, Artificial Sequence
  Description of Artificial Sequence: Synthetic coding sequence
atggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagaactggctggaccccagcaaggagatcaagaagcagatcagaagcagcccctggaacttcgccttcaccgtgaagttctacccccccgaccccgcccagctgaccgaggacatcaccagatactacctgtgcctgcagctgagagccgacatcatcaccggcagactgccctgcagcttcgtgacccacgccctgctgggcagctacgccgtgcaggccgagctgggcgactacgacgccgaggagcacgtgggcaactacgtgagcgagctgagattcgcccccaaccagaccagagagctggaggagagaatcatggagctgcacaagacctacagaggcatgacccccggcgaggccgagatccacttcctggagaacgccaagaagctgagcatgtacggcgtggacctgcaccacgccaaggacagcgagggcatcgacatcatgctgggcgtgtgcgccaacggcctgctgatctacagagacagactgagaatcaacagattcgcctggcccaagatcctgaagatcagctacaagagaagcaacttctacatcaagatcagacccggcgagtacgagcagttcgagagcaccatcggcttcaagctgcccaaccacagaagcgccaagagactgtggaaggtgtgcatcgagcaccacaccttcttcagactggtgagccccgagcccccccccaagggcttcctggtgatgggcagcaagttcagatacagcggcagaacccaggcccagaccagacaggccagcgccctgatcgacagacccgcccccttcttcgagagaagcagcagcaagagatacaccatgagcagaagcctggacggcgccgagttcagcagacccgccagcgtgagcgagaaccacgacgccggccccgacggcgacaagagagacgaggacggcgagagcggcggccagagaagcgaggccgaggagggcgaggtgagaacccccaccaagatcaaggagctgaagttcctggacaagcccgaggacgtgctgctgaagcaccaggccagcatcaacgagctgaagagaaccctgaaggagcccaacagcaagctgatccacagagacagagactgggagagagagagaagactgcccagcagccccgccagccccagccccaagggcacccccgagaaggccaacgagagagccggcctgagagagggcagcgaggagaaggtgaagccccccagacccagagcccccgagagcgacaccggcgacgaggaccaggaccaggagagagacaccgtgttcctgaaggacaaccacctggccatcgagagaaagtgcagcagcatcaccgtgagcagcaccagcagcctggaggccgaggtggacttcaccgtgatcggcgactaccacggcagcgccttcgaggacttcagcagaagcctgcccgagctggacagagacaagagcgacagcgacaccgagggcctgctgttcagcagagacctgaacaagggcgcccccagccaggacgacgagagcggcggcatcgaggacagccccgacagaggcgcctgcagcacccccgacatgccccagttcgagcccgtgaagaccgagaccatgaccgtgagcagcctggccatcagaaagaagatcgagcccgaggccgtgctgcagaccagagtgagcgccatggacaacacccagcaggtggacggcagcgccagcgtgggcagagagttcatcgccaccacccccagcatcaccaccgagaccatcagcaccaccatggagaacagcctgaagagcggcaagggcgccgccgccatgatccccggcccccagaccgtggccaccgagatcagaagcctgagccccatcatcggcaaggacgtgctgaccagcacctacggcgccaccgccgagaccctgagcaccagcaccaccacccacgtgaccaagaccgtgaagggcggcttcagcgagaccagaatcgagaagagaatcatcatcaccggcgacgaggacgtggaccaggaccaggccctggccctggccatcaaggaggccaagctgcagcaccccgacatgctggtgaccaaggccgtggtgtacagagagaccgaccccagccccgaggagagagacaagaagccccaggagagctag

SEQ ID NO: 80617 - DNA, 2319 bp, Artificial Sequence; identical to SEQ ID NO: 80616
  Description of Artificial Sequence: Synthetic coding sequence

SEQ ID NO: 80618 - DNA, 600 bp, Artificial Sequence; identical to SEQ ID NO: 80614
  Description of Artificial Sequence: Synthetic coding sequence

SEQ ID NO: 80619 - DNA, 2385 bp, Artificial Sequence
  Description of Artificial Sequence: Synthetic coding sequence
atgaccaccgagaccggccccgacagcgaggtgaagaaggcccaggaggaggccccccagcagcccgaggccgccgccgccgtgaccacccccgtgacccccgccggccacggccaccccgaggccaacagcaacgagaagcaccccagccagcaggacaccagacccgccgagcagagcctggacatggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagaagcacggcagaggccaggtgctgttcgacctggtgtgcgagcacctgaacctgctggagaaggactacttcggcctgaccttctgcgacgccgacagccagaagaactggctggaccccagcaaggagatcaagaagcagatcagaagcagcccctggaacttcgccttcaccgtgaagttctacccccccgaccccgcccagctgaccgaggacatcaccagatactacctgtgcctgcagctgagagccgacatcatcaccggcagactgccctgcagcttcgtgacccacgccctgctgggcagctacgccgtgcaggccgagctgggcgactacgacgccgaggagcacgtgggcaactacgtgagcgagctgagattcgcccccaaccagaccagagagctggaggagagaatcatggagctgcacaagacctacagaggcatgacccccggcgaggccgagatccacttcctggagaacgccaagaagctgagcatgtacggcgtggacctgcaccacgccaaggacagcgagggcatcgacatcatgctgggcgtgtgcgccaacggcctgctgatctacagagacagactgagaatcaacagattcgcctggcccaagatcctgaagatcagctacaagagaagcaacttctacatcaagatcagacccggcgagtacgagcagttcgagagcaccatcggcttcaagctgcccaaccacagaagcgccaagagactgtggaaggtgtgcatcgagcaccacaccttcttcagactggtgagccccgagcccccccccaagggcttcctggtgatgggcagcaagttcagatacagcggcagaacccaggcccagaccagacaggccagcgccctgatcgacagacccgcccccttcttcgagagaagcagcagcaagagatacaccatgagcagaagcctggacggcgccgagttcagcagacccgccagcgtgagcgagaaccacgacgccggccccgacggcgacaagagagacgaggacggcgagagcggcggccagagaagcgaggccgaggagggcgaggtgagaacccccaccaagatcaaggagctgaagcccgagcaggagaccacccccagacacaagcaggagttcctggacaagcccgaggacgtgctgctgaagcaccaggccagcatcaacgagctgaagagaaccctgaaggagcccaacagcaagctgatccacagagacagagactgggagagagagagaagactgcccagcagccccgccagccccagccccaagggcacccccgagaaggccaacgagagagccggcctgagagagggcagcgaggagaaggtgaagccccccagacccagagcccccgagagcgacaccggcgacgaggaccaggaccaggagagagacaccgtgttcctgaaggacaaccacctggccatcgagagaaagtgcagcagcatcaccgtgagcagcaccagcagcctggaggccgaggtggacttcaccgtgatcggcgactaccacggcagcgccttcgaggacttcagcagaagcctgcccgagctggacagagacaagagcgacagcgacaccgagggcctgctgttcagcagagacctgaacaagggcgcccccagccaggacgacgagagcggcggcatcgaggacagccccgacagaggcgcctgcagcacccccgacatgccccagttcgagcccgtgaagaccgagaccatgaccgtgagcagcctggccatcagaaagaagatcgagcccgaggccgtgctgcagaccagagtgagcgccatggacaacacccaggagaacagcctgaagagcggcaagggcgccgccgccatgatccccggcccccagaccgtggccaccgagatcagaagcctgagccccagcgccgaccacagagagagatgcccccaccagcacctgagaagacactgcggcaaccccctgaacctgcaccaccacccctgccaccagaactgcgagagaagagtgttctag

SEQ ID NO: 80620 - DNA, 507 bp, Artificial Sequence
  Description of Artificial Sequence: Synthetic coding sequence
atgaccaccgagaccggccccgacagcgaggtgaagaaggcccaggaggaggccccccagcagcccgaggccgccgccgccgtgaccacccccgtgacccccgccggccacggccaccccgaggccaacagcaacgagaagcaccccagccagcaggacaccagacccgccgagcagagcctggacatggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagaagcacggcagaggccaggtgctgttcgacctggtgtgcgagcacctgaacctgctggagaaggactacttcggcctgaccttctgcgacgccgacagccagaagaactggctggaccccagcaaggagatcaagaagcagatcagaagcagcccctggaactag

SEQ ID NO: 80621 - DNA, 180 bp, Artificial Sequence
  Description of Artificial Sequence: Synthetic coding sequence
atgaccaccgagaccggccccgacagcgaggtgaagaaggcccaggaggaggccccccagcagcccgaggccgccgccgccgtgaccacccccgtgacccccgccggccacggccaccccgaggccaacagcaacgagaagcaccccagccagcaggacaccagacccgccgagcagtag

SEQ ID NO: 80622 - DNA, 774 bp, Artificial Sequence
  Description of Artificial Sequence: Synthetic coding sequence
atggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagaagcacggcagaggccaggtgctgttcgacctggtgtgcgagcacctgaacctgctggagaaggactacttcggcctgaccttctgcgacgccgacagccagaagaactggctggaccccagcaaggagatcaagaagcagatcagaagcagcccctggaacttcgccttcaccgtgaagttctacccccccgaccccgcccagctgaccgaggacatcaccagatactacctgtgcctgcagctgagagccgacatcatcaccggcagactgccctgcagcttcgtgacccacgccctgctgggcagctacgccgtgcaggccgagctgggcgactacgacgccgaggagcacgtgggcaactacgtgagcgagctgagattcgcccccaaccagaccagagagctggaggagagaatcatggagctgcacaagacctacagaggcatgacccccggcgaggccgagatccacttcctggagaacgccaagaagctgagcatgtacggcgtggacctgcaccacgccaaggacagcgagggcatcgacatcatgctgggcgtgtgcgccaacggcctgctgatctacagagacagactgagaatcaacagattctag

SEQ ID NO: 80623 - DNA, 114 bp, Artificial Sequence
  Description of Artificial Sequence: Synthetic coding sequence
atggaggagaaggactacagcgaggccgacggcctgagcgagagaaccacccccagcaaggcccagaagagcccccagaagatcgccaagaagtacaagagcgccatctgctag

SEQ ID NO: 80624 - DNA, 360 bp, Artificial Sequence
  Description of Artificial Sequence: Synthetic coding sequence
tgaagcgtgggcagagagttcatcgccaccacccccagcatcaccaccgagaccatcagcaccaccatgatcatcggcaaggacgtgctgaccagcacctacggcgccaccgccgagaccctgagcaccagcaccaccacccacgtgaccaagaccgtgaagggcggcttcagcgagaccagaatcgagaagagaatcatcatcaccggcgacgaggacgtggaccaggaccaggccctggccctggccatcaaggaggccaagctgcagcaccccgacatgctggtgaccaaggccgtggtgtacagagagaccgaccccagccccgaggagagagacaagaagccccaggagagctag

SEQ ID NO: 80625 - DNA, 2340 bp, Artificial Sequence; identical to SEQ ID NO: 80610
  Description of Artificial Sequence: Synthetic coding sequence

SEQ ID NO: 80626 - DNA, 345 bp, Artificial Sequence
  Description of Artificial Sequence: Synthetic coding sequence
atgaccaccgagaccggccccgacagcgaggtgaagaaggcccaggaggaggccccccagcagcccgaggccgccgccgccgtgaccacccccgtgacccccgccggccacggccaccccgaggccaacagcaacgagaagcaccccagccagcaggacaccagacccgccgagcagagcctggacatggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagtag

SEQ ID NO: 80627 - DNA, 567 bp, Artificial Sequence
  Description of Artificial Sequence: Synthetic coding sequence
atgaccaccgagaccggccccgacagcgaggtgaagaaggcccaggaggaggccccccagcagcccgaggccgccgccgccgtgaccacccccgtgacccccgccggccacggccaccccgaggccaacagcaacgagaagcaccccagccagcaggacaccagacccgccgagcagagcctggacatggaggagaaggactacagcgaggccgacggcctgagcgagagaaccacccccagcaaggcccagaagagcccccagaagatcgccaagaagtacaagagcgccatctgcagagtgaccctgctggacgccagcgagtacgagtgcgaggtggagaagcacggcagaggccaggtgctgttcgacctggtgtgcgagcacctgaacctgctggagaaggactacttcggcctgaccttctgcgacgccgacagccagaagaactggctggaccccagcaaggagatcaagaagcagatcagaagcagcccctggaacttcgccttcaccgtgaagttctacccccccgaccccgcccagctgaccgaggacatcacctag

SEQ ID NO: 80628 - DNA, 705 bp, Artificial Sequence
  Description of Artificial Sequence: Synthetic coding sequence
atggagagcacccccgagcccagacccaacgagtgggagaagagaagaatcacccccctgagcctgcagacccagggcagaaagggcgaccacctgttcaaggacatcctgagcgtgaaggagaagtacctgatgcccaccatctggaccgtggaggagaaggcccaggagaccgacaagaccagagcccccgagagcgagggcccctgcaccggcgccagagacgccgtgaagagcagccacgagaccctgaacatcgtggaggagaagaagagagccgaggtgggcaaggacgagagagtgatcaccgaggagatgaacggcaaggagatcagccccggcagcggccccggcgagatcagaaaggtggagcccgtgacccagaaggacagcaccagcctgagcagcgagagcagcagcagcagcagcgagagcgaggaggaggacgtgggcgagtacagaccccaccacagagtgaccgagggcaccatcagagaggagcaggagtacgaggaggaggtggaggaggagcccagacccgccgccaaggtggtggagagagaggaggccgtgcccgaggccagccccgtgacccaggccggcgccagcgtgatcaccgtggagaccgtgatccaggagaacgtgggcgcccagaagatccccggcgagaagagcgtgcacgagggcgccctgaagcaggactag

SEQ ID NO: 80629 - DNA, 3018 bp, Artificial Sequence
  Description of Artificial Sequence: Synthetic coding sequence
atgaccaccgaggtgggcagcgtgagcgaggtgaagaaggacagcagccagctgggcaccgacgccaccaaggagaagcccaaggaggtggccgagaaccagcagaaccagagcagcgaccccgaggaggagaagggcagccagcccccccccgccgccgagagccagagcagcctgagaagacagaagagagagaaggagaccagcgagagcagaggcatcagcagattcatccccccctggctgaagaagcagaagagctacaccctggtggtggccaaggacggcggcgacaagaaggagcccacccaggccgtggtggaggagcaggtgctggacaaggaggagcccctgcccgaggagcagagacaggccaagggcgacgccgaggagatggcccagaagaagcaggagatcaaggtggaggtgaaggaggagaagcccagcgtgagcaaggaggagaagcccagcgtgagcaaggtggagatgcagcccaccgagctggtgagcaaggagagagaggagaaggtgaaggagacccaggaggacaagctggagggcggcgccgccaagagagagaccaaggaggtgcagaccaacgagctgaaggccgagaaggccagccagaaggtgaccaagaagaccaagaccgtgcagtgcaaggtgaccctgctggacggcaccgagtacagctgcgacctggagaagcacgccaagggccaggtgctgttcgacaaggtgtgcgagcacctgaacctgctggagaaggactacttcggcctgctgttccaggagagccccgagcagaagaactggctggaccccgccaaggagatcaagagacagctgagaaacctgccctggctgttcaccttcaacgtgaagttctacccccccgaccccagccagctgaccgaggacatcaccagatacttcctgtgcctgcagctgagacaggacatcgccagcggcagactgccctgcagcttcgtgacccacgccctgctgggcagctacaccctgcaggccgagctgggcgactacgaccccgaggagcacggcagcatcgacctgagcgagttccagttcgcccccacccagaccaaggagctggaggagaaggtggccgagctgcacaagacccacagaggcctgagccccgcccaggccgacagccagttcctggagaacgccaagagactgagcatgtacggcgtggacctgcaccacgccaaggacagcgagggcgtggacatcaagctgggcgtgtgcgccaacggcctgctgatctacaaggacagactgagaatcaacagattcgcctggcccaagatcctgaagatcagctacaagagaagcaacttctacatcaaggtgagacccgccgagctggagcagttcgagagcaccatcggcttcaagctgcccaaccacagagccgccaagagactgtggaaggtgtgcgtggagcaccacaccttctacagactggtgagccccgagcagccccccaaggccaagttcctgaccctgggcagcaagttcagatacagcggcagaacccaggcccagaccagacaggccagcaccctgatcgacagacccgccccccacttcgagagaaccagcagcaagagagtgagcagaagcctggacggcgcccccatcggcgtgatggaccagagcctgatgaaggacttccccggcgccgccggcgagatcagcgcctacggccccggcctggtgagcatcgccgtggtgcaggacggcgacggcagaagagaggtgagaagccccaccaaggccccccacctgcagctgatcgagggcaagaagaacagcctgagagtggagggcgacaacatctacgtgagacacagcaacctgatgctggaggagctggacaaggcccaggaggacatcctgaagcaccaggccagcatcagcgagctgaagagaaacttcatggagagcacccccgagcccagacccaacgagtgggagaagagaagaatcacccccctgagcctgcagacccagggcagcagccacgagaccctgaacatcgtggaggagaagaagagagccgaggtgggcaaggacgagagagtgatcaccgaggagatgaacggcaaggagatcagccccggcagcggccccggcgagatcagaaaggtggagcccgtgacccagaaggacagcaccagcctgagcagcgagagcagcagcagcagcagcgagagcgaggaggaggacgtgggcgagtacagaccccaccacagagtgaccgagggcaccatcagagaggagcaggagtacgaggaggaggtggaggaggagcccagacccgccgccaaggtggtggagagagaggaggccgtgcccgaggccagccccgtgacccaggccggcgccagcgtgatcaccgtggagaccgtgatccaggagaacgtgggcgcccagaagatccccggcgagaagagcgtgcacgagggcgccctgaagcaggacatgggcgaggaggccgaggaggagccccagaaggtgaacggcgaggtgagccacgtggacatcgacgtgctgccccagatcatctgctgcagcgagccccccgtggtgaagaccgagatggtgaccatcagcgacgccagccagagaaccgagatcagcaccaaggaggtgcccatcgtgcagaccgagaccaagaccatcacctacgagagcccccagatcgacggcggcgccggcggcgacagcggcaccctgctgaccgcccagaccatcaccagcgagagcgtgagcaccaccaccaccacccacatcaccaagaccgtgaagggcggcatcagcgagaccagaatcgagaagagaatcgtgatcaccggcgacggcgacatcgaccacgaccaggccctggcccaggccatcagagaggccagagagcagcaccccgacatgagcgtgaccagagtggtggtgcacaaggagaccgagctggccgaggagggcgaggactag

SEQ ID NO: 80630 - DNA, 3018 bp, Artificial Sequence; identical to SEQ ID NO: 80629
  Description of Artificial Sequence: Synthetic coding sequence

SEQ ID NO: 80631 - DNA, 2022 bp, Artificial Sequence
  Description of Artificial Sequence: Synthetic coding sequence
atgaccaccgaggtgggcagcgtgagcgaggtgaagaaggacagcagccagctgggcaccgacgccaccaaggagaagcccaaggaggtggccgagaaccagcagaaccagagcagcgaccccgaggaggagaagggcagccagcccccccccgccgccgagagccagagcagcctgagaagacagaagagagagaaggagaccagcgagagcagaggcatcagcagattcatccccccctggctgaagaagcagaagagctacaccctggtggtggccaaggacggcggcgacaagaaggagcccacccaggccgtggtggaggagcaggtgctggacaaggaggagcccctgcccgaggagcagagacaggccaagggcgacgccgaggagatggcccagaagaagcaggagatcaaggtggaggtgaaggaggagaagcccagcgtgagcaaggaggagaagcccagcgtgagcaaggtggagatgcagcccaccgagctggtgagcaaggagagagaggagaaggtgaaggagacccaggaggacaagctggagggcggcgccgccaagagagagaccaaggaggtgcagaccaacgagctgaaggccgagaaggccagccagaaggtgaccaagaagaccaagaccgtgcagtgcaaggtgaccctgctggacggcaccgagtacagctgcgacctggagaagcacgccaagggccaggtgctgttcgacaaggtgtgcgagcacctgaacctgctggagaaggactacttcggcctgctgttccaggagagccccgagcagaagaactggctggaccccgccaaggagatcaagagacagctgagaaacctgccctggctgttcaccttcaacgtgaagttctacccccccgaccccagccagctgaccgaggacatcaccagatacttcctgtgcctgcagctgagacaggacatcgccagcggcagactgccctgcagcttcgtgacccacgccctgctgggcagctacaccctgcaggccgagctgggcgactacgaccccgaggagcacggcagcatcgacctgagcgagttccagttcgcccccacccagaccaaggagctggaggagaaggtggccgagctgcacaagacccacagaggcctgagccccgcccaggccgacagccagttcctggagaacgccaagagactgagcatgtacggcgtggacctgcaccacgccaaggacagcgagggcgtggacatcaagctgggcgtgtgcgccaacggcctgctgatctacaaggacagactgagaatcaacagattcgcctggcccaagatcctgaagatcagctacaagagaagcaacttctacatcaaggtgagacccgccgagctggagcagttcgagagcaccatcggcttcaagctgcccaaccacagagccgccaagagactgtggaaggtgtgcgtggagcaccacaccttctacagactggtgagccccgagcagccccccaaggccaagttcctgaccctgggcagcaagttcagatacagcggcagaacccaggcccagaccagacaggccagcaccctgatcgacagacccgccccccacttcgagagaaccagcagcaagagagtgagcagaagcctggacggcgcccccatcggcgtgatggaccagagcctgatgaaggacttccccggcgccgccggcgagatcagcgcctacggccccggcctggtgagcatcgccgtggtgcaggacggcgacggcagaagagaggtgagaagccccaccaaggccccccacctgcagctgatcgagggcaagaccgtgaagggcggcatcagcgagaccagaatcgagaagagaatcgtgatcaccggcgacggcgacatcgaccacgaccaggccctggcccaggccatcagagaggccagagagcagcaccccgacatgagcgtgaccagagtggtggtgcacaaggagaccgagctggccgaggagggcgaggactag

SEQ ID NO: 80632 - DNA, 1902 bp, Artificial Sequence
  Description of Artificial Sequence: Synthetic coding sequence
atgaccaccgaggtgggcagcgtgagcgaggtgaagaaggacagcagccagctgggcaccgacgccaccaaggagaagcccaaggaggtggccgagaaccagcagaaccagagcagcgaccccgaggaggagaagggcagccagcccccccccgccgccgagagccagagcagcctgagaagacagaagagagagaaggagaccagcgagagcagaggcatcagcagattcatccccccctggctgaagaagcagaagagctacaccctggtggtggccaaggacggcggcgacaagaaggagcccacccaggccgtggtggaggagcaggtgctggacaaggaggagcccctgcccgaggagcagagacaggccaagggcgacgccgaggagatggcccagaagaagcaggagatcaaggtggaggtgaaggaggagaagcccagcgtgagcaaggaggagaagcccagcgtgagcaaggtggagatgcagcccaccgagctggtgagcaaggagagagaggagaaggtgaaggagacccaggaggacaagctggagggcggcgccgccaagagagagaccaaggaggtgcagaccaacgagctgaaggccgagaaggccagccagaaggtgaccaagaagaccaagaccgtgcagtgcaaggtgaccctgctggacggcaccgagtacagctgcgacctggagaagcacgccaagggccaggtgctgttcgacaaggtgtgcgagcacctgaacctgctggagaaggactacttcggcctgctgttccaggagagccccgagcagaagaactggctggaccccgccaaggagatcaagagacagctgagaaacctgccctggctgttcaccttcaacgtgaagttctacccccccgaccccagccagctgaccgaggacatcaccagatacttcctgtgcctgcagctgagacaggacatcgccagcggcagactgccctgcagcttcgtgacccacgccctgctgggcagctacaccctgcaggccgagctgggcgactacgaccccgaggagcacggcagcatcgacctgagcgagttccagttcgcccccacccagaccaaggagctggaggagaaggtggccgagctgcacaagacccacagaggcctgagccccgcccaggccgacagccagttcctggagaacgccaagagactgagcatgtacggcgtggacctgcaccacgccaaggacagcgagggcgtggacatcaagctgggcgtgtgcgccaacggcctgctgatctacaaggacagactgagaatcaacagattcgcctggcccaagatcctgaagatcagctacaagagaagcaacttctacatcaaggtgagacccgccgagctggagcagttcgagagcaccatcggcttcaagctgcccaaccacagagccgccaagagactgtggaaggtgtgcgtggagcaccacaccttctacagactggtgagccccgagcagccccccaaggccaagttcctgaccctgggcagcaagttcagatacagcggcagaacccaggcccagaccagacaggccagcaccctgatcgacagacccgccccccacttcgagagaaccagcagcaagagagtgagcagaagcctggacggcgcccccatcggcgtgatggaccagagcctgatgaaggacttccccggcgccgccggcgagatcagcgcctacggccccggcctggtgagcatcgccgtggtgcaggacggcgacggcagaagagaggtgagaagccccaccaaggccccccacctgcagctgatcgagggcaagagcagccacgagaccctgaacatcgtggaggagaagagcggccagagactgggcaagaccaaggagtag

SEQ ID NO: 80633 - DNA, 2244 bp, Artificial Sequence
  Description of Artificial Sequence: Synthetic coding sequence
atgaccaccgaggtgggcagcgtgagcgaggtgaagaaggacagcagccagctgggcaccgacgccaccaaggagaagcccaaggaggtggccgagaaccagcagaaccagagcagcgaccccgaggaggagaagggcagccagcccccccccgccgccgagagccagagcagcctgagaagacagaagagagagaaggagaccagcgagagcagaggcatcagcagattcatccccccctggctgaagaagcagaagagctacaccctggtggtggccaaggacggcggcgacaagaaggagcccacccaggccgtggtggaggagcaggtgctggacaaggaggagcccctgcccgaggagcagagacaggccaagggcgacgccgaggagatggcccagaagaagcaggagatcaaggtggaggtgaaggaggagaagcccagcgtgagcaaggaggagaagcccagcgtgagcaaggtggagatgcagcccaccgagctggtgagcaaggagagagaggagaaggtgaaggagacccaggaggacaagctggagggcggcgccgccaagagagagaccaaggaggtgcagaccaacgagctgaaggccgagaaggccagccagaaggtgaccaagaagaccaagaccgtgcagtgcaaggtgaccctgctggacggcaccgagtacagctgcgacctggagaagcacgccaagggccaggtgctgttcgacaaggtgtgcgagcacctgaacctgctggagaaggactacttcggcctgctgttccaggagagccccgagcagaagaactggctggaccccgccaaggagatcaagagacagctgagaaacctgccctggctgttcaccttcaacgtgaagttctacccccccgaccccagccagctgaccgaggacatcaccagatacttcctgtgcctgcagctgagacaggacatcgccagcggcagactgccctgcagcttcgtgacccacgccctgctgggcagctacaccctgcaggccgagctgggcgactacgaccccgaggagcacggcagcatcgacctgagcgagttccagttcgcccccacccagaccaaggagctggaggagaaggtggccgagctgcacaagacccacagaggcctgagccccgcccaggccgacagccagttcctggagaacgccaagagactgagcatgtacggcgtggacctgcaccacgccaaggacagcgagggcgtggacatcaagctgggcgtgtgcgccaacggcctgctgatctacaaggacagactgagaatcaacagattcgcctggcccaagatcctgaagatcagctacaagagaagcaacttctacatcaaggtgagacccgccgagctggagcagttcgagagcaccatcggcttcaagctgcccaaccacagagccgccaagagactgtggaaggtgtgcgtggagcaccacaccttctacagactggtgagccccgagcagccccccaaggccaagttcctgaccctgggcagcaagttcagatacagcggcagaacccaggcccagaccagacaggccagcaccctgatcgacagacccgccccccacttcgagagaaccagcagcaagagagtgagcagaagcctggacggcgcccccatcggcgtgatggaccagagcctgatgaaggacttccccggcgccgccggcgagatcagcgcctacggccccggcctggtgagcatcgccgtggtgcaggacggcgacggcagaagagaggtgagaagccccaccaaggccccccacctgcagctgatcgagggcaagccccccgtggtgaagaccgagatggtgaccatcagcgacgccagccagagaaccgagatcagcaccaaggaggtgcccatcgtgcagaccgagaccaagaccatcacctacgagagcccccagatcgacggcggcgccggcggcgacagcggcaccctgctgaccgcccagaccatcaccagcgagagcgtgagcaccaccaccaccacccacatcaccaagaccgtgaagggcggcatcagcgagaccagaatcgagaagagaatcgtgatcaccggcgacggcgacatcgaccacgaccaggccctggcccaggccatcagagaggccagagagcagcaccccgacatgagcgtgaccagagtggtggtgcacaaggagaccgagctggccgaggagggcgaggactag

SEQ ID NO: 80634 - DNA, 1143 bp, Artificial Sequence
  Description of Artificial Sequence: Synthetic coding sequence
tgactgggcagcaagttcagatacagcggcagaacccaggcccagaccagacaggccagcaccctgatcgacagacccgccccccacttcgagagaaccagcagcaagagagtgagcagaagcctggacggcgcccccatcggcgtgatggaccagagcctgatgaaggacttccccggcgccgccggcgagatcagcgcctacggccccggcctggtgagcatcgccgtggtgcaggacggcgacggcagaagagaggtgagaagccccaccaaggccccccacctgcagctgatcgagggcaagaagaacagcctgagagtggagggcgacaacatctacgtgagacacagcaacctgatgctggaggagctggacaaggcccaggaggacatcctgaagcaccaggccagcatcagcgagctgaagagaaacttcatggagagcacccccgagcccagacccaacgagtgggagaagagaagaatcacccccctgagcctgcagacccagggcagaaagggcgaccacctgttcaaggacatcctgagcgtgaaggagaagtacctgatgcccaccatctggaccgtggaggagaaggcccaggagaccgacaagaccagagcccccgagagcgagggcccctgcaccggcgccagagacgccgtgaagagcagccacgagaccctgaacatcgtggaggagaagaagagagccgaggtgggcaaggacgagagagtgatcaccgaggagatgaacggcaaggagatcagccccggcagcggccccggcgagatcagaaaggtggagcccgtgacccagaaggacagcaccagcctgagcagcgagagcagcagcagcagcagcgagagcgaggaggaggacgtgggcgagtacagaccccaccacagagtgaccgagggcaccatcagagaggagcaggagtacgaggaggaggtggaggaggagcccagacccgccgccaaggtggtggagagagaggaggccgtgcccgaggccagccccgtgacccaggccggcgccagcgtgatcaccgtggagaccgtgatccaggagaacgtgggcgcccagaagatccccggcgagaagagcgtgcacgagggcgccctgaagcaggactag

SEQ ID NO: 80635 - DNA, 1152 bp, Artificial Sequence
  Description of Artificial Sequence: Synthetic coding sequence
atggaggaggaggagacccagctggaggaggagctggacaaggcccaggaggacatcctgaagcaccaggccagcatcagcgagctgaagagaaacttcatggagagcacccccgagcccagacccaacgagtgggagaagagaagaatcacccccctgagcctgcagacccagggcagcagccacgagaccctgaacatcgtggaggagaagaagagagccgaggtgggcaaggacgagagagtgatcaccgaggagatgaacggcaaggagatcagccccggcagcggccccggcgagatcagaaaggtggagcccgtgacccagaaggacagcaccagcctgagcagcgagagcagcagcagcagcagcgagagcgaggaggaggacgtgggcgagtacagaccccaccacagagtgaccgagggcaccatcagagaggagcaggagtacgaggaggaggtggaggaggagcccagacccgccgccaaggtggtggagagagaggaggccgtgcccgaggccagccccgtgacccaggccggcgccagcgtgatcaccgtggagaccgtgatccaggagaacgtgggcgcccagaagatccccggcgagaagagcgtgcacgagggcgccctgaagcaggacatgggcgaggaggccgaggaggagccccagaaggtgaacggcgaggtgagccacgtggacatcgacgtgctgccccagatcatctgctgcagcgagccccccgtggtgaagaccgagatggtgaccatcagcgacgccagccagagaaccgagatcagcaccaaggaggtgcccatcgtgcagaccgagaccaagaccatcacctacgagagcccccagatcgacggcggcgccggcggcgacagcggcaccctgctgaccgcccagaccatcaccagcgagagcgtgagcaccaccaccaccacccacatcaccaagaccgtgaagggcggcatcagcgagaccagaatcgagaagagaatcgtgatcaccggcgacggcgacatcgaccacgaccaggccctggcccaggccatcagagaggccagagagcagcaccccgacatgagcgtgaccagagtggtggtgcacaaggagaccgagctggccgaggagggcgaggactag

SEQ ID NO: 80636 - DNA, 2022 bp, Artificial Sequence; identical to SEQ ID NO: 80631
  Description of Artificial Sequence: Synthetic coding sequence

SEQ ID NO: 80637 - DNA, 462 bp, Artificial Sequence
  Description of Artificial Sequence: Synthetic coding sequence
atgaccaccgaggtgggcagcgtgagcgaggtgaagaaggacagcagccagctgggcaccgacgccaccaaggagaagcccaaggaggtggccgagaaccagcagaaccagagcagcgaccccgaggaggagaagggcagccagcccccccccgccgccgagagccagagcagcctgagaagacagaagagagagaaggagaccagcgagagcagaggcatcagcagattcatccccccctggctgaagaagcagaagagctacaccctggtggtggccaaggacggcggcgacaagaaggagcccacccaggccgtggtggaggagcaggtgctggacaaggaggagcccctgcccgaggagcagagacaggccaagggcgacgccgaggagatggcccagaagaagcaggagatcaaggtggaggtgaaggaggagaagcccagcgtgagcaaggagtag

SEQ ID NO: 80638 - DNA, 2244 bp, Artificial Sequence; identical to SEQ ID NO: 80633
  Description of Artificial Sequence: Synthetic coding sequence

SEQ ID NO: 80639 - DNA, 540 bp, Artificial Sequence
  Description of Artificial Sequence: Synthetic coding sequence
atgaccaccgaggtgggcagcgtgagcgaggtgaagaaggacagcagccagctgggcaccgacgccaccaaggagaagcccaaggaggtggccgagaaccagcagaaccagagcagcgaccccgaggaggagaagggcagccagcccccccccgccgccgagagccagagcagcctgagaagacagaagagagagaaggagaccagcgagagcagaggcatcagcagattcatccccccctggctgaagaagcagaagagctacaccctggtggtggccaaggacggcggcgacaagaaggagcccacccaggccgtggtggaggagcaggtgctggacaaggaggagcccctgcccgaggagcagagacaggccaagggcgacgccgaggagatggcccagaagaagcaggagatcaaggtggaggtgaaggaggagaagcccagcgtgagcaaggaggagaagcccagcgtgagcaaggtggagatgcagcccaccgagctggtgagcaaggagagagaggagaaggtgaaggagtag

SEQ ID NO: 80640 - DNA, 2559 bp, Artificial Sequence
  Description of Artificial Sequence: Synthetic coding sequence
atgaccaccgaggtgggcagcgtgagcgaggtgaagaaggacagcagccagctgggcaccgacgccaccaaggagaagcccaaggaggtggccgagaaccagcagaaccagagcagcgaccccgaggaggagaagggcagccagcccccccccgccgccgagagccagagcagcctgagaagacagaagagagagaaggagaccagcgagagcagaggcatcagcagattcatccccccctggctgaagaagcagaagagctacaccctggtggtggccaaggacggcggcgacaagaaggagcccacccaggccgtggtggaggagcaggtgctggacaaggaggagcccctgcccgaggagcagagacaggccaagggcgacgccgaggagatggcccagaagaagcaggagatcaaggtggaggtgaaggaggagaagcccagcgtgagcaaggaggagaagcccagcgtgagcaaggtggagatgcagcccaccgagctggtgagcaaggagagagaggagaaggtgaaggagacccaggaggacaagctggagggcggcgccgccaagagagagaccaaggaggtgcagaccaacgagctgaaggccgagaaggccagccagaaggtgaccaagaagaccaagaccgtgcagtgcaaggtgaccctgctggacggcaccgagtacagctgcgacctggagaagcacgccaagggccaggtgctgttcgacaaggtgtgcgagcacctgaacctgctggagaaggactacttcggcctgctgttccaggagagccccgagcagaagaactggctggaccccgccaaggagatcaagagacagctgagaaacctgccctggctgttcaccttcaacgtgaagttctacccccccgaccccagccagctgaccgaggacatcaccagatacttcctgtgcctgcagctgagacaggacatcgccagcggcagactgccctgcagcttcgtgacccacgccctgctgggcagctacaccctgcaggccgagctgggcgactacgaccccgaggagcacggcagcatcgacctgagcgagttccagttcgcccccacccagaccaaggagctggaggagaaggtggccgagctgcacaagacccacagaggcctgagccccgcccaggccgacagccagttcctggagaacgccaagagactgagcatgtacggcgtggacctgcaccacgccaaggacagcgagggcgtggacatcaagctgggcgtgtgcgccaacggcctgctgatctacaaggacagactgagaatcaacagattcgcctggcccaagatcctgaagatcagctacaagagaagcaacttctacatcaaggtgagacccgccgagctggagcagttcgagagcaccatcggcttcaagctgcccaaccacagagccgccaagagactgtggaaggtgtgcgtggagcaccacaccttctacagactggtgagccccgagcagccccccaaggccaagttcctgaccctgggcagcaagttcagatacagcggcagaacccaggcccagaccagacaggccagcaccctgatcgacagacccgccccccacttcgagagaaccagcagcaagagagtgagcagaagcctggacggcgcccccatcggcgtgatggaccagagcctgatgaaggacttccccggcgccgccggcgagatcagcgcctacggccccggcctggtgagcatcgccgtggtgcaggacggcgacggcagaagagaggtgagaagccccaccaaggccccccacctgcagctgatcgagggcaagagcagccacgagaccctgaacatcgtggaggagaagaagagagccgaggtgggcaaggacgagagagtgatcaccgaggagatgaacggcaaggagatcagccccggcagcggccccggcgagatcagaaaggtggagcccgtgacccagaaggacagcaccagcctgagcagcgagagcagcagcagcagcagcgagagcgaggaggaggacgtgggcgagtacagaccccaccacagagtgaccgagggcaccatcagagaggagcaggagtacgaggaggaggtggaggaggagcccagacccgccgccaagccccccgtggtgaagaccgagatggtgaccatcagcgacgccagccagagaaccgagatcagcaccaaggaggtgcccatcgtgcagaccgagaccaagaccatcacctacgagagcccccagatcgacggcggcgccggcggcgacagcggcaccctgctgaccgcccagaccatcaccagcgagagcgtgagcaccaccaccaccacccacatcaccaagaccgtgaagggcggcatcagcgagaccagaatcgagaagagaatcgtgatcaccggcgacggcgacatcgaccacgaccaggccctggcccaggccatcagagaggccagagagcagcaccccgacatgagcgtgaccagagtggtggtgcacaaggagaccgagctggccgaggagggcgaggactag

SEQ ID NO: 80641 - DNA, 357 bp, Artificial Sequence
  Description of Artificial Sequence: Synthetic coding sequence
atgaccaccgaggtgggcagcgtgagcgaggtgaagaaggacagcagccagctgggcaccgacgccaccaaggagaagcccaaggaggtggccgagaaccagcagaaccagagcagcgaccccgaggaggagaagggcagccagcccccccccgccgccgagagccagagcagcctgagaagacagaagagagagaaggagaccagcgagagcagaggcatcagcagattcatccccccctggctgaagaagcagaagagctacaccctggtggtggccaaggacggcggcgacaagaaggagcccacccaggccgtggtggaggagcaggtgctggacaaggaggagcccctgtag

SEQ ID NO: 80642 - DNA, 606 bp, Artificial Sequence
  Description of Artificial Sequence: Synthetic coding sequence
atggaggaggaggagacccagctggaggagaagaacagcctgagagtggagggcgacaacatctacgtgagacacagcaacctgatgctggaggagctggacaaggcccaggaggacatcctgaagcaccaggccagcatcagcgagctgaagagaaacttcatggagagcacccccgagcccagacccaacgagtgggagaagagaagaatcacccccctgagcctgcagacccagggcaccagagcccccgagagcgagggcccctgcaccggcgccagagacgccgtgaagccccccgtggtgaagaccgagatggtgaccatcagcgacgccagccagagaaccgagatcagcaccaaggaggtgcccatcgtgcagaccgagaccaagaccatcacctacgagagcccccagaccgtgaagggcggcatcagcgagaccagaatcgagaagagaatcgtgatcaccggcgacggcgacatcgaccacgaccaggccctggcccaggccatcagagaggccagagagcagcaccccgacatgagcgtgaccagagtggtggtgcacaaggagaccgagctggccgaggagggcgaggactag

SEQ ID NO: 80643 - DNA, 384 bp, Artificial Sequence
  Description of Artificial Sequence: Synthetic coding sequence
atgaccaccgaggtgggcagcgtgagcgaggtgaagaaggacagcagccagctgggcaccgacgccaccaaggagaagcccaaggaggtggccgagaaccagcagaaccagagcagcgaccccgaggaggagaagggcagccagcccccccccgccgccgagagccagagcagcctgagaagacagaagagagagaaggagaccagcgagagcagaggcatcagcagattcatccccccctggctgaagaagcagaagagctacaccctggtggtggccaaggacggcggcgacaagaaggagcccacccaggccgtggtggaggagcaggtgctggacaaggaggagcccctgcccgaggagcagagacaggccaagggctag

SEQ ID NO: 80644 - DNA, 489 bp, Artificial Sequence
  Description of Artificial Sequence: Synthetic coding sequence
atgaccaccgaggtgggcagcgtgagcgaggtgaagaaggacagcagccagctgggcaccgacgccaccaaggagaagcccaaggaggtggccgagaaccagcagaaccagagcagcgaccccgaggaggagaagggcagccagcccccccccgccgccgagagccagagcagcctgagaagacagaagagagagaaggagaccagcgagagcagaggcatcagcagattcatccccccctggctgaagaagcagaagagctacaccctggtggtggccaaggacggcggcgacaagaaggagcccacccaggccgtggtggaggagcaggtgctggacaaggaggagcccctgcccgaggagcagagacaggccaagggcgacgccgaggagatggcccagaagaagcaggagatcaaggtggaggtgaaggaggagaagcccagcgtgagcaaggaggagaagcccagcgtgagcaaggtggagtag

SEQ ID NO: 80645 - DNA, 3264 bp, Artificial Sequence
  Description of Artificial Sequence: Synthetic coding sequence
atgaccaccgagagcggcagcgacagcgagagcaagcccgaccaggaggccgagccccaggaggccgccggcgcccagggcagagccggcgcccccgtgcccgagccccccaaggaggagcagcagcaggccctggagcagttcgccgccgccgccgcccacagcacccccgtgagaagagaggtgaccgacaaggagcaggagttcgccgccagagccgccaagcagctggagtaccagcagctggaggacgacaagctgagccagaagagcagcagcagcaagctgagcagaagccccctgaagatcgtgaagaagcccaagagcatgcagtgcaaggtgatcctgctggacggcagcgagtacacctgcgacgtggagaagagaagcagaggccaggtgctgttcgacaaggtgtgcgagcacctgaacctgctggagaaggactacttcggcctgacctacagagacgccgagaaccagaagaactggctggaccccgccaaggagatcaagaagcaggtgagaagcggcgcctggcacttcagcttcaacgtgaagttctacccccccgaccccgcccagctgagcgaggacatcaccagatactacctgtgcctgcagctgagagacgacatcgtgagcggcagactgccctgcagcttcgtgaccctggccctgctgggcagctacaccgtgcagagcgagctgggcgactacgaccccgacgagtgcggcagcgactacatcagcgagttcagattcgcccccaaccacaccaaggagctggaggacaaggtgatcgagctgcacaagagccacagaggcatgacccccgccgaggccgagatgcacttcctggagaacgccaagaagctgagcatgtacggcgtggacctgcaccacgccaaggacagcgagggcgtggagatcatgctgggcgtgtgcgccagcggcctgctgatctacagagacagactgagaatcaacagattcgcctggcccaaggtgctgaagatcagctacaagagaaacaacttctacatcaagatcagacccggcgagttcgagcagttcgagagcaccatcggcttcaagctgcccaaccacagagccgccaagagactgtggaaggtgtgcgtggagcaccacaccttcttcagactgctgctgcccgaggccccccccaagaagttcctgaccctgggcagcaagttcagatacagcggcagaacccaggcccagaccagaagagccagcgccctgatcgacagacccgccccctacttcgagagaagcagcagcaagagatacaccatgagcagaagcctggacggcgaggtgggcaccggccagtacgccaccaccaagggcatcagccagaccaacctgatcaccaccgtgacccccgagaagaaggccgaggaggagagagacgaggaggaggacaagagaagaaagggcgaggaggtgacccccatcagcgccatcagacacgagggcaagagccccggcctgggcaccgacagctgccccctgagcccccccagcacccactgcgcccccaccagccccaccgagctgagaagaagatgcaaggagaacgactgcaagctgcccggctacgagcccagcagagccgagcacctgcccggcgagcccgccctggacagcgacggccccggcagaccctacctgggcgaccaggacgtggccttcagctacagacagcagaccggcaagggcaccaccctgttcagcttcagcctgcagctgcccgagagcttccccagcctgctggacgacgacggctacctgagcttccccaacctgagcgagaccaacctgctgccccagagcctgcagcactacctgcccatcagaagccccagcctggtgccctgcttcctgttcatcttcttcttcctgctgagcgccagcttcagcgtgccctacgccctgaccctgagcttccccctggccctgtgcctgtgctacctggagcccaaggccgccagcctgagcgccagcctggacaacgaccccagcgacagcagcgaggaggagaccgacagcgagagaaccgacaccgccgccgacggcgagaccaccgccaccgagagcgaccaggaggaggacgccgagctgaaggcccaggagctggagaagacccaggacgacctgatgaagcaccagaccaacatcagcgagctgaagagaaccttcctggagaccagcaccgacaccgccgtgaccaacgagtgggagaagagactgagcaccagccccgtgagactggccgccagacaggaggacgcccccatgatcgagcccctggtgcccgaggagaccaagcagagcagcggcgagaagctgatggacggcagcgagatcttcagcctgctggagagcgccagaaagcccaccgagttcatcggcggcgtgaccagcaccagccagagctgggtgcagaagatggagaccaagaccgagagcagcggcatcgagaccgagcccaccgtgcaccacctgcccctgagcaccgagaaggtggtgcaggagaccgtgctggtggaggagagaagagtggtgcacgccagcggcgacgccagctacagcgccggcgacagcggcgacgccgccgcccagcccgccttcaccggcatcaagggcaaggagggcagcgccctgaccgagggcgccaaggaggagggcggcgaggaggtggccaaggccgtgctggagcaggaggagaccgccgccgccagcagagagagacaggaggagcagagcgccgccatccacatcagcgagaccctggagcagaagccccacttcgagagcagcaccgtgaagaccgagaccatcagcttcggcagcgtgagccccggcggcgtgaagctggagatcagcaccaaggaggtgcccgtggtgcacaccgagaccaagaccatcacctacgagagcagccaggtggaccccggcaccgacctggagcccggcgtgctgatgagcgcccagaccatcaccagcgagaccaccagcaccaccaccaccacccacatcaccaagaccgtgaagggcggcatcagcgagaccagaatcgagaagagaatcgtgatcaccggcgacgccgacatcgaccacgaccaggccctggcccaggccatcaaggaggccaaggagcagcaccccgacatgagcgtgaccaaggtggtggtgcacaaggagaccgagatcacccccgaggacggcgaggactag

SEQ ID NO: 80646 - DNA, 3264 bp, Artificial Sequence; identical to SEQ ID NO: 80645
  Description of Artificial Sequence: Synthetic coding sequence

SEQ ID NO: 80647 - DNA, 2598 bp, Artificial Sequence
  Description of Artificial Sequence: Synthetic coding sequence
atgaccaccgagagcggcagcgacagcgagagcaagcccgaccaggaggccgagccccaggaggccgccggcgcccagggcagagccggcgcccccgtgcccgagccccccaaggaggagcagcagcaggccctggagcagttcgccgccgccgccgcccacagcacccccgtgagaagagaggtgaccgacaaggagcaggagttcgccgccagagccgccaagcagctggagtaccagcagctggaggacgacaagctgagccagaagagcagcagcagcaagctgagcagaagccccctgaagatcgtgaagaagcccaagagcatgcagtgcaaggtgatcctgctggacggcagcgagtacacctgcgacgtggagaagagaagcagaggccaggtgctgttcgacaaggtgtgcgagcacctgaacctgctggagaaggactacttcggcctgacctacagagacgccgagaaccagaagaactggctggaccccgccaaggagatcaagaagcaggtgagaagcggcgcctggcacttcagcttcaacgtgaagttctacccccccgaccccgcccagctgagcgaggacatcaccagatactacctgtgcctgcagctgagagacgacatcgtgagcggcagactgccctgcagcttcgtgaccctggccctgctgggcagctacaccgtgcagagcgagctgggcgactacgaccccgacgagtgcggcagcgactacatcagcgagttcagattcgcccccaaccacaccaaggagctggaggacaaggtgatcgagctgcacaagagccacagaggcatgacccccgccgaggccgagatgcacttcctggagaacgccaagaagctgagcatgtacggcgtggacctgcaccacgccaaggacagcgagggcgtggagatcatgctgggcgtgtgcgccagcggcctgctgatctacagagacagactgagaatcaacagattcgcctggcccaaggtgctgaagatcagctacaagagaaacaacttctacatcaagatcagacccggcgagttcgagcagttcgagagcaccatcggcttcaagctgcccaaccacagagccgccaagagactgtggaaggtgtgcgtggagcaccacaccttcttcagactgctgctgcccgaggccccccccaagaagttcctgaccctgggcagcaagttcagatacagcggcagaacccaggcccagaccagaagagccagcgccctgatcgacagacccgccccctacttcgagagaagcagcagcaagagatacaccatgagcagaagcctggacggcgccagcgtgaacgagaaccacgagatctacatgaaggacagcatgagcgccgccgaggtgggcaccggccagtacgccaccaccaagggcatcagccagaccaacctgatcaccaccgtgacccccgagaagaaggccgaggaggagagagacgaggaggaggacaagagaagaaagggcgaggaggtgacccccatcagcgccatcagacacgagggcaagaccgacagcgagagaaccgacaccgccgccgacggcgagaccaccgccaccgaggagctggagaagacccaggacgacctgatgaagcaccagaccaacatcagcgagctgaagagaaccttcctggagaccagcaccgacaccgccgtgaccaacgagtgggagaagagactgagcaccagccccgtgagactggccgccagacaggaggacgcccccatgatcgagcccctggtgcccgaggagaagatggagaccaagaccgagagcagcggcatcgagaccgagcccaccgtgcaccacctgcccctgagcaccgagaaggtggtgcaggagaccgtgctggtggaggagagaagagtggtgcacgccagcggcgacgccagctacagcgccggcgacagcggcgacgccgccgcccagcccgccttcaccggcatcaagggcaaggagggcagcgccctgaccgagggcgccaaggaggagggcggcgaggaggtggccaaggccgtgctggagcaggaggagaccgccgccgccagcagagagagacaggaggagcagagcgccgccatccacatcagcgagaccctggagcagaagccccacttcgagagcagcaccgtgaagaccgagaccatcagcttcggcagcgtgagccccggcggcgtgaagctggagatcagcaccaaggaggtgcccgtggtgcacaccgagaccaagaccatcacctacgagagcagccaggtggaccccggcaccgacctggagcccggcgtgctgatgagcgcccagaccatcaccagcgagaccaccagcaccaccaccaccacccacatcaccaagaccgtgaagggcggcatcagcgagaccagaatcgagaagagaatcgtgatcaccggcgacgccgacatcgaccacgaccaggccctggcccaggccatcaaggaggccaaggagcagcaccccgacatgagcgtgaccaaggtggtggtgcacaaggagaccgagatcacccccgaggacggcgaggactag

SEQ ID NO: 80648 - DNA, 1155 bp, Artificial Sequence
  Description of Artificial Sequence: Synthetic coding sequence
atgaagcaccagaccaacatcagcgagctgaagagaaccttcctggagaccagcaccgacaccgccgtgaccaacgagtgggagaagagactgagcaccagccccgtgagactggccgccagacaggaggacgcccccatgatcgagcccctggtgcccgaggagaccaaggaggagaccgagatcagcgagaaggtgatcttcctgcagcagggcagcgcccccttcctggagagccagaccaagcagagcagcggcgagaagctgatggacggcagcgagatcttcagcctgctggagagcgccagaaagcccaccgagttcatcggcggcgtgaccagcaccagccagagctgggtgcagaagatggagaccaagaccgagagcagcggcatcgagaccgagcccaccgtgcaccacctgcccctgagcaccgagaaggtggtgcaggagaccgtgctggtggaggagagaagagtggtgcacgccagcggcgacgccagctacagcgccggcgacagcggcgacgccgccgcccagcccgccttcaccggcatcaagggcaaggagggcagcgccctgaccgagggcgccaaggaggagggcggcgaggaggtggccaaggccgtgctggagcaggaggagaccgccgccgccagcagagagagacaggaggagcagagcgccgccatccacatcagcgagaccctggagcagaagccccacttcgagagcagcaccgtgaagaccgagaccatcagcttcggcagcgtgagccccggcggcgtgaagctggagatcagcaccaaggaggtgcccgtggtgcacaccgagaccaagaccatcacctacgagagcagccaggtggaccccggcaccgacctggagcccggcgtgctgatgagcgcccagaccatcaccagcgagaccaccagcaccaccaccaccacccacatcaccaagaccgtgaagggcggcatcagcgagaccagaatcgagaagagaatcgtgatcaccggcgacgccgacatcgaccacgaccaggccctggcccaggccatcaaggaggccaaggagcagcaccccgacatgagcgtgaccaaggtggtggtgcacaaggagaccgagatcacccccgaggacggcgaggactag

SEQ ID NO: 80649 - DNA, 2271 bp, Artificial Sequence
  Description of Artificial Sequence: Synthetic coding sequence
atgcagtgcaaggtgatcctgctggacggcagcgagtacacctgcgacgtggagaagagaagcagaggccaggtgctgttcgacaaggtgtgcgagcacctgaacctgctggagaaggactacttcggcctgacctacagagacgccgagaaccagaagaactggctggaccccgccaaggagatcaagaagcaggtgagaagcggcgcctggcacttcagcttcaacgtgaagttctacccccccgaccccgcccagctgagcgaggacatcaccagatactacctgtgcctgcagctgagagacgacatcgtgagcggcagactgccctgcagcttcgtgaccctggccctgctgggcagctacaccgtgcagagcgagctgggcgactacgaccccgacgagtgcggcagcgactacatcagcgagttcagattcgcccccaaccacaccaaggagctggaggacaaggtgatcgagctgcacaagagccacagaggcatgacccccgccgaggccgagatgcacttcctggagaacgccaagaagctgagcatgtacggcgtggacctgcaccacgccaaggacagcgagggcgtggagatcatgctgggcgtgtgcgccagcggcctgctgatctacagagacagactgagaatcaacagattcgcctggcccaaggtgctgaagatcagctacaagagaaacaacttctacatcaagatcagacccggcgagttcgagcagttcgagagcaccatcggcttcaagctgcccaaccacagagccgccaagagactgtggaaggtgtgcgtggagcaccacaccttcttcagactgctgctgcccgaggccccccccaagaagttcctgaccctgggcagcaagttcagatacagcggcagaacccaggcccagaccagaagagccagcgccctgatcgacagacccgccccctacttcgagagaagcagcagcaagagatacaccatgagcagaagcctggacggcgccagcgtgaacgagaaccacgagatctacatgaaggacagcatgagcgccgccgaggtgggcaccggccagtacgccaccaccaagggcatcagccagaccaacctgatcaccaccgtgacccccgagaagaaggccgaggaggagagagacgaggaggaggacaagagaagaaagggcgaggaggtgacccccatcagcgccatcagacacgagggcaagaccgacagcgagagaaccgacaccgccgccgacggcgagaccaccgccaccgaggagctggagaagacccaggacgacctgatgaagcaccagaccaacatcagcgagctgaagagaaccttcctggagaccagcaccgacaccgccgtgaccaacgagtgggagaagagactgagcaccagccccgtgagactggccgccagacaggaggacgcccccatgatcgagcccctggtgcccgaggagaagatggagaccaagaccgagagcagcggcatcgagaccgagcccaccgtgcaccacctgcccctgagcaccgagaaggtggtgcaggagaccgtgctggtggaggagagaagagtggtgcacgccagcggcgacgccagctacagcgccggcgacagcggcgacgccgccgcccagcccgccttcaccggcatcaagggcaaggagggcagcgccctgaccgagggcgccaaggaggagggcggcgaggaggtggccaaggccgtgctggagcaggaggagaccgccgccgccagcagagagagacaggaggagcagagcgccgccatccacatcagcgagaccctggagcagaagccccacttcgagagcagcaccgtgaagaccgagaccatcagcttcggcagcgtgagccccggcggcgtgaagctggagatcagcaccaaggaggtgcccgtggtgcacaccgagaccaagaccatcacctacgagagcagccaggtggaccccggcaccgacctggagcccggcgtgctgatgagcgcccagaccatcaccagcgagaccaccagcaccaccaccaccacccacatcaccaagaccgtgaagggcggcatcagcgagaccagaatcgagaagagaatcgtgatcaccggcgacgccgacatcgaccacgaccaggccctggcccaggccatcaaggaggccaaggagcagcaccccgacatgagcgtgaccaaggtggtggtgcacaaggagaccgagatcacccccgaggacggcgaggactag

SEQ ID NO: 80650 - DNA, 1179 bp, Artificial Sequence
  Description of Artificial Sequence: Synthetic coding sequence
atgaagcaccagaccaacatcagcgagctgaagagaaccttcctggagaccagcaccgacaccgccgtgaccaacgagtgggagaagagactgagcaccagccccgtgagactggccgccagacaggaggacgcccccatgatcgagcccctggtgcccgaggagcccagcgtgatcaagaagatgcaggagggcgacagcgccgacagcgtggtgaccagcagacagatcatcttccagaagaccgtgcccagcaccctggagaccaagcagagcagcggcgagaagctgatggacggcagcgagatcttcagcctgctggagagcgccagaaagcccaccgagttcatcggcggcgtgaccagcaccagccagagctgggtgcagaagatggagaccaagaccgagagcagcggcatcgagaccgagcccaccgtgcaccacctgcccctgagcaccgagaaggtggtgcaggagaccgtgctggtggaggagagaagagtggtgcacgccagcggcgacgccagctacagcgccggcgacagcggcgacgccgccgcccagcccgccttcaccggcatcaagggcaaggagggcagcgccctgaccgagggcgccaaggaggagggcggcgaggaggtggccaaggccgtgctggagcaggaggagaccgccgccgccagcagagagagacaggaggagcagagcgccgccatccacatcagcgagaccctggagcagaagccccacttcgagagcagcaccgtgaagaccgagaccatcagcttcggcagcgtgagccccggcggcgtgaagctggagatcagcaccaaggaggtgcccgtggtgcacaccgagaccaagaccatcacctacgagagcagccaggtggaccccggcaccgacctggagcccggcgtgctgatgagcgcccagaccatcaccagcgagaccaccagcaccaccaccaccacccacatcaccaagaccgtgaagggcggcatcagcgagaccagaatcgagaagagaatcgtgatcaccggcgacgccgacatcgaccacgaccaggccctggcccaggccatcaaggaggccaaggagcagcaccccgacatgagcgtgaccaaggtggtggtgcacaaggagaccgagatcacccccgaggacggcgaggactag

SEQ ID NO: 80651 - DNA, 936 bp, Artificial Sequence
  Description of Artificial Sequence: Synthetic coding sequence
agatggcagctgggcggcgccgccaccgccgccgccggcggcgccagagtgtggagacccctgcccgccagcagaagcagcttccccccccccagccccagactggaccccggcgagttcgagggcaagagcccctgcggcggcacctgcgagcagccctacctgagcctgcccctgagatacttcttcagccccagaaaggtggtgcccgccggctgcgagcaggcccccggcggcgcccccaaggagggcttcggcgacagcgacagcgagagcaagcccgaccaggaggccgagccccaggaggccgccggcgcccagggcagagccggcgcccccgtgcccgagccccccaaggaggagcagcagcaggccctggagcagttcgccgccgccgccgcccacagcacccccgtgagaagagaggtgaccgacaaggagcaggagttcgccgccagagccgccaagcagctggagtaccagcagctggaggacgacaagctgagccagaagagcagcagcagcaagctgagcagaagccccctgaagatcgtgaagaagcccaagagcatgcagtgcaaggtgatcctgctggacggcagcgagtacacctgcgacgtggagaagagaagcagaggccaggtgctgttcgacaaggtgtgcgagcacctgaacctgctggagaaggactacttcggcctgacctacagagacgccgagaaccagaagaactggctggaccccgccaaggagatcaagaagcaggtgagaagcggcgcctggcacttcagcttcaacgtgaagttctacccccccgaccccgcccagctgagcgaggacatcaccagatactacctgtgcctgcagctgagagacgacatcgtgagcggcagactgccctgcagcttcgtgaccctggccctgctgggcagctag

SEQ ID NO: 80652 - DNA, 2652 bp, Artificial Sequence
  Description of Artificial Sequence: Synthetic coding sequence
atgaccaccgagagcggcagcgacagcgagagcaagcccgaccaggaggccgagccccaggaggccgccggcgcccagggcagagccggcgcccccgtgcccgagccccccaaggaggagcagcagcaggccctggagcagttcgccgccgccgccgcccacagcacccccgtgagaagagaggtgaccgacaaggagcaggagttcgccgccagagccgccaagcagctggagtaccagcagctggaggacgacaagctgagccagaagagcagcagcagcaagctgagcagaagccccctgaagatcgtgaagaagcccaagagcatgcagtgcaaggtgatcctgctggacggcagcgagtacacctgcgacgtggagaagagaagcagaggccaggtgctgttcgacaaggtgtgcgagcacctgaacctgctggagaaggactacttcggcctgacctacagagacgccgagaaccagaagaactggctggaccccgccaaggagatcaagaagcaggtgagaagcggcgcctggcacttcagcttcaacgtgaagttctacccccccgaccccgcccagctgagcgaggacatcaccagatactacctgtgcctgcagctgagagacgacatcgtgagcggcagactgccctgcagcttcgtgaccctggccctgctgggcagctacaccgtgcagagcgagctgggcgactacgaccccgacgagtgcggcagcgactacatcagcgagttcagattcgcccccaaccacaccaaggagctggaggacaaggtgatcgagctgcacaagagccacagaggcatgacccccgccgaggccgagatgcacttcctggagaacgccaagaagctgagcatgtacggcgtggacctgcaccacgccaaggacagcgagggcgtggagatcatgctgggcgtgtgcgccagcggcctgctgatctacagagacagactgagaatcaacagattcgcctggcccaaggtgctgaagatcagctacaagagaaacaacttctacatcaagatcagacccggcgagttcgagcagttcgagagcaccatcggcttcaagctgcccaaccacagagccgccaagagactgtggaaggtgtgcgtggagcaccacaccttcttcagactgctgctgcccgaggccccccccaagaagttcctgaccctgggcagcaagttcagatacagcggcagaacccaggcccagaccagaagagccagcgccctgatcgacagacccgccccctacttcgagagaagcagcagcaagagatacaccatgagcagaagcctggacggcgccagcgtgaacgagaaccacgagatctacatgaaggacagcatgagcgccgccgaggtgggcaccggccagtacgccaccaccaagggcatcagccagaccaacctgatcaccaccgtgacccccgagaagaaggccgaggaggagagagacgaggaggaggacaagagaagaaagggcgaggaggtgacccccatcagcgccatcagacacgagggcaagaccgacagcgagagaaccgacaccgccgccgacggcgagaccaccgccaccgagagcgaccaggaggaggacgccgagctgaaggcccaggagctggagaagacccaggacgacctgatgaagcaccagaccaacatcagcgagctgaagagaaccttcctggagaccagcaccgacaccgccgtgaccaacgagtgggagaagagactgagcaccagccccgtgagactggccgccagacaggaggacgcccccatgatcgagcccctggtgcccgaggagaccaagcagagcagcggcgagaagctgatggacggcagcgagatcttcagcctgctggagagcgccagaaagcccaccgagttcatcggcggcgtgaccagcaccagccagagctgggtgcagaagatggagaccaagaccgagagcagcggcatcgagaccgagcccaccgtgcaccacctgcccctgagcaccgagaaggtggtgcaggagaccgtgctggtggaggagagaagagtggtgcacgccagcggcgacgccagctacagcgccggcgacagcggcgacgccgccgcccagcccgccttcaccggcatcaagggcaaggagggcagcgccctgaccgagggcgccaaggaggagggcggcgaggaggtggccaaggccgtgctggagcaggaggagaccgccgccgccagcagagagagacaggaggagcagagcgccgccatccacatcagcgagaccctggagcagaagccccacttcgagagcagcaccgtgaagaccgagaccatcagcttcggcagcgtgagccccggcggcgtgaagctggagatcagcaccaaggaggtgcccgtggtgcacaccgagaccaagaccatcacctacgagagcagccaggtggaccccggcaccgacctggagcccggcgtgctgatgagcgcccagaccatcaccagcgagaccaccagcaccaccaccaccacccacatcaccaagaccgtgaagggcggcatcagcgagaccagaatcgagaagagaatcgtgatcaccggcgacgccgacatcgaccacgaccaggagtag

SEQ ID NO: 80653 - DNA, 2271 bp, Artificial Sequence; identical to SEQ ID NO: 80649
  Description of Artificial Sequence: Synthetic coding sequence

SEQ ID NO: 80654 - DNA, 2166 bp, Artificial Sequence
  Description of Artificial Sequence: Synthetic coding sequence
atgggccagggcgagcccagccagagaagcaccggcctggccggcctgtacgccgcccccgccgccagccccgtgttcatcaagggcagcggcatggacgccctgggcatcaagagctgcgacttccaggccgccagaaacaacgaggagcaccacaccaaggccctgagcagcagaagactgttcgtgagaagaggccagcccttcaccatcatcctgtacttcagagcccccgtgagagccttcctgcccgccctgaagaaggtggccctgaccgcccagaccggcgagcagcccagcaagatcaacagaacccaggccaccttccccatcagcagcctgggcgacagaaagtggtggagcgccgtggtggaggagagagacgcccagagctggaccatcagcgtgaccacccccgccgacgccgtgatcggccactacagcctgctgctgcaggtgagcggcagaaagcagctgctgctgggccagttcaccctgctgttcaacccctggaacagagaggacgccgtgttcctgaagaacgaggcccagagaatggagtacctgctgaaccagaacggcctgatctacctgggcaccgccgactgcatccaggccgagagctgggacttcggccagttcgagggcgacgtgatcgacctgagcctgagactgctgagcaaggacaagcaggtggagaagtggagccagcccgtgcacgtggccagagtgctgggcgccctgctgcacttcctgaaggagcagagagtgctgcccaccccccagacccaggccacccaggagggcgccctgctgaacaagagaagaggcagcgtgcccatcctgagacagtggctgaccggcagaggcagacccgtgtacgacggccaggcctgggtgctggccgccgtggcctgcaccgtgctgagatgcctgggcatccccgccagagtggtgaccaccttcgccagcgcccagggcaccggcggcagactgctgatcgacgagtactacaacgaggagggcctgcagaacggcgagggccagagaggcagaatctggatcttccagaccagcaccgagtgctggatgaccagacccgccctgccccagggctacgacggctggcagatcctgcaccccagcgcccccaacggcggcggcgtgctgggcagctgcgacctggtgcccgtgagagccgtgaaggagggcaccctgggcctgacccccgccgtgagcgacctgttcgccgccatcaacgccagctgcgtggtgtggaagtgctgcgaggacggcaccctggagctgaccgacagcaacaccaagtacgtgggcaacaacatcagcaccaagggcgtgggcagcgacagatgcgaggacatcacccagaactacaagtaccccgagggcagcctgcaggagaaggaggtgctggagagagtggagaaggagaagatggagagagagaaggacaacggcatcagaccccccagcctggagaccgccagccccctgtacctgctgctgaaggcccccagcagcctgcccctgagaggcgacgcccagatcagcgtgaccctggtgaaccacagcgagcaggagaaggccgtgcagctggccatcggcgtgcaggccgtgcactacaacggcgtgctggccgccaagctgtggagaaagaagctgcacctgaccctgagcgccaacctggagaagatcatcaccatcggcctgttcttcagcaacttcgagagaaacccccccgagaacaccttcctgagactgaccgccatggccacccacagcgagagcaacctgagctgcttcgcccaggaggacatcgccatctgcagaccccacctggccatcaagatgcccgagaaggccgagcagtaccagcccctgaccgccagcgtgagcctgcagaacagcctggacgcccccatggaggactgcgtgatcagcatcctgggcagaggcctgatccacagagagagaagctacagattcagaagcgtgtggcccgagaacaccatgtgcgccaagttccagttcacccccacccacgtgggcctgcagagactgaccgtggaggtggactgcaacatgttccagaacctgaccaactacaagagcgtgaccgtggtggcccccgagctgagcgcctag

SEQ ID NO: 80655 - DNA, 1860 bp, Artificial Sequence
  Description of Artificial Sequence: Synthetic coding sequence
atgggccaggccctgggcatcaagagctgcgacttccaggccgccagaaacaacgaggagcaccacaccaaggccctgagcagcagaagactgttcgtgagaagaggccagcccttcaccatcatcctgtacttcagagcccccgtgagagccttcctgcccgccctgaagaaggtggccctgaccgcccagaccggcgagcagcccagcaagatcaacagaacccaggccaccttccccatcagcagcctgggcgacagaaagtggtggagcgccgtggtggaggagagagacgcccagagctggaccatcagcgtgaccacccccgccgacgccgtgatcggccactacagcctgctgctgcaggtgagcggcagaaagcagctgctgctgggccagttcaccctgctgttcaacccctggaacagagaggacgccgtgttcctgaagaacgaggcccagagaatggagtacctgctgaaccagaacggcctgatctacctgggcaccgccgactgcatccaggccgagagctgggacttcggccagttcgagggcgacgtgatcgacctgagcctgagactgctgagcaaggacaagcaggtggagaagtggagccagcccgtgcacgtggccagagtgctgggcgccctgctgcacttcctgaaggagcagagagtgctgcccaccccccagacccaggccacccaggagggcgccctgctgaacaagagaagaggcagcgtgcccatcctgagacagtggctgaccggcagaggcagacccgtgtacgacggccaggcctgggtgctggccgccgtggcctgcaccgtgctgagatgcctgggcatccccgccagagtggtgaccaccttcgccagcgcccagggcaccggcggcagactgctgatcgacgagtactacaacgaggagggcctgcagaacggcgagggccagagaggcagaatctggaagtgctgcgaggacggcaccctggagctgaccgacagcaacaccaagtacgtgggcaacaacatcagcaccaagggcgtgggcagcgacagatgcgaggacatcacccagaactacaagtaccccgagggcagcctgcaggagaaggaggtgctggagagagtggagaaggagaagatggagagagagaaggacaacggcatcagaccccccagcctggagaccgccagccccctgtacctgctgctgaaggcccccagcagcctgcccctgagaggcgacgcccagatcagcgtgaccctggtgaaccacagcgagcaggagaaggccgtgcagctggccatcggcgtgcaggccgtgcactacaacggcgtgctggccgccaagctgtggagaaagaagctgcacctgaccctgagcgccaacctggagaagatcatcaccatcggcctgttcttcagcaacttcgagagaaacccccccgagaacaccttcctgagactgaccgccatggccacccacagcgagagcaacctgagctgcttcgcccaggaggacatcgccatctgcagaccccacctggccatcaagatgcccgagaaggccgagcagtaccagcccctgaccgccagcgtgagcctgcagaacagcctggacgcccccatggaggactgcgtgatcagcatcctgggcagaggcctgatccacagagagagaagctacagattcagaagcgtgtggcccgagaacaccatgtgcgccaagttccagttcacccccacccacgtgggcctgcagagactgaccgtggaggtggactgcaacatgttccagaacctgaccaactacaagagcgtgaccgtggtggcccccgagctgagcgcctag

SEQ ID NO: 80656 - DNA, 2076 bp, Artificial Sequence
  Description of Artificial Sequence: Synthetic coding sequence
atgggccaggccctgggcatcaagagctgcgacttccaggccgccagaaacaacgaggagcaccacaccaaggccctgagcagcagaagactgttcgtgagaagaggccagcccttcaccatcatcctgtacttcagagcccccgtgagagccttcctgcccgccctgaagaaggtggccctgaccgcccagaccggcgagcagcccagcaagatcaacagaacccaggccaccttccccatcagcagcctgggcgacagaaagtggtggagcgccgtggtggaggagagagacgcccagagctggaccatcagcgtgaccacccccgccgacgccgtgatcggccactacagcctgctgctgcaggtgagcggcagaaagcagctgctgctgggccagttcaccctgctgttcaacccctggaacagagaggacgccgtgttcctgaagaacgaggcccagagaatggagtacctgctgaaccagaacggcctgatctacctgggcaccgccgactgcatccaggccgagagctgggacttcggccagttcgagggcgacgtgatcgacctgagcctgagactgctgagcaaggacaagcaggtggagaagtggagccagcccgtgcacgtggccagagtgctgggcgccctgctgcacttcctgaaggagcagagagtgctgcccaccccccagacccaggccacccaggagggcgccctgctgaacaagagaagaggcagcgtgcccatcctgagacagtggctgaccggcagaggcagacccgtgtacgacggccaggcctgggtgctggccgccgtggcctgcaccgtgctgagatgcctgggcatccccgccagagtggtgaccaccttcgccagcgcccagggcaccggcggcagactgctgatcgacgagtactacaacgaggagggcctgcagaacggcgagggccagagaggcagaatctggatcttccagaccagcaccgagtgctggatgaccagacccgccctgccccagggctacgacggctggcagatcctgcaccccagcgcccccaacggcggcggcgtgctgggcagctgcgacctggtgcccgtgagagccgtgaaggagggcaccctgggcctgacccccgccgtgagcgacctgttcgccgccatcaacgccagctgcgtggtgtggaagtgctgcgaggacggcaccctggagctgaccgacagcaacaccaagtacgtgggcaacaacatcagcaccaagggcgtgggcagcgacagatgcgaggacatcacccagaactacaagtaccccgagggcagcctgcaggagaaggaggtgctggagagagtggagaaggagaagatggagagagagaaggacaacggcatcagaccccccagcctggagaccgccagccccctgtacctgctgctgaaggcccccagcagcctgcccctgagaggcgacgcccagatcagcgtgaccctggtgaaccacagcgagcaggagaaggccgtgcagctggccatcggcgtgcaggccgtgcactacaacggcgtgctggccgccaagctgtggagaaagaagctgcacctgaccctgagcgccaacctggagaagatcatcaccatcggcctgttcttcagcaacttcgagagaaacccccccgagaacaccttcctgagactgaccgccatggccacccacagcgagagcaacctgagctgcttcgcccaggaggacatcgccatctgcagaccccacctggccatcaagatgcccgagaaggccgagcagtaccagcccctgaccgccagcgtgagcctgcagaacagcctggacgcccccatggaggactgcgtgatcagcatcctgggcagaggcctgatccacagagagagaagctacagattcagaagcgtgtggcccgagaacaccatgtgcgccaagttccagttcacccccacccacgtgggcctgcagagactgaccgtggaggtggactgcaacatgttccagaacctgaccaactacaagagcgtgaccgtggtggcccccgagctgagcgcctag

SEQ ID NO: 80657 - DNA, 1842 bp, Artificial Sequence
  Description of Artificial Sequence: Synthetic coding sequence
atgggccaggccctgggcatcaagagctgcgacttccaggccgccagaaacaacgaggagcaccacaccaaggccctgagcagcagaagactgttcgtgagaagaggccagcccttcaccatcatcctgtacttcagagcccccgtgagagccttcctgcccgccctgaagaaggtggccctgaccgcccagaccgaggacgccgtgttcctgaagaacgaggcccagagaatggagtacctgctgaaccagaacggcctgatctacctgggcaccgccgactgcatccaggccgagagctgggacttcggccagttcgagggcgacgtgatcgacctgagcctgagactgctgagcaaggacaagcaggtggagaagtggagccagcccgtgcacgtggccagagtgctgggcgccctgctgcacttcctgaaggagcagagagtgctgcccaccccccagacccaggccacccaggagggcgccctgctgaacaagagaagaggcagcgtgcccatcctgagacagtggctgaccggcagaggcagacccgtgtacgacggccaggcctgggtgctggccgccgtggcctgcaccgtgctgagatgcctgggcatccccgccagagtggtgaccaccttcgccagcgcccagggcaccggcggcagactgctgatcgacgagtactacaacgaggagggcctgcagaacggcgagggccagagaggcagaatctggatcttccagaccagcaccgagtgctggatgaccagacccgccctgccccagggctacgacggctggcagatcctgcaccccagcgcccccaacggcggcggcgtgctgggcagctgcgacctggtgcccgtgagagccgtgaaggagggcaccctgggcctgacccccgccgtgagcgacctgttcgccgccatcaacgccagctgcgtggtgtggaagtgctgcgaggacggcaccctggagctgaccgacagcaacaccaagtacgtgggcaacaacatcagcaccaagggcgtgggcagcgacagatgcgaggacatcacccagaactacaagtaccccgagggcagcctgcaggagaaggaggtgctggagagagtggagaaggagaagatggagagagagaaggacaacggcatcagaccccccagcctggagaccgccagccccctgtacctgctgctgaaggcccccagcagcctgcccctgagaggcgacgcccagatcagcgtgaccctggtgaaccacagcgagcaggagaaggccgtgcagctggccatcggcgtgcaggccgtgcactacaacggcgtgctggccgccaagctgtggagaaagaagctgcacctgaccctgagcgccaacctggagaagatcatcaccatcggcctgttcttcagcaacttcgagagaaacccccccgagaacaccttcctgagactgaccgccatggccacccacagcgagagcaacctgagctgcttcgcccaggaggacatcgccatctgcagaccccacctggccatcaagatgcccgagaaggccgagcagtaccagcccctgaccgccagcgtgagcctgcagaacagcctggacgcccccatggaggactgcgtgatcagcatcctgggcagaggcctgatccacagagagagaagctacagattcagaagcgtgtggcccgagaacaccatgtgcgccaagttccagttcacccccacccacgtgggcctgcagagactgaccgtggaggtggactgcaacatgttccagaacctgaccaactacaagagcgtgaccgtggtggcccccgagctgagcgcctag

SEQ ID NO: 80658 - DNA, 1218 bp, Artificial Sequence
  Description of Artificial Sequence: Synthetic coding sequence
atggagagactgcagaagcagcccctgaccagccccggcagcgtgagccccagcagagacagcagcgtgcccggcagccccagcagcatcgtggccaagatggacaaccaggtgctgggctacaaggacctggccgccatccccaaggacaaggccatcctggacatcgagagacccgacctgatgatctacgagccccacttcacctacagcctgctggagcacgtggagctgcccagaagcagagagagaagcctgagccccaagagcaccagccccccccccagccccgaggtgtgggccgacagcagaagccccggcatcatcagccaggccagcgcccccagaaccaccggcacccccagaaccagcctgccccacttccaccaccccgagaccagcagacccgacagcaacatctacaagaagccccccatctacaagcagagagagagcgtgggcggcagcccccagaccaagcacctgatcgaggacctgatcatcgagagcagcaagttccccgccgcccagccccccgaccccaaccagcccgccaagatcgagaccgactactggccctgcccccccagcctggccgtggtggagaccgagtggagaaagagaaaggccagcagaagaggcgccgaggaggaggaggaggaggaggacgacgacagcggcgaggagatgaaggccctgagagagagacagagagaggagctgagcaaggtgaccagcaacctgggcaagatgatcctgaaggaggagatggagaagagcctgcccatcagaagaaagaccagaagcctgcccgacagaacccccttccacaccagcctgcaccagggcaccagcaagagcagcagcctgcccgcctacggcagaaccaccctgagcagactgcagagcaccgagttcagccccagcggcagcgagaccggcagccccggcctgcagaacggcgagggccagagaggcagaatggacagaggcaacagcctgccctgcgtgctggagcagaagatctacccctacgagatgctggtggtgaccaacaagggcagaaccaagctgccccccggcgtggacagaatgagactggagagacacctgagcgccgaggacttcagcagagtgttcgccatgagccccgaggagttcggcaagctggccctgtggaagagaaacgagctgaagaagaaggccagcctgttctag

SEQ ID NO: 80659 - DNA, 1218 bp, Artificial Sequence; identical to SEQ ID NO: 80658
  Description of Artificial Sequence: Synthetic coding sequence

SEQ ID NO: 80660 - DNA, 1626 bp, Artificial Sequence
  Description of Artificial Sequence: Synthetic coding sequence
atgatctacgagccccacttcacctacagcctgctggagcacgtggagctgcccagaagcagagagagaagcctgagccccaagagcaccagccccccccccagccccgaggtgtgggccgacagcagaagccccggcatcatcagccaggccagcgcccccagaaccaccggcacccccagaaccagcctgccccacttccaccaccccgagaccagcagacccgacagcaacatctacaagaagccccccatctacaagcagagagagagcgtgggcggcagcccccagaccaagcacctgatcgaggacctgatcatcgagagcagcaagttccccgccgcccagccccccgaccccaaccagcccgccaagatcgagaccgactactggccctgcccccccagcctggccgtggtggagaccgagtggagaaagagaaaggccagcagaagaggcgccgaggaggaggaggaggaggaggacgacgacagcggcgaggagatgaaggccctgagagagagacagagagaggagctgagcaaggtgaccagcaacctgggcaagatgatcctgaaggaggagatggagaagagcctgcccatcagaagaaagaccagaagcctgcccgacagaacccccttccacaccagcctgcaccagggcaccagcaagagcagcagcctgcccgcctacggcagaaccaccctgagcagactgcagagcaccgagttcagccccagcggcagcgagaccggcagccccggcctgcagaacggcgagggccagagaggcagaatggacagaggcaacagcctgccctgcgtgctggagcagaagatctacccctacgagatgctggtggtgaccaacaagggcagaaccaagctgccccccggcgtggacagaatgagactggagagacacctgagcgccgaggacttcagcagagtgttcgccatgagccccgaggagttcggcaagctggccctgtggaagagaaacgagctgaagaagaaggccagcctgttcggcgccctggtggtgagacccgtgggctgcctggagcagctggagggcagatgcagaggcggcaagagacccggcagaaagagcagcagactgctgtgcagaccccccagcccccccatcctgacccccgacagcttccccgccctgcagccccccgcccccctgaccctggtgggcaccggccccagcagcgccagcggcagagaggtgaccccccccctgcagctggccctgaccagcgccagaaagcccagagccagcaagcccttcgcccccgccctgagactgccccagaagcccggcctgagagtggagatgccccccacccacgaccccggccccccccccgccagcagacccagaaacggcaacagcagcaccaagcccggcaccggccagaagctgggcctgcccccccccctggacggcgtgaagagacccggcctggcccacttcggcgtgagctggctgcccgccctgacctacacccacgcccccccccacaccctgtgcagcctgaagaacgtgatctactggggcccccccagctgcttcccccacctgcccctgccctacctgaccccccccgcctag

SEQ ID NO: 80661 - DNA, 1152 bp, Artificial Sequence
  Description of Artificial Sequence: Synthetic coding sequence
atggagagactgcagaagcagcccctgaccagccccggcagcgtgagccccagcagagacagcagcgtgcccggcagccccagcagcatcgtggccaagatggacaaccaggtgctgggctacaaggacctggccgccatccccaaggacaaggccatcctggacatcgagagacccgacctgatgatctacgagccccacttcacctacagcctgctggagcacgtggagctgcccagaagcagagagagaagcctgagccccaagagcaccagccccccccccagccccgaggtgtgggccgacagcagaagccccggcatcatcagccaggccagcgcccccagaaccaccggcacccccagaaccagcctgccccacttccaccaccccgagaccagcagacccgacagcaacatctacaagaagccccccatctacaagcagagagagagcgtgggcggcagcccccagaccaagcacctgatcgaggacctgatcatcgagagcagcaagttccccgccgcccagccccccgaccccaaccagcccgccaagatcgagaccgactactggccctgcccccccagcctggccgtggtggagaccgagtggagaaagagaaaggccagcagaagaggcgccgaggaggaggaggaggaggaggacgacgacagcggcgaggagatgaaggccctgagagagagacagagagaggagctgagcaaggtgaccagcaacctgggcaagatgatcctgaaggaggagatggagaagagcctgcccatcagaagaaagaccagaagcctgcccgacagaacccccttccacaccagcctgcaccagggcaccagcaagagcagcagcctgcccgcctacggcagaaccaccctgagcagactgcagagcaccgagttcagccccagcggcagcgagaccggcagccccggcctgcagatctacccctacgagatgctggtggtgaccaacaagggcagaaccaagctgccccccggcgtggacagaatgagactggagagacacctgagcgccgaggacttcagcagagtgttcgccatgagccccgaggagttcggcaagctggccctgtggaagagaaacgagctgaagaagaaggccagcctgttctag

SEQ ID NO: 80662 - DNA, 1152 bp, Artificial Sequence; identical to SEQ ID NO: 80661
  Description of Artificial Sequence: Synthetic coding sequence

SEQ ID NO: 80663 - DNA, 1218 bp, Artificial Sequence; identical to SEQ ID NO: 80658
  Description of Artificial Sequence: Synthetic coding sequence

SEQ ID NO: 80664 - DNA, 1077 bp, Artificial Sequence
  Description of Artificial Sequence: Synthetic coding sequence
atggagagactgcagaaggccaagatggacaaccaggtgctgggctacaaggacctggccgccatccccaaggacaaggccatcctggacatcgagagacccgacctgatgatctacgagccccacttcacctacagcctgctggagcacgtggagctgcccagaagcagagagagaagcctgagccccaagagcaccagccccccccccagccccgaggtgtgggccgacagcagaagccccggcatcatcagccaggccagcgcccccagaaccaccggcacccccagaaccagcctgccccacttccaccaccccgagaccagcagacccgacagcaacatctacaagaagccccccatctacaagcagagagagagcgtgggcggcagcccccagaccaagcacctgatcgaggacctgatcatcgagagcagcaagttccccgccgcccagccccccgaccccaaccagcccgccaagatcgagaccgactactggccctgcccccccagcctggccgtggtggagaccgagtggagaaagagaaaggccagcagaagaggcgccgaggaggaggaggaggaggaggacgacgacagcggcgaggagatgaaggccctgagagagagacagagagaggagctgagcaaggtgaccagcaacctgggcaagatgatcctgaaggaggagatggagaagagcctgcccatcagaagaaagaccagaagcctgcccgacagaacccccttccacaccagcctgcaccagggcaccagcaagagcagcagcctgcccgcctacggcagaaccaccctgagcagactgcagagcaccgagttcagccccagcggcagcgagaccggcagccccggcctgcagatctacccctacgagatgctggtggtgaccaacaagggcagaaccaagctgccccccggcgtggacagaatgagactggagagacacctgagcgccgaggacttcagcagagtgttcgccatgagccccgaggagttcggcaagctggccctgtggaagagaaacgagctgaagaagaaggccagcctgttctag

SEQ ID NO: 80665 - DNA, 1152 bp, Artificial Sequence; identical to SEQ ID NO: 80661
  Description of Artificial Sequence: Synthetic coding sequence

SEQ ID NO: 80666 - DNA, 1218 bp, Artificial Sequence; identical to SEQ ID NO: 80658
  Description of Artificial Sequence: Synthetic coding sequence

SEQ ID NO: 80667 - DNA, 1098 bp, Artificial Sequence
  Description of Artificial Sequence: Synthetic coding sequence
atggagagactgcagaaggccaagatggacaaccaggtgctgggctacaaggacctggccgccatccccaaggacaaggccatcctggacatcgagagacccgacctgatgatctacgagccccacttcacctacagcctgctggagcacgtggagctgcccagaagcagagaggtgtgggccgacagcagaagccccggcatcatcagccaggccagcgcccccagaaccaccggcacccccagaaccagcctgccccacttccaccaccccgagaccagcagacccgacagcaacatctacaagaagccccccatctacaagcagagagagagcgtgggcggcagcccccagaccaagcacctgatcgaggacctgatcatcgagagcagcaagttccccgccgcccagccccccgaccccaaccagcccgccaagatcgagaccgactactggccctgcccccccagcctggccgtggtggagaccgagtggagaaagagaaaggccagcagaagaggcgccgaggaggaggaggaggaggaggacgacgacagcggcgaggagatgaaggccctgagagagagacagagagaggagctgagcaaggtgaccagcaacctgggcaagatgatcctgaaggaggagatggagaagagcctgcccatcagaagaaagaccagaagcctgcccgacagaacccccttccacaccagcctgcaccagggcaccagcaagagcagcagcctgcccgcctacggcagaaccaccctgagcagactgcagagcaccgagttcagccccagcggcagcgagaccggcagccccggcctgcagaacggcgagggccagagaggcagaatggacagaggcaacagcctgccctgcgtgctggagcagaagatctacccctacgagatgctggtggtgaccaacaagggcagaaccaagctgccccccggcgtggacagaatgagactggagagacacctgagcgccgaggacttcagcagagtgttcgccatgagccccgaggagttcggcaagctggccctgtggaagagaaacgagctgaagaagaaggccagcctgttctag

SEQ ID NO: 80668 - DNA, 570 bp, Artificial Sequence
  Description of Artificial Sequence: Synthetic coding sequence
atggacgccgtggacgccaccatggagaagctgagagcccagtgcctgagcagaggcgccagcggcatccagggcctggccagattcttcagacagctggacagagacggcagcagaagcctggacgccgacgagttcagacagggcctggccaagctgggcctggtgctggaccaggccgaggccgagggcgtgtgcagaaagtgggacagaaacggcagcggcaccctggacctggaggagttcctgagagccctgagaccccccatgagccaggccagagaggccgtgatcgccgccgccttcgccaagctggacagaagcggcgacggcgtggtgaccgtggacgacctgagaggcgtgtacagcggcagagcccaccccaaggtgagaagcggcgagtggaccgaggacgaggtgctgagaagattcctggacaacttcgacagcagcgagaaggacggccaggtgaccctggccgagttccaggactactacagcggcgtgagcgccagcatgaacaccgacgaggagttcgtggccatgatgaccagcgcctggcagctgtag

SEQ ID NO: 80669 - DNA, 2565 bp, Artificial Sequence
  Description of Artificial Sequence: Synthetic coding sequence
atggccctggagcaggccctgcaggccgccagacagggcgagctggacgtgctgagaagcctgcacgccgccggcctgctgggccccagcctgagagaccccctggacgccctgcccgtgcaccacgccgccagagccggcaagctgcactgcctgagattcctggtggaggaggccgccctgcccgccgccgccagagccagaaacggcgccacccccgcccacgacgccagcgccaccggccacctggcctgcctgcagtggctgctgagccagggcggctgcagagtgcaggacaaggacaacagcggcgccaccgtgctgcacctggccgccagattcggccaccccgaggtggtgaactggctgctgcaccacggcggcggcgaccccaccgccgccaccgacatgggcgccctgcccatccactacgccgccgccaagggcgacttccccagcctgagactgctggtggagcactaccccgagggcgtgaacgcccagaccaagaacggcgccacccccctgtacctggcctgccaggagggccacctggaggtgacccagtacctggtgcaggagtgcggcgccgacccccacgccagagcccacgacggcatgacccccctgcacgccgccgcccagatgggccacagccccgtgatcgtgtggctggtgagctgcaccgacgtgagcctgagcgagcaggacaaggacggcgccaccgccatgcacttcgccgccagcagaggccacaccaaggtgctgagctggctgctgctgcacggcggcgagatcagcgccgacctgtggggcggcacccccctgcacgacgccgccgagaacggcgagctggagtgctgccagatcctggtggtgaacggcgccgagctggacgtgagagacagagacggctacaccgccgccgacctgagcgacttcaacggccacagccactgcaccagatacctgagaaccgtggagaacctgagcgtggagcacagagtgctgagcagagaccccagcgccgagctggaggccaagcagcccgacagcggcatgagcagccccaacaccaccgtgagcgtgcagcccctgaacttcgacctgagcagccccaccagcaccctgagcaactacgacagctgcagcagcagccacagcagcatcaagggccagcaccccccctgcggcctgagcagcgccagagccgccgacatccagagctacatggacatgctgaaccccgagctgggcctgcccagaggcaccatcggcaagcccaccccccccccccccccccccagcttccccccccccccccccccccccggcacccagctgcccccccccccccccggctaccccgcccccaagccccccgtgggcccccaggccgccgacatctacatgcagaccaagaacaagctgagacacgtggagaccgaggccctgaagaaggagctgagcagctgcgacggccacgacggcctgagaagacaggacagcagcagaaagcccagagccttcagcaagcagcccagcaccggcgactactacagacagctgggcagatgccccggcgagaccctggccgccagacccggcatggcccacagcgaggaggtgagagccagacagcccgccagagccggctgccccagactgggccccgccgccagaggcagcctggagggccccagcgcccccccccaggccgccctgctgcccggcaaccacgtgcccaacggctgcgccgccgaccccaaggccagcagagagctgccccccccccccccccccccccccccccccctgcccgaggccgccagcagccccccccccgccccccccctgcccctggagagcgccggccccggctgcggccagagaagaagcagcagcagcaccggcagcaccaagagcttcaacatgatgagccccaccggcgacaacagcgagctgctggccgagatcaaggccggcaagagcctgaagcccaccccccagagcaagggcctgaccaccgtgttcagcggcatcggccagcccgccttccagcccgacagccccctgcccagcgtgagccccgccctgagccccgtgagaagccccaccccccccgccgccggcttccagcccctgctgaacggcagcctggtgcccgtgccccccaccacccccgcccccggcgtgcagctggacgtggaggccctgatccccacccacgacgagcagggcagacccatccccgagtggaagagacaggtgatggtgagaaagatgcagctgaagatgcaggaggaggaggagcagagaagaaaggaggaggaggaggaggccagactggccagcatgcccgcctggagaagagacctgctgagaaagaagctggaggaggagagagagcagaagagaaaggaggaggagagacagaagcaggaggagctgagaagagagaaggagcagagcgagaagctgagaaccctgggctacgacgagagcaagctggccccctggcagagacaggtgatcctgaagaagggcgacatcgccaagtactag

SEQ ID NO: 80670 - DNA, 867 bp, Artificial Sequence
  Description of Artificial Sequence: Synthetic coding sequence
atggcccacagcgaggaggccgccctgctgcccggcaaccacgtgcccaacggctgcgccgccgaccccaaggccagcagagagctgccccccccccccccccccccccccccccccctgcccgaggccgccagcagccccccccccgccccccccctgcccctggagagcgccggccccggctgcggccagagaagaagcagcagcagcaccggcagcaccaagagcttcaacatgatgagccccaccggcgacaacagcgagctgctggccgagatcaaggccggcaagagcctgaagcccaccccccagagcaagggcctgaccaccgtgttcagcggcatcggccagcccgccttccagcccgacagccccctgcccagcgtgagccccgccctgagccccgtgagaagccccaccccccccgccgccggcttccagcccctgctgaacggcagcctggtgcccgtgccccccaccacccccgcccccggcgtgcagctggacgtggaggccctgatccccacccacgacgagcagggcagacccatccccgagtggaagagacaggtgatggtgagaaagatgcagctgaagatgcaggaggaggaggagcagagaagaaaggaggaggaggaggaggccagactggccagcatgcccgcctggagaagagacctgctgagaaagaagctggaggaggagagagagcagaagagaaaggaggaggagagacagaagcaggaggagctgagaagagagaaggagcagagcgagaagctgagaaccctgggctacgacgagagcaagctggccccctggcagagacaggtgatcctgaagaagggcgacatcgccaagtactag

SEQ ID NO: 80671 - DNA, 645 bp, Artificial Sequence
  Description of Artificial Sequence: Synthetic coding sequence
gacggcatgacccccctgcacgccgccgcccagatgggccacagccccgtgatcgtgtggctggacaaggacggcgccaccgccatgcacttcgccgccagcagaggccacaccaaggtgctgagctggctgctgctgcacggcggcgagatcagcgccgacctgtggggcggcacccccctgcacgacgccgccgagaacggcgagctggagtgctgccagatcctggtggtgaacggcgccgagctggacgtgagagacagagacggctacaccgccgccgacctgagcgacttcaacggccacagccactgcaccagatacctgagaaccgtggagaacctgagcgtggagcacagagtgctgagcagagaccccagcgccgagctggaggccaagcagcccgacagcggcatgagcagccccaacaccaccgtgagcgtgcagcccctgaacttcgacctgagcagccccaccagcaccctgagcaactacgacagctgcagcagcagccacagcagcatcaagggccagcaccccccctgcggcctgagcagcgccagagccgccgacatccagagctacatggacatgctgaaccccgagctgggcctgcccagaggcaccatcggcaagcccacctag

SEQ ID NO: 80672 - DNA, 567 bp, Artificial Sequence
  Description of Artificial Sequence: Synthetic coding sequence
tgagagatcaaggccggcaagagcctgaagcccaccccccagagcaagggcctgaccaccgtgttcagcggcatcggccagcccgccttccagcccgacagccccctgcccagcgtgagccccgccctgagccccgtgagaagccccaccccccccgccgccggcttccagcccctgctgaacggcagcctggtgcccgtgccccccaccacccccgcccccggcgtgcagctggacgtggaggccctgatccccacccacgacgagcagggcagacccatccccgagtggaagagacaggtgatggtgagaaagatgcagctgaagatgcaggaggaggaggagcagagaagaaaggaggaggaggaggaggccagactggccagcatgcccgcctggagaagagacctgctgagaaagaagctggaggaggagagagagcagaagagaaaggaggaggagagacagaagcaggaggagctgagaagagagaaggagcagagcgagaagctgagaaccctgggctacgacgagagcaagctggccccctggcagagacagatctag

SEQ ID NO: 80673 - DNA, 1335 bp, Artificial Sequence
  Description of Artificial Sequence: Synthetic coding sequence
atggccagagtgggccccggcagagccggcgtgagctgccagggcagaggcagaggcagaggcggcagcggccagagaagaccccccacctgggagatcagcgacagcgacgccgaggacagcgccggcagcgaggccgccgccagagccagagaccccgccggcgagagaagagccgccgccgaggccctgagactgctgagacccgagcaggtgctgaagagactggccgtgtgcgtggacaccgccatcctggaggacgccggcgccgacgtgctgatggaggccctggaggccctgggctgcgagtgcagaatcgagccccagagacccgccagaagcctgagatggaccagagccagccccgacccctgccccagaagcctgccccccgaggtgtgggccgccggcgagcaggagctgctgctgctgctggagcccgaggagttcctgcagggcgtggccaccctgacccagatcagcggccccacccactgggtgccctggatcagccccgagaccaccgccagaccccacctggccgtgatcggcctggacgcctacctgtggtacagaagcctgagctgcccccagcagggctggctgggcagaggcttcagaggcggcggcctgtggcagagacccagcagcggcagagccggccccatgggcagcggcgaggagtggagccccctgctgagaagcagacagcacgtgagcagaggcacccagcagcccgagagccccaaggtggccggcgccgaggtggccgtgagctggcccgaggtggaggaggtgagagcctgcctgagctgggccctggtgctgctgcagctgtgggccaacctggacgtgctgctggtggccagctggcaggagctgagcagacacgtgtgcgccgtgaccaaggccctggcccagtaccccctgaagtgcgtgatgcccagactgaagggcggcagaatcaccagcagacagtacagagagagccaggccttcagcttctgcaccgccggcagatgggccgccggcgagcccgtggccagagacggcgccggcctgcaggccgcctggagaagacagatcagacagttcagcagagtgagccccgccgtggccgacgccgtggtgaccgccttccccagccccagactgctgcagcaggccctggaggcctgcagcaccgagagagagagaatgggcctgctggccgacctgcccgtgccccccagcgagggcggcagacccagaagagtgggccccgacctgagcagaagaatctgcctgttcctgaccaccgccaaccccgacctgctgctggacctgggcagctag

SEQ ID NO: 80674 - DNA, 1161 bp, Artificial Sequence
  Description of Artificial Sequence: Synthetic coding sequence
atggccagagtgggccccggcagagccggcgtgagctgccagggcagaggcagaggcagaggcggcagcggccagagaagaccccccacctgggagatcagcgacagcgacgccgaggacagcgccggcagcgaggccgccgccagagccagagaccccgccggcgagagaagagccgccgccgaggccctgagactgctgagacccgagcaggtgctgaagagactggccgtgtgcgtggacaccgccatcctggaggacgccggcgccgacgtgctgatggaggccctggaggccctgggctgcgagtgcagaatcgagccccagagacccgccagaagcctgagatggaccagagccagccccgacccctgccccagaagcctgccccccgaggtgtgggccgccggcgagcaggagctgctgctgctgctggagcccgaggagttcctgcagggcgtggccaccctgacccagatcagcggccccacccactgggtgccctggatcagccccgagaccaccgccagaccccacctggccgtgatcggcctggacgcctacctgtggagcagacagcacgtgagcagaggcacccagcagcccgagagccccaaggtggccggcgccgaggtggccgtgagctggcccgaggtggaggaggtgagagcctgcctgagctgggccctggtgctgctgcagctgtgggccaacctggacgtgctgctggtggccagctggcaggagctgagcagacacgtgtgcgccgtgaccaaggccctggcccagtaccccctgaagtgcgtgatgcccagactgaagggcggcagaatcaccagcagacagtacagagagagccaggccttcagcttctgcaccgccggcagatgggccgccggcgagcccgtggccagagacggcgccggcctgcaggccgcctggagaagacagatcagacagttcagcagagtgagccccgccgtggccgacgccgtggtgaccgccttccccagccccagactgctgcagcaggccctggaggcctgcagcaccgagagagagagaatgggcctgctggccgtgggccccgacctgagcagaagaatctgcctgttcctgaccaccgccaaccccgacctgctgctggacctgggcagctag

SEQ ID NO: 80675 - DNA, 2523 bp, Artificial Sequence
  Description of Artificial Sequence: Synthetic coding sequence
atgatgagcatccaggagaagagcaaggagaacagcagcaaggtgaccaagaagagcgacgacaagaacagcgagaccgagatccaggacagccagaagaacctggccaagaagagcggccccaaggagaccatcaagagccaggccaagagcagcagcgagagcaagatcaaccagcccgagctggagaccagaatgagcaccagaagcagcaaggccgccagcaacgacaaggccaccaagagcatcaacaagaacaccgtgaccgtgagaggctacagccaggagagcaccaagaagaagctgagccagaagaagctggtgcacgagaaccccaaggccaacgagcagctgaacagaagaagccagagactgcagcagctgaccgaggtgagcagaagaagcctgagaagcagagagatccagggccaggtgcaggccgtgaagcagagcctgccccccaccaagaaggagcagtgcagcagcacccagagcaagagcaacaagaccagccagaagcacgtgaagagaaaggtgctggaggtgaagagcgacagcaaggaggacgagaacctggtgatcaacgaggtgatcaacagccccaagggcaagaagagaaaggtggagcaccagaccgcctgcgcctgcagcagccagtgcacccagggcagcgagaagtgcccccagaagaccaccagaagagacgagaccaagcccgtgcccgtgaccagcgaggtgaagagaagcaagatggccaccagcgtggtgcccaagaagaacgagatgaagaagagcgtgcacacccaggtgaacaccaacaccaccctgcccaagagcccccagcccagcgtgcccgagcagagcgacaacgagctggagcaggccggcaagagcaagagaggcagcatcctgcagctgtgcgaggagatcgccggcgagatcgagagcgacaacgtggaggtgaagaaggagagcagccagatggagagcgtgaaggaggagaagcccaccgagatcaagctggaggagaccagcgtggagagacagatcctgcaccagaaggagaccaaccaggacgtgcagtgcaacagattcttccccagcagaaagaccaagcccgtgaagtgcatcctgaacggcatcaacagcagcgccaagaagaacagcaactggaccaagatcaagctgagcaagttcaacagcgtgcagcacaacaagctggacagccaggtgagccccaagctgggcctgctgagaaccagcttcagcccccccgccctggagatgcaccaccccgtgacccagagcaccttcctgggcaccaagctgcacgacagaaacatcacctgccagcaggagaagatgaaggagatcaacagcgaggaggtgaagatcaacgacatcaccgtggagatcaacaagaccaccgagagagcccccgagaactgccacctggccaacgagatcaagcccagcgacccccccctggacaaccagatgaagcacagcttcgacagcgccagcaacaagaacttcagccagtgcctggagagcaagctggagaacagccccgtggagaacgtgaccgccgccagcaccctgctgagccaggccaagatcgacaccggcgagaacaagttccccggcagcgccccccagcagcacagcatcctgagcaaccagaccagcaagagcagcgacaacagagagacccccagaaaccacagcctgcccaagtgcaacagccacctggagatcaccatccccaaggacctgaagctgaaggaggccgagaagaccgacgagaagcagctgatcatcgacgccggccagaagagattcggcgccgtgagctgcaacgtgtgcggcatgctgtacaccgccagcaaccccgaggacgagacccagcacctgctgttccacaaccagttcatcagcgccgtgaagtacgtgggctggaagaaggagagaatcctggccgagtaccccgacggcagaatcatcatggtgctgcccgaggaccccaagtacgccctgaagaaggtggacgagatcagagagatggtggacaacgacctgggcttccagcaggcccccctgatgtgctacagcagaaccaagaccctgctgttcatcagcaacgacaagaaggtggtgggctgcctgatcgccgagcacatccagtggggctacagagtgatcgaggagaagctgcccgtgatcagaagcgaggaggagaaggtgagattcgagagacagaaggcctggtgctgcagcaccctgcccgagcccgccatctgcggcatcagcagaatctgggtgttcagcatgatgagaagaaagaagatcgccagcagaatgatcgagtgcctgagaagcaacttcatctacggcagctacctgagcaaggaggagatcgccttcagcgaccccacccccgacggcaagctgttcgccacccagtactgcggcaccggccagttcctggtgtacaacttcatcaacggccagaacagcacctag

SEQ ID NO: 80676 - DNA, 2106 bp, Artificial Sequence
  Description of Artificial Sequence: Synthetic coding sequence
atgatgagcatccaggagaagagcaaggagaacagcagcaaggtgaccaagaagagcgacgacaagaacagcgagaccgagatccaggacagccagaagaacctggccaagaagagcggccccaaggagaccatcaagagccaggccaagagcagcagcgagagcaagatcaaccagcccgagctggagaccagaatgagcaccagaagcagcaaggccgccagcaacgacaaggccaccaagagcatcaacaagaacaccgtgaccgtgagaggctacagccaggagagcaccaagaagaagctgagccagaagaagctggtgcacgagaaccccaaggccaacgagcagctgaacagaagaagccagagactgcagcagctgaccgaggtgagcagaagaagcctgagaagcagagagatccagggccaggtgcaggccgtgaagcagagcctgccccccaccaagaaggagcagtgcagcagcacccagagcaagagcaacaagaccagccagaagcacgtgaagagaaaggtgctggaggtgaagagcgacagcaaggaggacgagaacctggtgatcaacgaggtgatcaacagccccaagggcaagaagagaaaggtggagcaccagaccgcctgcgcctgcagcagccagtgcacccagggcagcgagaagtgcccccagaagaccaccagaagagacgagaccaagcccgtgcccgtgaccagcgaggtgaagagaagcaagatggccaccagcgtggtgcccaagaagaacgagatgaagaagagcgtgcacacccaggtgaacaccaacaccaccctgcccaagagcccccagcccagcgtgcccgagcagagcgacaacgagctggagcaggccggcaagagcaagagaggcagcatcctgcagctgtgcgaggagatcgccggcgagatcgagagcgacaacgtggaggtgaagaaggagagcagccagatggagagcgtgaaggaggagaagcccaccgagatcaagctggaggagaccagcgtggagagacagatcctgcaccagaaggagaccaaccaggacgtgcagtgcaacagattcttccccagcagaaagaccaagcccgtgaagtgcatcctgaacggcatcaacagcagcgccaagaagaacagcaactggaccaagatcaagctgagcaagttcaacagcgtgcagcacaacaagctggacagccaggtgagccccaagctgggcctgctgagaaccagcttcagcccccccgccctggagatgcaccaccccgtgacccagagcaccttcctgggcaccaagctgcacgacagaaacatcacctgccagcaggagaagatgaaggagatcaacagcgaggaggtgaagatcaacgacatcaccgtggagatcaacaagaccaccgagagagcccccgagaactgccacctggccaacgagatcaagcccagcgacccccccctggacaaccagatgaagcacagcttcgacagcgccagcaacaagaacttcagccagtgcctggagagcaagctggagaacagccccgtggagaacgtgaccgccgccagcaccctgctgagccaggccaagatcgacaccggcgagaacaagttccccggcagcgccccccagcagcacagcatcctgagcaaccagaccagcaagagcagcgacaacagagagacccccagaaaccacagcctgcccaagtgcaacagccacctggagatcaccatccccaaggacctgaagctgaaggaggccgagaagaccgacgagaagcagctgatcatcgacgccggccagaagagattcggcgccgtgagctgcaacgtgtgcggcatgctgtacaccgccagcaaccccgaggacgagacccagcacctgctgttccacaaccagttcatcagcgccgtgaagtacgtggtgctgctgatcaaccaccacgagtgcggcagcgaggaggagttcatcaccagcctgttcctgagcatgttcaacttcagatacacccagagaagcttcagcttccccatcagattcctggagggcctggaggagagaaagaacagcggctag

SEQ ID NO: 80677 - DNA, 1806 bp, Artificial Sequence
  Description of Artificial Sequence: Synthetic coding sequence
atggccgccctgacccccagaaagagaaagcaggacagcctgaagtgcgacagcctgctgcacttcaccgagaacctgttccccagccccaacaagaagcactgcttctaccagaacagcgacaagaacgaggagaacctgcactgcagccagcaggagcacttcgtgctgagcgccctgaagaccaccgagatcaacagactgcccagcgccaaccagggcagccccttcaagagcgccctgagcaccgtgagcttctacaaccagaacaagtggtacctgaaccccctggagagaaagctgatcaaggagagcagaagcacctgcctgaagaccaacgacgaggacaagagcttccccatcgtgaccgagaagatgcagggcaagcccgtgtgcagcaagaagaacaacaagaagccccagaagagcctgaccgccaagtaccagcccaagtacagacacatcaagcccgtgagcagaaacagcagaaacagcaagcagaacagagtgatctacaagcccatcgtggagaaggagaacaactgccacagcgccgagaacaacagcaacgcccccagagtgctgagccagaagatcaagccccaggtgaccctgcagggcggcgccgccttcttcgtgagaaagaagagcagcctgagaaagagcagcctggagaacgagcccagcctgggcagaacccagaagagcaagagcgaggtgatcgaggacagcgacgtggagaccgtgagcgagaagaagaccttcgccaccagacaggtgcccaagtgcctggtgctggaggagaagctgaagatcggcctgctgagcgccagcagcaagaacaaggagaagctgatcaaggacagcagcgacgacagagtgagcagcaaggagcacaaggtggacaagaacgaggccttcagcagcgaggacagcctgggcgagaacaagaccatcagccccaagagcaccgtgtaccccatcttcagcgccagcagcgtgaacagcaagagaagcctgggcgaggagcagttcagcgtgggcagcgtgaacttcatgaagcagaccaacatccagaagaacaccaacaccagagacaccagcaagaagaccaaggaccagctgatcatcgacgccggccagaagcacttcggcgccaccgtgtgcaagagctgcggcatgatctacaccgccagcaaccccgaggacgagatgcagcacgtgcagcaccaccacagattcctggagggcatcaagtacgtgggctggaagaaggagagagtggtggccgagttctgggacggcaagatcgtgctggtgctgccccacgaccccagcttcgccatcaagaaggtggaggacgtgcaggagctggtggacaacgagctgggcttccagcaggtggtgcccaagtgccccaacaagatcaagaccttcctgttcatcagcgacgagaagagagtggtgggctgcctgatcgccgagcccatcaagcaggccttcagagtgctgagcgagcccatcggccccgagagccccagcagcaccgagtgccccagagcctggcagtgcagcgacgtgcccgagcccgccgtgtgcggcatcagcagaatctgggtgttcagactgaagagaagaaagagaatcgccagaagactggtggacaccctgagaaactgcttcatgttcggctgcttcctgagcaccgacgagatcgccttcagcgaccccacccccgacggcaagctgttcgccaccaagtactgcaacacccccaacttcctggtgtacaacttcaacagctag

SEQ ID NO: 80678 - DNA, 720 bp, Artificial Sequence
  Description of Artificial Sequence: Synthetic coding sequence
atgaagcagaccaacatccagaagaacaccaacaccagagacaccagcaagaagaccaaggaccagctgatcatcgacgccggccagaagcacttcggcgccaccgtgtgcaagagctgcggcatgatctacaccgccagcaaccccgaggacgagatgcagcacgtgcagcaccaccacagattcctggagggcatcaagtacgtgggctggaagaaggagagagtggtggccgagttctgggacggcaagatcgtgctggtgctgccccacgaccccagcttcgccatcaagaaggtggaggacgtgcaggagctggtggacaacgagctgggcttccagcaggtggtgcccaagtgccccaacaagatcaagaccttcctgttcatcagcgacgagaagagagtggtgggctgcctgatcgccgagcccatcaagcaggccttcagagtgctgagcgagcccatcggccccgagagccccagcagcaccgagtgccccagagcctggcagtgcagcgacgtgcccgagcccgccgtgtgcggcatcagcagaatctgggtgttcagactgaagagaagaaagagaatcgccagaagactggtggacaccctgagaaactgcttcatgttcggctgcttcctgagcaccgacgagatcgccttcagcgaccccacccccgacgactgcagaagactgaacagataccaggagacctag

SEQ ID NO: 80679 - DNA, 849 bp, Artificial Sequence
  Description of Artificial Sequence: Synthetic coding sequence
atggccctgaagcagatcagcagcaacaagtgcttcggcggcctgcagaaggtgttcgagcacgacagcgtggagctgaactgcaagatgaagttcgccgtgtacctgccccccaaggccgagaccggcaagtgccccgccctgtactggctgagcggcctgacctgcaccgagcagaacttcatcagcaagagcggctaccaccagagcgccagcgagcacggcctggtggtgatcgcccccgacaccagccccagaggctgcaacatcaagggcgaggacgagagctgggacttcggcaccggcgccggcttctacgtggacgccaccgaggacccctggaagaccaactacagaatgtacagctacgtgaccgaggagctgccccagctgatcaacgccaacttccccgtggacccccagagaatgagcatcttcggccacagcatgggcggccacggcgccctgatctgcgccctgaagaaccccggcaagtacaagagcgtgagcgccttcgcccccatctgcaaccccgtgctgtgcccctggggcaagaaggccttcagcggctacctgggcaccgaccagagcaagtggaaggcctacgacgccacccacctggtgaagagctaccccggcagccagctggacatcctgatcgaccagggcaaggacgaccagttcctgctggacggccagctgctgcccgacaacttcatcgccgcctgcaccgagaagaagatccccgtggtgttcagactgcaggagggctacgaccacagctactacttcatcgccaccttcatcaccgaccacatcagacaccacgccaagtacctgaacgcctag

SEQ ID NO: 80680 - DNA, 642 bp, Artificial Sequence
  Description of Artificial Sequence: Synthetic coding sequence
atggccatcacccagttcagactgttcaagttctgcacctgcctggccaccgtgttcagcttcctgaagagactgatctgcagaagcggcagaggcagaaagctgagcggcgaccagatcaccctgcccaccaccgtggactacagcagcgtgcccaagcagaccgacgtggaggagtggaccagctgggacgaggacgcccccaccagcgtgaagatcgagggcggcaacggcaacgtggccacccagcagaacagcctggagcagctggagcccgactacttcaaggacatgacccccaccatcagaaagacccagaagatcgtgatcaagaagagagagcccctgaacttcggcatccccgacggcagcaccggcttcagcagcagactggccgccacccaggacctgcccttcatccaccagagcagcgagctgggcgacctggacacctggcaggagaacaccaacgcctgggaggaggaggaggacgccgcctggcaggccgaggaggtgctgagacagcagaagctggccgacagagagaagagagccgccgagcagcagagaaagaagatggagaaggaggcccagagactgatgaagaaggagcagaacaagatcggcgtgaagctgagctag

SEQ ID NO: 80681 - DNA, 642 bp, Artificial Sequence; identical to SEQ ID NO: 80680
  Description of Artificial Sequence: Synthetic coding sequence

SEQ ID NO: 80682 - DNA, 594 bp, Artificial Sequence
  Description of Artificial Sequence: Synthetic coding sequence
atggccatcacccagttcagactgttcaagttctgcacctgcctggccaccgtgttcagcttcctgaagagactgatctgcagaagcggcagaggcagaaagctgagcggcgaccagatcaccctgcccaccaccgtggactacagcagcgtgcccaagcagaccgacgtggaggagtggaccagctgggacgaggacgcccccaccagcgtgaagatcgagggcggcaacggcaacgtggccacccagcagaacagcctggagcagctggagcccgactacttcaaggacatgacccccaccatcagaaagacccagaagatcgtgatcaagaagagagagcccctgaacttcggcatccccgacggcagcaccggcttcagcagcagactggccgccacccaggacctgcccttcatccaccagagcagcgagctgggcgacctggacacctggcaggagaacaccaacgcctgggaggaggaggaggacgccgcctggcaggccgaggaggtgctgagacagcagaagctggccgacagagagaagagagccgccgagcagcagagaaagaagatggagaaggaggcctag

SEQ ID NO: 80683 - DNA, 777 bp, Artificial Sequence
  Description of Artificial Sequence: Synthetic coding sequence
atggccatcacccagttcagactgttcaagttctgcacctgcctggccaccgtgttcagcttcctgaagagactgatctgcagaagcggcagaggcagaaagctgagcggcgaccagatcaccctgcccaccaccgtggactacagcagcgtgcccaagcagaccgacgtggaggagtggaccagctgggacgaggacgcccccaccagcgtgaagatcgagggcggcaacggcaacgtggccacccagcagaacagcctggagcagctggagcccgactacttcaaggacatgacccccaccatcagaaagacccagaagatcgtgatcaagaagagagagcccctgaacttcggcatccccgacggcagcaccggcttcagcagcagactggccgccacccaggacctgcccttcatccaccagagcagcgagctgggcgacctggacacctggcaggagaacaccaacgcctgggaggaggaggaggacgccgcctggcaggccgaggaggtgctgagaagcagaaccaacgtgtgcctgctgtgcagcctgctgttccaccaccccacccccaccagcaccccctacatcaaccagagcgtgaagatcgagagagtgagcctgggccagtggagctacggcaagagcaaggagcagcagaagctggccgacagagagaagagagccgccgagcagcagagaaagaagatggagaaggaggcccagagactgatgaagaaggagcagaacaagatcggcgtgaagctgagctag

SEQ ID NO: 80684 - DNA, 237 bp, Artificial Sequence
  Description of Artificial Sequence: Synthetic coding sequence
atggccatcacccagttcagactgttcaagttctgcacctgcctggccaccgtgttcagcttcctgaagagactgatctgcagaagcggcagaggcagaaagctgagcggcgaccagatcaccctgcccaccaccgtggactacagcagcgtgcccaagcagaccgacgtggaggagtggaccagctgggacgaggacgcccccaccagcgtgaagatcgagggcggcaacggctag

SEQ ID NO: 80685 - DNA, 1272 bp, Artificial Sequence
  Description of Artificial Sequence: Synthetic coding sequence
atgagcagccaggtggtgggcatcgagcccctgtacatcaaggccgagcccgccagccccgacagccccaagggcagcagcgagaccgagaccgagccccccgtggccctggcccccggccccgcccccaccagatgcctgcccggccacaaggaggaggaggacggcgagggcgccggccccggcgagcagggcggcggcaagctggtgctgagcagcctgcccaagagactgtgcctggtgtgcggcgacgtggccagcggctaccactacggcgtggccagctgcgaggcctgcaaggccttcttcaagagaaccatccagggcagcatcgagtacagctgccccgccagcaacgagtgcgagatcaccaagagaagaagaaaggcctgccaggcctgcagattcaccaagtgcctgagagtgggcatgctgaaggagggcgtgagactggacagagtgagaggcggcagacagaagtacaagagaagacccgaggtggaccccctgcccttccccggccccttccccgccggccccctggccgtggccggcggccccagaaagaccgccgcccccgtgaacgccctggtgagccacctgctggtggtggagcccgagaagctgtacgccatgcccgaccccgccggccccgacggccacctgcccgccgtggccaccctgtgcgacctgttcgacagagagatcgtggtgaccatcagctgggccaagagcatccccggcttcagcagcctgagcctgagcgaccagatgagcgtgctgcagagcgtgtggatggaggtgctggtgctgggcgtggcccagagaagcctgcccctgcaggacgagctggccttcgccgaggacctggtgctggacgaggagggcgccagagccgccggcctgggcgagctgggcgccgccctgctgcagctggtgagaagactgcaggccctgagactggagagagaggagtacgtgctgctgaaggccctggccctggccaacagcgacagcgtgcacatcgaggacgccgaggccgtggagcagctgagagaggccctgcacgaggccctgctggagtacgaggccggcagagccggccccggcggcggcgccgagagaagaagagccggcagactgctgctgaccctgcccctgctgagacagaccgccggcaaggtgctggcccacttctacggcgtgaagctggagggcaaggtgcccatgcacaagctgttcctggagatgctggaggccatgatggactag

SEQ ID NO: 80686 - DNA, 1272 bp, Artificial Sequence; identical to SEQ ID NO: 80685
  Description of Artificial Sequence: Synthetic coding sequence

SEQ ID NO: 80687 - DNA, 1269 bp, Artificial Sequence
  Description of Artificial Sequence: Synthetic coding sequence
atgagcagccaggtggtgggcatcgagcccctgtacatcaaggccgagcccgccagccccgacagccccaagggcagcagcgagaccgagaccgagccccccgtggccctggcccccggccccgcccccaccagatgcctgcccggccacaaggaggaggaggacggcgagggcgccggccccggcgagcagggcggcggcaagctggtgctgagcagcctgcccaagagactgtgcctggtgtgcggcgacgtggccagcggctaccactacggcgtggccagctgcgaggcctgcaaggccttcttcaagagaaccatccagggcagcatcgagtacagctgccccgccagcaacgagtgcgagatcaccaagagaagaagaaaggcctgccaggcctgcagattcaccaagtgcctgagagtgggcatgctgaaggagggcgtgagactggacagagtgagaggcggcagacagaagtacaagagaagacccgaggtggaccccctgcccttccccggccccttccccgccggccccctggccgtggccggcggccccagaaagaccgcccccgtgaacgccctggtgagccacctgctggtggtggagcccgagaagctgtacgccatgcccgaccccgccggccccgacggccacctgcccgccgtggccaccctgtgcgacctgttcgacagagagatcgtggtgaccatcagctgggccaagagcatccccggcttcagcagcctgagcctgagcgaccagatgagcgtgctgcagagcgtgtggatggaggtgctggtgctgggcgtggcccagagaagcctgcccctgcaggacgagctggccttcgccgaggacctggtgctggacgaggagggcgccagagccgccggcctgggcgagctgggcgccgccctgctgcagctggtgagaagactgcaggccctgagactggagagagaggagtacgtgctgctgaaggccctggccctggccaacagcgacagcgtgcacatcgaggacgccgaggccgtggagcagctgagagaggccctgcacgaggccctgctggagtacgaggccggcagagccggccccggcggcggcgccgagagaagaagagccggcagactgctgctgaccctgcccctgctgagacagaccgccggcaaggtgctggcccacttctacggcgtgaagctggagggcaaggtgcccatgcacaagctgttcctggagatgctggaggccatgatggactag

SEQ ID NO: 80688 - DNA, 330 bp, Artificial Sequence
  Description of Artificial Sequence: Synthetic coding sequence
atgagcagccaggtggtgggcatcgagcccctgtacatcaaggccgagcccgccagccccgacagccccaagggcagcagcgagaccgagaccgagccccccgtggccctggcccccggccccgcccccaccagatgcctgcccggccacaaggaggaggaggacggcgagggcgccggccccggcgagcagggcggcggcaagctggtgctgagcagcctgcccaagagactgtgcctggtgtgcggcgacgtggccagcggctaccactacggcgtggccagctgcgaggcctgcaaggccttcttcaagagaaccatccagggctag

SEQ ID NO: 80689 - DNA, 1503 bp, Artificial Sequence
  Description of Artificial Sequence: Synthetic coding sequence
atgagcagcgacgacagacacctgggcagcagctgcggcagcttcatcaagaccgagcccagcagccccagcagcggcatcgacgccctgagccaccacagccccagcggcagcagcgacgccagcggcggcttcggcctggccctgggcacccacgccaacggcctggacagcccccccatgttcgccggcgccggcctgggcggcaccccctgcagaaagagctacgaggactgcgccagcggcatcatggaggacagcgccatcaagtgcgagtacatgctgaacgccatccccaagagactgtgcctggtgtgcggcgacatcgccagcggctaccactacggcgtggccagctgcgaggcctgcaaggccttcttcaagagaaccatccagggcaacatcgagtacagctgccccgccaccaacgagtgcgagatcaccaagagaagaagaaagagctgccaggcctgcagattcatgaagtgcctgaaggtgggcatgctgaaggagggcgtgagactggacagagtgagaggcggcagacagaagtacaagagaagactggacagcgagagcagcccctacctgagcctgcagatcagcccccccgccaagaagcccctgaccaagatcgtgagctacctgctggtggccgagcccgacaagctgtacgccatgcccccccccggcatgcccgagggcgacatcaaggccctgaccaccctgtgcgacctggccgacagagagctggtggtgatcatcggctgggccaagcacatccccggcttcagcagcctgagcctgggcgaccagatgagcctgctgcagagcgcctggatggagatcctgatcctgggcatcgtgtacagaagcctgccctacgacgacaagctggtgtacgccgaggactacatcatggacgaggagcacagcagactggccggcctgctggagctgtacagagccatcctgcagctggtgagaagatacaagaagctgaaggtggagaaggaggagttcgtgaccctgaaggccctggccctggccaacagcgacagcatgtacatcgaggacctggaggccgtgcagaagctgcaggacctgctgcacgaggccctgcaggactacgagctgagccagagacacgaggagccctggagaaccggcaagctgctgctgaccctgcccctgctgagacagaccgccgccaaggccgtgcagcacttctacagcgtgaagctgcagggcaaggtgcccatgcacaagctgttcctggagatgctggaggccaaggcctgggccagagccgacagcctgcaggagtggagacccctggagcaggtgcccagccccctgcacagagccaccaagagacagcacgtgcacttcctgacccccctgccccccccccccagcgtggcctgggtgggcaccgcccaggccggctaccacctggaggtgttcctgccccagagagccggctggcccagagccgcctag

SEQ ID NO: 80690 - DNA, 1527 bp, Artificial Sequence
  Description of Artificial Sequence: Synthetic coding sequence
atgagcagcgacgacagacacctgggcagcagctgcggcagcttcatcaagaccgagcccagcagccccagcagcggcatcgacgccctgagccaccacagccccagcggcagcagcgacgccagcggcggcttcggcctggccctgggcacccacgccaacggcctggacagcccccccatgttcgccggcgccggcctgggcggcaccccctgcagaaagagctacgaggactgcgccagcggcatcatggaggacagcgccatcaagtgcgagtacatgctgaacgccatccccaagagactgtgcctggtgtgcggcgacatcgccagcggctaccactacggcgtggccagctgcgaggcctgcaaggccttcttcaagagaaccatccagggcaacatcgagtacagctgccccgccaccaacgagtgcgagatcaccaagagaagaagaaagagctgccaggcctgcagattcatgaagtgcctgaaggtgggcatgctgaaggagggcgtgagactggacagagtgagaggcggcagacagaagtacaagagaagactggacagcgagagcagcccctacctgagcctgcagatcagcccccccgccaagaagcccctgaccaagatcgtgagctacctgctggtggccgagcccgacaagctgtacgccatgcccccccccggcatgcccgagggcgacatcaaggccctgaccaccctgtgcgacctggccgacagagagctggtggtgatcatcggctgggccaagcacatccccggcttcagcagcctgagcctgggcgaccagatgagcctgctgcagagcgcctggatggagatcctgatcctgggcatcgtgtacagaagcctgccctacgacgacaagctggtgtacgccgaggactacatcatggacgaggagcacagcagactggccggcctgctggagctgtacagagccatcctgcagctggtgagaagatacaagaagctgaaggtggagaaggaggagttcgtgaccctgaaggccctggccctggccaacagcgacagcatgtacatcgaggacctggaggccgtgcagaagctgcaggacctgctgcacgaggccctgcaggactacgagctgagccagagacacgaggagccctggagaaccggcaagctgctgctgaccctgcccctgctgagacagaccgccgccaaggccgtgcagcacttctacagcgtgaagctgcagggcaaggtgcccatgcacaagctgttcctggagatgctggaggccaaggtgggccaggagcagctgagaggcagccccaaggacgagagaatgagcagccacgacggcaagtgccccttccagagcgccgccttcaccagcagagaccagagcaacagccccggcatccccaaccccagacccagcagccccacccccctgaacgagagaggcagacagatcagccccagcaccagaacccccggcggccagggcaagcacctgtggctgaccatgtag

SEQ ID NO: 80691 - DNA, 1503 bp, Artificial Sequence; identical to SEQ ID NO: 80689
  Description of Artificial Sequence: Synthetic coding sequence

SEQ ID NO: 80692 - DNA, 1527 bp, Artificial Sequence; identical to SEQ ID NO: 80690
  Description of Artificial Sequence: Synthetic coding sequence

SEQ ID NO: 80693 - DNA, 1527 bp, Artificial Sequence
  Description of Artificial Sequence: Synthetic coding sequence
atgctgctgaacagaatgagcagcgacgacagacacctgggcagcagctgcggcagcttcatcaagaccgagcccagcagccccagcagcggcatcgacgccctgagccaccacagccccagcggcagcagcgacgccagcggcggcttcggcctggccctgggcacccacgccaacggcctggacagcccccccatgttcgccggcgccggcctgggcggcaccccctgcagaaagagctacgaggactgcgccagcggcatcatggaggacagcgccatcaagtgcgagtacatgctgaacgccatccccaagagactgtgcctggtgtgcggcgacatcgccagcggctaccactacggcgtggccagctgcgaggcctgcaaggccttcttcaagagaaccatccagggcaacatcgagtacagctgccccgccaccaacgagtgcgagatcaccaagagaagaagaaagagctgccaggcctgcagattcatgaagtgcctgaaggtgggcatgctgaaggagggcgtgagactggacagagtgagaggcggcagacagaagtacaagagaagactggacagcgagagcagcccctacctgagcctgcagatcagcccccccgccaagaagcccctgaccaagatcgtgagctacctgctggtggccgagcccgacaagctgtacgccatgcccccccccggcatgcccgagggcgacatcaaggccctgaccaccctgtgcgacctggccgacagagagctggtggtgatcatcggctgggccaagcacatccccggcttcagcagcctgagcctgggcgaccagatgagcctgctgcagagcgcctggatggagatcctgatcctgggcatcgtgtacagaagcctgccctacgacgacaagctggtgtacgccgaggactacatcatggacgaggagcacagcagactggccggcctgctggagctgtacagagccatcctgcagctggtgagaagatacaagaagctgaaggtggagaaggaggagttcgtgaccctgaaggccctggccctggccaacagcgacagcatgtacatcgaggacctggaggccgtgcagaagctgcaggacctgctgcacgaggccctgcaggactacgagctgagccagagacacgaggagccctggagaaccggcaagctgctgctgaccctgcccctgctgagacagaccgccgccaaggccgtgcagcacttctacagcgtgaagctgcagggcaaggtgcccatgcacaagctgttcctggagatgctggaggccaaggtgggccaggagcagctgagaggcagccccaaggacgagagaatgagcagccacgacggcaagtgccccttccagagcgccgccttcaccagcagagaccagagcaacagccccggcatccccaaccccagacccagcagccccacccccctgaacgagagaggcagacagatcagccccagcaccagaacccccggcggccagggcaagcactag

SEQ ID NO: 80694 - DNA, 1302 bp, Artificial Sequence
  Description of Artificial Sequence: Synthetic coding sequence
atgagcagcgacgacagacacctgggcagcagctgcggcagcttcatcaagaccgagcccagcagccccagcagcggcatcgacgccctgagccaccacagccccagcggcagcagcgacgccagcggcggcttcggcctggccctgggcacccacgccaacggcctggacagcccccccatgttcgccggcgccggcctgggcggcaccccctgcagaaagagctacgaggactgcgccagcggcatcatggaggacagcgccatcaagtgcgagtacatgctgaacgccatccccaagagactgtgcctggtgtgcggcgacatcgccagcggctaccactacggcgtggccagctgcgaggcctgcaaggccttcttcaagagaaccatccagggcaacatcgagtacagctgccccgccaccaacgagtgcgagatcaccaagagaagaagaaagagctgccaggcctgcagattcatgaagtgcctgaaggtgggcatgctgaaggagggcgtgagactggacagagtgagaggcggcagacagaagtacaagagaagactggacagcgagagcagcccctacctgagcctgcagatcagcccccccgccaagaagcccctgaccaagatcgtgagctacctgctggtggccgagcccgacaagctgtacgccatgcccccccccggcatgcccgagggcgacatcaaggccctgaccaccctgtgcgacctggccgacagagagctggtggtgatcatcggctgggccaagcacatccccggcttcagcagcctgagcctgggcgaccagatgagcctgctgcagagcgcctggatggagatcctgatcctgggcatcgtgtacagaagcctgccctacgacgacaagctggtgtacgccgaggactacatcatggacgaggagcacagcagactggccggcctgctggagctgtacagagccatcctgcagctggtgagaagatacaagaagctgaaggtggagaaggaggagttcgtgaccctgaaggccctggccctggccaacagcgacagcatgtacatcgaggacctggaggccgtgcagaagctgcaggacctgctgcacgaggccctgcaggactacgagctgagccagagacacgaggagccctggagaaccggcaagctgctgctgaccctgcccctgctgagacagaccgccgccaaggccgtgcagcacttctacagcgtgaagctgcagggcaaggtgcccatgcacaagctgttcctggagatgctggaggccaaggtgtag

SEQ ID NO: 80695 - DNA, 1311 bp, Artificial Sequence
  Description of Artificial Sequence: Synthetic coding sequence
atgagcaacaaggacagacacatcgacagcagctgcagcagcttcatcaagaccgagcccagcagccccgccagcctgaccgacagcgtgaaccaccacagccccggcggcagcagcgacgccagcggcagctacagcagcaccatgaacggccaccagaacggcctggacagcccccccctgtaccccagcgcccccatcctgggcggcagcggccccgtgagaaagctgtacgacgactgcagcagcaccatcgtggaggacccccagaccaagtgcgagtacatgctgaacagcatgcccaagagactgtgcctggtgtgcggcgacatcgccagcggctaccactacggcgtggccagctgcgaggcctgcaaggccttcttcaagagaaccatccagggcaacatcgagtacagctgccccgccaccaacgagtgcgagatcaccaagagaagaagaaagagctgccaggcctgcagattcatgaagtgcctgaaggtgggcatgctgaaggagggcgtgagactggacagagtgagaggcggcagacagaagtacaagagaagaatcgacgccgagaacagcccctacctgaacccccagctggtgcagcccgccaagaagccctacaacaagatcgtgagccacctgctggtggccgagcccgagaagatctacgccatgcccgaccccaccgtgcccgacagcgacatcaaggccctgaccaccctgtgcgacctggccgacagagagctggtggtgatcatcggctgggccaagcacatccccggcttcagcaccctgagcctggccgaccagatgagcctgctgcagagcgcctggatggagatcctgatcctgggcgtggtgtacagaagcctgagcttcgaggacgagctggtgtacgccgacgactacatcatggacgaggaccagagcaagctggccggcctgctggacctgaacaacgccatcctgcagctggtgaagaagtacaagagcatgaagctggagaaggaggagttcgtgaccctgaaggccatcgccctggccaacagcgacagcatgcacatcgaggacgtggaggccgtgcagaagctgcaggacgtgctgcacgaggccctgcaggactacgaggccggccagcacatggaggaccccagaagagccggcaagatgctgatgaccctgcccctgctgagacagaccagcaccaaggccgtgcagcacttctacaacatcaagctggagggcaaggtgcccatgcacaagctgttcctggagatgctggaggccaaggtgtgctag

SEQ ID NO: 80696 - DNA, 1308 bp, Artificial Sequence
  Description of Artificial Sequence: Synthetic coding sequence
atgagcaacaaggacagacacatcgacagcagctgcagcagcttcatcaagaccgagcccagcagccccgccagcctgaccgacagcgtgaaccaccacagccccggcggcagcagcgacgccagcggcagctacagcagcaccatgaacggccaccagaacggcctggacagcccccccctgtaccccagcgcccccatcctgggcggcagcggccccgtgagaaagctgtacgacgactgcagcagcaccatcgtggaggacccccagaccaagtgcgagtacatgctgaacagcatgcccaagagactgtgcctggtgtgcggcgacatcgccagcggctaccactacggcgtggccagctgcgaggcctgcaaggccttcttcaagagaaccatccagggcaacatcgagtacagctgccccgccaccaacgagtgcgagatcaccaagagaagaagaaagagctgccaggcctgcagattcatgaagtgcctgaaggtgggcatgctgaaggagggcgtgagactggacagagtgagaggcggcagacagaagtacaagagaagaatcgacgccgagaacagcccctacctgaacccccagctggtgcagcccgccaagaagccctacaacaagatcgtgagccacctgctggtggccgagcccgagaagatctacgccatgcccgaccccaccgtgcccgacagcgacatcaaggccctgaccaccctgtgcgacctggccgacagagagctggtggtgatcatcggctgggccaagcacatccccggcttcagcaccctgagcctggccgaccagatgagcctgctgcagagcgcctggatggagatcctgatcctgggcgtggtgtacagaagcctgagcttcgaggacgagctggtgtacgccgacgactacatcatggacgaggaccagagcaagctggccggcctgctggacctgaacaacgccatcctgcagctggtgaagaagtacaagagcatgaagctggagaaggaggagttcgtgaccctgaaggccatcgccctggccaacagcgacagcatgcacatcgaggacgtggaggccgtgcagaagctgcaggacgtgctgcacgaggccctgcaggactacgaggccggccagcacatggaggaccccagaagagccggcaagatgctgatgaccctgcccctgctgagacagaccagcaccaaggccgtgcagcacttctacaacatcaagctggagggcaaggtgcccatgcacaagctgttcctggagatgctggaggccaaggtgtag

SEQ ID NO: 80697 - DNA, 1308 bp, Artificial Sequence; identical to SEQ ID NO: 80696
  Description of Artificial Sequence: Synthetic coding sequence

SEQ ID NO: 80698 - DNA, 1308 bp, Artificial Sequence; identical to SEQ ID NO: 80696
  Description of Artificial Sequence: Synthetic coding sequence

SEQ ID NO: 80699 - DNA, 1308 bp, Artificial Sequence; identical to SEQ ID NO: 80696
  Description of Artificial Sequence: Synthetic coding sequence

SEQ ID NO: 80700 - DNA, 1308 bp, Artificial Sequence; identical to SEQ ID NO: 80696
  Description of Artificial Sequence: Synthetic coding sequence

SEQ ID NO: 80701 - DNA, 1308 bp, Artificial Sequence; identical to SEQ ID NO: 80696
  Description of Artificial Sequence: Synthetic coding sequence

SEQ ID NO: 80702 - DNA, 1329 bp, Artificial Sequence
  Description of Artificial Sequence: Synthetic coding sequence
atgagcaacaaggacagacacatcgacagcagctgcagcagcttcatcaagaccgagcccagcagccccgccagcctgaccgacagcgtgaaccaccacagccccggcggcagcagcgacgccagcggcagctacagcagcaccatgaacggccaccagaacggcctggacagcccccccctgtaccccagcgcccccatcctgggcggcagcggccccgtgagaaagctgtacgacgactgcagcagcaccatcgtggaggacccccagaccaagtgcgagtacatgctgaacagcatgcccaagagactgtgcctggtgtgcggcgacatcgccagcggctaccactacggcgtggccagctgcgaggcctgcaaggccttcttcaagagaaccatccagggcaacatcgagtacagctgccccgccaccaacgagtgcgagatcaccaagagaagaagaaagagctgccaggcctgcagattcatgaagtgcctgaaggtgggcatgctgaaggagggcgtgagactggacagagtgagaggcggcagacagaagtacaagagaagaatcgacgccgagaacagcccctacctgaacccccagctggtgcagcccgccaagaagcccctgctgtggagcgaccccgccgacaacaagatcgtgagccacctgctggtggccgagcccgagaagatctacgccatgcccgaccccaccgtgcccgacagcgacatcaaggccctgaccaccctgtgcgacctggccgacagagagctggtggtgatcatcggctgggccaagcacatccccggcttcagcaccctgagcctggccgaccagatgagcctgctgcagagcgcctggatggagatcctgatcctgggcgtggtgtacagaagcctgagcttcgaggacgagctggtgtacgccgacgactacatcatggacgaggaccagagcaagctggccggcctgctggacctgaacaacgccatcctgcagctggtgaagaagtacaagagcatgaagctggagaaggaggagttcgtgaccctgaaggccatcgccctggccaacagcgacagcatgcacatcgaggacgtggaggccgtgcagaagctgcaggacgtgctgcacgaggccctgcaggactacgaggccggccagcacatggaggaccccagaagagccggcaagatgctgatgaccctgcccctgctgagacagaccagcaccaaggccgtgcagcacttctacaacatcaagctggagggcaaggtgcccatgcacaagctgttcctggagatgctggaggccaaggtgtag

SEQ ID NO: 80703 - DNA, 1377 bp, Artificial Sequence
  Description of Artificial Sequence: Synthetic coding sequence
atggacagcgtggagctgtgcctgcccgagagcttcagcctgcactacgaggaggagctgctgtgcagaatgagcaacaaggacagacacatcgacagcagctgcagcagcttcatcaagaccgagcccagcagccccgccagcctgaccgacagcgtgaaccaccacagccccggcggcagcagcgacgccagcggcagctacagcagcaccatgaacggccaccagaacggcctggacagcccccccctgtaccccagcgcccccatcctgggcggcagcggccccgtgagaaagctgtacgacgactgcagcagcaccatcgtggaggacccccagaccaagtgcgagtacatgctgaacagcatgcccaagagactgtgcctggtgtgcggcgacatcgccagcggctaccactacggcgtggccagctgcgaggcctgcaaggccttcttcaagagaaccatccagggcaacatcgagtacagctgccccgccaccaacgagtgcgagatcaccaagagaagaagaaagagctgccaggcctgcagattcatgaagtgcctgaaggtgggcatgctgaaggagggcgtgagactggacagagtgagaggcggcagacagaagtacaagagaagaatcgacgccgagaacagcccctacctgaacccccagctggtgcagcccgccaagaagccctacaacaagatcgtgagccacctgctggtggccgagcccgagaagatctacgccatgcccgaccccaccgtgcccgacagcgacatcaaggccctgaccaccctgtgcgacctggccgacagagagctggtggtgatcatcggctgggccaagcacatccccggcttcagcaccctgagcctggccgaccagatgagcctgctgcagagcgcctggatggagatcctgatcctgggcgtggtgtacagaagcctgagcttcgaggacgagctggtgtacgccgacgactacatcatggacgaggaccagagcaagctggccggcctgctggacctgaacaacgccatcctgcagctggtgaagaagtacaagagcatgaagctggagaaggaggagttcgtgaccctgaaggccatcgccctggccaacagcgacagcatgcacatcgaggacgtggaggccgtgcagaagctgcaggacgtgctgcacgaggccctgcaggactacgaggccggccagcacatggaggaccccagaagagccggcaagatgctgatgaccctgcccctgctgagacagaccagcaccaaggccgtgcagcacttctacaacatcaagctggagggcaaggtgcccatgcacaagctgttcctggagatgctggaggccaaggtgtag

SEQ ID NO: 80704 - DNA, 171 bp, Artificial Sequence
  Description of Artificial Sequence: Synthetic coding sequence
atgagcaacaaggacagacacatcgacagcagctgcagcagcttcatcaagaccgagcccagcagccccgccagcctgaccgacagcgtgaaccaccacagccccggcggcagcagcgacgccagcggcagctacagcagcaccatgaacggccaccagaacggcctgtag

SEQ ID NO: 80705 - DNA, 279 bp, Artificial Sequence
  Description of Artificial Sequence: Synthetic coding sequence
atgagcaacaaggacagacacatcgacagcagctgcagcagcttcatcaagaccgagcccagcagccccgccagcctgaccgacagcgtgaaccaccacagccccggcggcagcagcgacgccagcggcagctacagcagcaccatgaacggccaccagaacggcctggacagcccccccctgtaccccagcgcccccatcctgggcggcagcggccccgtgagaaagctgtacgacgactgcagcagcaccatcgtggaggacccccagaccaagtag

SEQ ID NO: 80706 - DNA, 1065 bp, Artificial Sequence
  Description of Artificial Sequence: Synthetic coding sequence
atgagcaacaaggacagacacatcgacagcagctgcagcagcttcatcaagaccgagcccagcagccccgccagcctgaccgacagcgtgaaccaccacagccccggcggcagcagcgacgccagcggcagctacagcagcaccatgaacggccaccagaacggcctggacagcccccccctgtaccccagcgcccccatcctgggcggcagcggccccgtgagaaagctgtacgacgactgcagcagcaccatcgtggaggacccccagaccaagtgcgagtacatgctgaacagcatgcccaagagactgtgcctggtgtgcggcgacatcgccagcggctaccactacggcgtggccagctgcgaggcctgcaaggccttcttcaagagaaccatccagggcaacatcgagtacagctgccccgccaccaacgagtgcgagatcaccaagagaagaagaaagagctgccaggcctgcagattcatgaagtgcctgaaggtgggcatgctgaaggagggcgtgagactggacagagtgagaggcggcagacagaagtacaagagaagaatcgacgccgagaacagcccctacctgaacccccagctggtgcagcccgccaagaagccctacaacaagatcgtgagccacctgctggtggccgagcccgagaagatctacgccatgcccgaccccaccgtgcccgacagcgacatcaaggccctgaccaccctgtgcgacctggccgacagagagctggtggtgatcatcggctgggccaagcacatccccggcttcagcaccctgagcctggccgaccagatgagcctgctgcagagcgcctggatggagatcctgatcctgggcgtggtgtacagaagcctgagcttcgaggacgagctggtgtacgccgacgactacatcatggacgaggaccagagcaagctggccggcctgctggacctgaacaacgccatcctgcagctggtgaagaagtacaagagcatgaagctggagaaggaggagttcgtgaccctgaaggccatcgccctggccaacagctag

SEQ ID NO: 80707 - DNA, 153 bp, Artificial Sequence
  Description of Artificial Sequence: Synthetic coding sequence
atgagcaacaaggacagacacatcgacagcagctgcagcagcttcatcaagaccgagcccagcagccccgccagcctgaccgacagcgtgaaccaccacagccccggcggcagcagcgacgccagcggcagctacagcagcaccatgaactag

SEQ ID NO: 80708 - DNA, 1308 bp, Artificial Sequence; identical to SEQ ID NO: 80696
  Description of Artificial Sequence: Synthetic coding sequence

SEQ ID NO: 80709 - DNA, 1308 bp, Artificial Sequence; identical to SEQ ID NO: 80696
  Description of Artificial Sequence: Synthetic coding sequence

SEQ ID NO: 80710 - DNA, 1308 bp, Artificial Sequence; identical to SEQ ID NO: 80696
  Description of Artificial Sequence: Synthetic coding sequence

SEQ ID NO: 80711 - DNA, 1413 bp, Artificial Sequence
  Description of Artificial Sequence: Synthetic coding sequence
atgtggagagagtgcgactggggcctgggcgccgtgaagagcgacctggcctgcgtgcccagcgccaagagactgctgtgcagaatgagcaacaaggacagacacatcgacagcagctgcagcagcttcatcaagaccgagcccagcagccccgccagcctgaccgacagcgtgaaccaccacagccccggcggcagcagcgacgccagcggcagctacagcagcaccatgaacggccaccagaacggcctggacagcccccccctgtaccccagcgcccccatcctgggcggcagcggccccgtgagaaagctgtacgacgactgcagcagcaccatcgtggaggacccccagaccaagtgcgagtacatgctgaacagcatgcccaagagactgtgcctggtgtgcggcgacatcgccagcggctaccactacggcgtggccagctgcgaggcctgcaaggccttcttcaagagaaccatccagggcaacatcgagtacagctgccccgccaccaacgagtgcgagatcaccaagagaagaagaaagagctgccaggcctgcagattcatgaagtgcctgaaggtgggcatgctgaaggagggcgtgagactggacagagtgagaggcggcagacagaagtacaagagaagaatcgacgccgagaacagcccctacctgaacccccagctggtgcagcccgccaagaagcccctgctgtggagcgaccccgccgacaacaagatcgtgagccacctgctggtggccgagcccgagaagatctacgccatgcccgaccccaccgtgcccgacagcgacatcaaggccctgaccaccctgtgcgacctggccgacagagagctggtggtgatcatcggctgggccaagcacatccccggcttcagcaccctgagcctggccgaccagatgagcctgctgcagagcgcctggatggagatcctgatcctgggcgtggtgtacagaagcctgagcttcgaggacgagctggtgtacgccgacgactacatcatggacgaggaccagagcaagctggccggcctgctggacctgaacaacgccatcctgcagctggtgaagaagtacaagagcatgaagctggagaaggaggagttcgtgaccctgaaggccatcgccctggccaacagcgacagcatgcacatcgaggacgtggaggccgtgcagaagctgcaggacgtgctgcacgaggccctgcaggactacgaggccggccagcacatggaggaccccagaagagccggcaagatgctgatgaccctgcccctgctgagacagaccagcaccaaggccgtgcagcacttctacaacatcaagctggagggcaaggtgcccatgcacaagctgttcctggagatgctggaggccaaggtgtag

SEQ ID NO: 80712 - DNA, 1359 bp, Artificial Sequence
  Description of Artificial Sequence: Synthetic coding sequence
atgctgtgcggcagacccagaagcagcagcgacaacagaaacttcctgagagagagagccggcctgagcagcgccgccgtgcagaccagaatcggcaacagcgccgccagcagaagaagccccgccgccagaccccccgtgcccgccccccccgccctgcccagaggcagacccggcaccgagggcagcaccagcctgagcgcccccgccgtgctggtggtggccgtggccgtggtggtggtggtggtgagcgccgtggcctgggccatggccaactacatccacgtgccccccggcagccccgaggtgcccaagctgaacgtgaccgtgcaggaccaggaggagcacagatgcagagagggcgccctgagcctgctgcagcacctgagaccccactgggacccccaggaggtgaccctgcagctgttcaccgacggcatcaccaacaagctgatcggctgctacgtgggcaacaccatggaggacgtggtgctggtgagaatctacggcaacaagaccgagctgctggtggacagagacgaggaggtgaagagcttcagagtgctgcaggcccacggctgcgccccccagctgtactgcaccttcaacaacggcctgtgctacgagttcatccagggcgaggccctggaccccaagcacgtgtgcaaccccgccatcttcagactgatcgccagacagctggccaagatccacgccatccacgcccacaacggctggatccccaagagcaacctgtggctgaagatgggcaagtacttcagcctgatccccaccggcttcgccgacgaggacatcaacaagagattcctgagcgacatccccagcagccagatcctgcaggaggagatgacctggatgaaggagatcctgagcaacctgggcagccccgtggtgctgtgccacaacgacctgctgtgcaagaacatcatctacaacgagaagcagggcgacgtgcagttcatcgactacgagtacagcggctacaactacctggcctacgacatcggcaaccacttcaacgagttcgccggcgtgagcgacgtggactacagcctgtaccccgacagagagctgcagagccagtggctgagagcctacctggaggcctacaaggagttcaagggcttcggcaccgaggtgaccgagaaggaggtggagatcctgttcatccaggtgaaccagttcgccctggccagccacttcttctggggcctgtgggccctgatccaggccaagtacagcaccatcgagttcgacttcctgggctacgccatcgtgagattcaaccagtacttcaagatgaagcccgaggtgaccgccctgaaggtgcccgagtag

SEQ ID NO: 80713 - DNA, 777 bp, Artificial Sequence
  Description of Artificial Sequence: Synthetic coding sequence
atgctgtgcggcagacccagaagcagcagcgacaacagaaacttcctgagagagagagccggcctgagcagcgccgccgtgcagaccagaatcggcaacagcgccgccagcagaagaagccccgccgccagaccccccgtgcccgccccccccgccctgcccagaggcagacccggcaccgagggcagcaccagcctgagcgcccccgccgtgctggtggtggccgtggccgtggtggtggtggtggtgagcgccgtggcctgggccatggccaactacatccacgtgccccccggcagccccgaggtgcccaagctgaacgtgaccgtgcaggaccaggaggagcacagatgcagagagggcgccctgagcctgctgcagcacctgagaccccactgggacccccaggaggtgaccctgcagctgttcaccgacggcatcaccaacaagctgatcggctgctacgtgggcaacaccatggaggacgtggtgctggtgagaatctacggcaacaagaccgagctgctggtggacagagacgaggaggtgaagagcttcagagtgctgcaggcccacggctgcgccccccagctgtactgcaccttcaacaacggcctgtgctacgagttcatccagggcgaggccctggaccccaagcacgtgtgcaaccccgccatcttcagcctgagcagcctgaccctgtgcaagggcaagaccaccagatgcttcggcctgaccggctgcagaggcagcagactgctgctgagcttcttctag

SEQ ID NO: 80714 - DNA, 1305 bp, Artificial Sequence
  Description of Artificial Sequence: Synthetic coding sequence
atgctgtgcggcagacccagaagcagcagcgacaacagaaacttcctgagagagagagccggcctgagcagcgccgccgtgcagaccagaatcggcaacagcgccgccagcagaagaagccccgccgccagaccccccgtgcccgccccccccgccctgcccagaggcagacccggcaccgagggcagcaccagcctgagcgcccccgccgtgctggtggtggccgtggccgtggtggtggtggtggtgagcgccgtggcctgggccatggccaactacatccacgtgccccccggcagccccgaggtgcccaagctgaacgtgaccgtgcaggaccaggaggagcacagatgcagagagggcgccctgagcctgctgcagcacctgagaccccactgggacccccaggaggtgaccctgcagctgttcaccgacggcatcaccaacaagctgatcggctgctacgtgggcaacaccatggaggacgtggtgctggtgagaatctacggcaacaagaccgagctgctggtggacagagacgaggaggtgaagagcttcagagtgctgcaggcccacggctgcgccccccagctgtactgcaccttcaacaacggcctgtgctacgagttcatccagggcgaggccctggaccccaagcacgtgtgcaaccccgccatcttcagactgatcgccagacagctggccaagatccacgccatccacgcccacaacggctggatccccaagagcaacctgtggctgaagatgggcaagtacttcagcctgatccccaccggcttcgccgacgaggacatcaacaagagattcctgagcgacatccccagcagccagatcctgcaggaggagatgacctggatgaaggagatcctgagcaacctgggcagccccgtggtgctgtgccacaacgacctgctgtgcaagaacatcatctacaacgagaagcagggcgacgtgcagttcatcgactacgagtacagcggctacaactacctggcctacgacatcggcaaccacttcaacgagttcgccggcgtgagcgacgtggactacagcctgtaccccgacagagagctgcagagccagtggctgagagcctacctggaggcctacaaggagttcaagggcttcggcaccgaggtgaccgagaaggaggtggagatcctgttcatccaggtgaaccagttcgccctgggcgagaacctgaacttcatcatcggcaacaagtactgccagctgttcagcctgaagtggctgctgatcagcttcggcgactgcggcctgtag

SEQ ID NO: 80715 - DNA, 627 bp, Artificial Sequence
  Description of Artificial Sequence: Synthetic coding sequence
atggccaagatccacaccatccacgccaacggcagcctgcccaagcccatcctgtggcacaagatgcacaactacttcaccctggtgaagaacgagatcaaccccagcctgagcgccgacgtgcccaaggtggaggtgctggagagagagctggcctggctgaaggagcacctgagccagctggagagccccgtggtgttctgccacaacgacctgctgtgcaagaacatcatctacgacagcatcaagggccacgtgagattcatcgactacgagtacgccggctacaactaccaggccttcgacatcggcaaccacttcaacgagttcgccggcgtgaacgaggtggactactgcctgtaccccgccagagagacccagctgcagtggctgcactactacctgcaggcccagaagggcatggccgtgacccccagagaggtgcagagactgtacgtgcaggtgaacaagttcgccctggccagccacttcttctgggccctgtgggccctgatccagaaccagtacagcaccatcgacttcgacttcctgagatacgccgtgatcagattcaaccagtacttcaaggtgaagccccaggccagcgccctggagatgcccaagtag

SEQ ID NO: 80716 - DNA, 954 bp, Artificial Sequence
  Description of Artificial Sequence: Synthetic coding sequence
atggaggagaaggccgccgccagcgccagctgcagagagccccccggcccccccagagccgccgccgtggcctacttcggcatcagcgtggaccccgacgacatcctgcccggcgccctgagactgatccaggagctgagaccccactggaagcccgagcaggtgagaaccaagagattcaccgacggcatcaccaacaagctggtggcctgctacgtggaggaggacatgcaggactgcgtgctggtgagagtgtacggcgagagaaccgagctgctggtggacagagagaacgaggtgagaaacttccagctgctgagagcccacagctgcgcccccaagctgtactgcaccttccagaacggcctgtgctacgagtacatgcagggcgtggccctggagcccgagcacatcagagagcccagactgttcagcctgagcgccgacgtgcccaaggtggaggtgctggagagagagctggcctggctgaaggagcacctgagccagctggagagccccgtggtgttctgccacaacgacctgctgtgcaagaacatcatctacgacagcatcaagggccacgtgagattcatcgactacgagtacgccggctacaactaccaggccttcgacatcggcaaccacttcaacgagttcgccggcgtgaacgaggtggactactgcctgtaccccgccagagagacccagctgcagtggctgcactactacctgcaggcccagaagggcatggccgtgacccccagagaggtgcagagactgtacgtgcaggtgaacaagttcgccctggccagccacttcttctgggccctgtgggccctgatccagaaccagtacagcaccatcgacttcgacttcctgagatacgccgtgatcagattcaaccagtacttcaaggtgaagccccaggccagcgccctggagatgcccaagtag

SEQ ID NO: 80717 - DNA, 1185 bp, Artificial Sequence
  Description of Artificial Sequence: Synthetic coding sequence
atggccgtgccccccagcgccccccagcccagagccagcttccacctgagaagacacaccccctgcccccagtgcagctggggcatggaggagaaggccgccgccagcgccagctgcagagagccccccggcccccccagagccgccgccgtggcctacttcggcatcagcgtggaccccgacgacatcctgcccggcgccctgagactgatccaggagctgagaccccactggaagcccgagcaggtgagaaccaagagattcaccgacggcatcaccaacaagctggtggcctgctacgtggaggaggacatgcaggactgcgtgctggtgagagtgtacggcgagagaaccgagctgctggtggacagagagaacgaggtgagaaacttccagctgctgagagcccacagctgcgcccccaagctgtactgcaccttccagaacggcctgtgctacgagtacatgcagggcgtggccctggagcccgagcacatcagagagcccagactgttcagactgatcgccctggagatggccaagatccacaccatccacgccaacggcagcctgcccaagcccatcctgtggcacaagatgcacaactacttcaccctggtgaagaacgagatcaaccccagcctgagcgccgacgtgcccaaggtggaggtgctggagagagagctggcctggctgaaggagcacctgagccagctggagagccccgtggtgttctgccacaacgacctgctgtgcaagaacatcatctacgacagcatcaagggccacgtgagattcatcgactacgagtacgccggctacaactaccaggccttcgacatcggcaaccacttcaacgagttcgccggcgtgaacgaggtggactactgcctgtaccccgccagagagacccagctgcagtggctgcactactacctgcaggcccagaagggcatggccgtgacccccagagaggtgcagagactgtacgtgcaggtgaacaagttcgccctgggccccagctgcgtgagcagcaccatgaccgccagcctgcagtgctgcagagtgggcaacagacacggcgagatcgccagactgaccctgagcggcctgttccccggcgtgagcctgctgctgggcagcctgggcccccaccccgagcccgtgctgcaccacagactgtag

SEQ ID NO: 80718 - DNA, 1161 bp, Artificial Sequence
  Description of Artificial Sequence: Synthetic coding sequence
atggccgtgccccccagcgccccccagcccagagccagcttccacctgagaagacacaccccctgcccccagtgcagctggggcatggaggagaaggccgccgccagcgccagctgcagagagccccccggcccccccagagccgccgccgtggcctacttcggcatcagcgtggaccccgacgacatcctgcccggcgccctgagactgatccaggagctgagaccccactggaagcccgagcaggtgagaaccaagagattcaccgacggcatcaccaacaagctggtggcctgctacgtggaggaggacatgcaggactgcgtgctggtgagagtgtacggcgagagaaccgagctgctggtggacagagagaacgaggtgagaaacttccagctgctgagagcccacagctgcgcccccaagctgtactgcaccttccagaacggcctgtgctacgagtacatgcagggcgtggccctggagcccgagcacatcagagagcccagactgttcagactgatcgccctggagatggccaagatccacaccatccacgccaacggcagcctgcccaagcccatcctgtggcacaagatgcacaactacttcaccctggtgaagaacgagatcaaccccagcctgagcgccgacgtgcccaaggtggaggtgctggagagagagctggcctggctgaaggagcacctgagccagctggagagccccgtggtgttctgccacaacgacctgctgtgcaagaacatcatctacgacagcatcaagggccacgtgagattcatcgactacgagtacgccggctacaactaccaggccttcgacatcggcaaccacttcaacgagttcgccggcgtgaacgaggtggactactgcctgtaccccgccagagagacccagctgcagtggctgcactactacctgcaggcccagaagggcatggccgtgacccccagagaggtgcagagactgtacgtgcaggtgaacaagttcgccctggccagccacttcttctgggccctgtgggccctgatccagaaccagtacagcaccatcgacttcgacttcctgagatacgccgtgatcagattcaaccagtacttcaaggtgaagccccaggccagcgccctggagatgcccaagtag

SEQ ID NO: 80719 - DNA, 759 bp, Artificial Sequence
  Description of Artificial Sequence: Synthetic coding sequence
agaagactgggcggcggcaccgccgagggcaagaccggcagaggcctgggcggccccagctgggacaccggccccagagccatgggcagcctgagcagacccagcttcagcgacagactgatcgccctggagatggccaagatccacaccatccacgccaacggcagcctgcccaagcccatcctgtggcacaagatgcacaactacttcaccctggtgaagaacgagatcaaccccagcctgagcgccgacgtgcccaaggtggaggtgctggagagagagctggcctggctgaaggagcacctgagccagctggagagccccgtggtgttctgccacaacgacctgctgtgcaagaacatcatctacgacagcatcaagggccacgtgagattcatcgactacgagtacgccggctacaactaccaggccttcgacatcggcaaccacttcaacgagttcgccggcgtgaacgaggtggactactgcctgtaccccgccagagagacccagctgcagtggctgcactactacctgcaggcccagaagggcatggccgtgacccccagagaggtgcagagactgtacgtgcaggtgaacaagttcgccctggccagccacttcttctgggccctgtgggccctgatccagaaccagtacagcaccatcgacttcgacttcctgagatacgccgtgatcagattcaaccagtacttcaaggtgaagccccaggccagcgccctggagatgcccaagtag

SEQ ID NO: 80720 - DNA, 765 bp, Artificial Sequence
  Description of Artificial Sequence: Synthetic coding sequence
atggccgaggccgtgctgagagtggccagaagacagctgagccagagaggcggcagcggcgcccccatcctgctgagacagatgttcgagcccgtgagctgcaccttcacctacctgctgggcgacagagagagcagagaggccgtgctgatcgaccccgtgctggagaccgcccccagagacgcccagctgatcaaggagctgggcctgagactgctgtacgccgtgaacacccactgccacgccgaccacatcaccggcagcggcctgctgagaagcctgctgcccggctgccagagcgtgatcagcagactgagcggcgcccaggccgacctgcacatcgaggacggcgacagcatcagattcggcagattcgccctggagaccagagccagccccggccacacccccggctgcgtgaccttcgtgctgaacgaccacagcatggccttcaccggcgacgccctgctgatcagaggctgcggcagaaccgacttccagcagggctgcgccaagaccctgtaccacagcgtgcacgagaagatcttcaccctgcccggcgactgcctgatctaccccgcccacgactaccacggcttcaccgtgagcaccgtggaggaggagagaaccctgaaccccagactgaccctgagctgcgaggagttcgtgaagatcatgggcaacctgaacctgcccaagccccagcagatcgacttcgccgtgcccgccaacatgagatgcggcgtgcagacccccaccgcctag

SEQ ID NO: 80721 - DNA, 1020 bp, Artificial Sequence
  Description of Artificial Sequence: Synthetic coding sequence
atggccgacagcgtgaagaccttcctgcaggacctggccagaggcatcaaggacagcatctggggcatctgcaccatcagcaagctggacgccagaatccagcagaagagagaggagcagagaagaagaagagccagcagcgtgctggcccagagaagagcccagagcatcgagagaaagcaggagagcgagcccagaatcgtgagcagaatcttccagtgctgcgcctggaacggcggcgtgttctggttcagcctgctgctgttctacagagtgttcatccccgtgctgcagagcgtgaccgccagaatcatcggcgaccccagcctgcacggcgacgtgtggagctggctggagttcttcctgaccagcatcttcagcgccctgtgggtgctgcccctgttcgtgctgagcaaggtggtgaacgccatctggttccaggacatcgccgacctggccttcgaggtgagcggcagaaagccccaccccttccccagcgtgagcaagatcatcgccgacatgctgttcaacctgctgctgcaggccctgttcctgatccagggcatgttcgtgagcctgttccccatccacctggtgggccagctggtgagcctgctgcacatgagcctgctgtacagcctgtactgcttcgagtacagatggttcaacaagggcatcgagatgcaccagagactgagcaacatcgagagaaactggccctactacttcggcttcggcctgcccctggccttcctgaccgccatgcagagcagctacatcatcagcggctgcctgttcagcatcctgttccccctgttcatcatcagcgccaacgaggccaagcccggcaaggcctacctgttccagctgagactgttcagcctggtggtgttcctgagcaacagactgttccacaagaccgtgtacctgcagagcgccctgagcagcagcaccagcgccgagaagttccccagcccccaccccagccccgccaagctgaaggccaccgccggccactag

SEQ ID NO: 80722 - DNA, 786 bp, Artificial Sequence
  Description of Artificial Sequence: Synthetic coding sequence
atggccgacagcgtgaagaccttcctgcaggacctggccagaggcatcaaggacagcatctggggcatctgcaccatcagcaagctggacgccagaatccagcagaagagagaggagcagagaagaagaagagccagcagcgtgctggcccagagaagagcccagagcatcgagagaaagcaggagagcgagcccagaatcgtgagcagaatcttccagtgctgcgcctggaacggcggcgtgttctggttcagcctgctgctgttctacagagtgttcatccccgtgctgcagagcgtgaccgccagaatcatcggcgaccccagcctgcacggcgacgtgtggagctggctggagttcttcctgaccagcatcttcagcgccctgtgggtgctgcccctgttcgtgctgagcaaggtggtgaacgccatctggttccaggacatcgccgacctggccttcgaggtgagcggcagaaagccccaccccttccccagcgtgagcaagatcatcgccgacatgctgttcaacctgctgctgcaggccctgttcctgatccagggcatgttcgtgagcctgttccccatccacctggtgggccagctggtgagcctgctgcacatgagcctgctgtacagcctgtactgcttcgagtacagatggttcaacaaggtggccgccttcagcctgagcagcttcctgtacagcctgagcgcccccatgaagcagagacccgccaagcacatcagcagcagctgcgccagcagcccctggtggagcagctag

SEQ ID NO: 80723 - DNA, 903 bp, Artificial Sequence
  Description of Artificial Sequence: Synthetic coding sequence
atgatcctggagggcggcggcgtgatgaacctgaaccccggcaacaacctgctgcaccagccccccgcctggaccgacagctacagcacctgcaacgtgagcagcggcttcttcggcggccagtggcacgagatccacccccagtactggaccaagtaccaggtgtgggagtggctgcagcacctgctggacaccaaccagctggacgccaactgcatccccttccaggagttcgacatcaacggcgagcacctgtgcagcatgagcctgcaggagttcaccagagccgccggcaccgccggccagctgctgtacagcaacctgcagcacctgaagtggaacggccagtgcagcagcgacctgttccagagcacccacaacgtgatcgtgaagaccgagcagaccgagcccagcatcatgaacacctggaaggacgagaactacctgtacgacaccaactacggcagcaccgtggacctgctggacagcaagaccttctgcagagcccagatcagcatgaccaccaccagccacctgcccgtggccgagagccccgacatgaagaaggagcaggacccccccgccaagtgccacaccaagaagcacaaccccagaggcacccacctgtgggagttcatcagagacatcctgctgaaccccgacaagaaccccggcctgatcaagtgggaggacagaagcgagggcgtgttcagattcctgaagagcgaggccgtggcccagctgtggggcaagaagaagaacaacagcagcatgacctacgagaagctgagcagagccatgagatactactacaagagagagatcctggagagagtggacggcagaagactggtgtacaagttcggcaagaacgccagaggctggagagagaacgagaactag

SEQ ID NO: 80724 - DNA, 903 bp, Artificial Sequence; identical to SEQ ID NO: 80723
  Description of Artificial Sequence: Synthetic coding sequence

SEQ ID NO: 80725 - DNA, 969 bp, Artificial Sequence
  Description of Artificial Sequence: Synthetic coding sequence
atgggcctgcccgagagaagaggcctggtgctgctgctgagcctggccgagatcctgttcaagatcatgatcctggagggcggcggcgtgatgaacctgaaccccggcaacaacctgctgcaccagccccccgcctggaccgacagctacagcacctgcaacgtgagcagcggcttcttcggcggccagtggcacgagatccacccccagtactggaccaagtaccaggtgtgggagtggctgcagcacctgctggacaccaaccagctggacgccaactgcatccccttccaggagttcgacatcaacggcgagcacctgtgcagcatgagcctgcaggagttcaccagagccgccggcaccgccggccagctgctgtacagcaacctgcagcacctgaagtggaacggccagtgcagcagcgacctgttccagagcacccacaacgtgatcgtgaagaccgagcagaccgagcccagcatcatgaacacctggaaggacgagaactacctgtacgacaccaactacggcagcaccgtggacctgctggacagcaagaccttctgcagagcccagatcagcatgaccaccaccagccacctgcccgtggccgagagccccgacatgaagaaggagcaggacccccccgccaagtgccacaccaagaagcacaaccccagaggcacccacctgtgggagttcatcagagacatcctgctgaaccccgacaagaaccccggcctgatcaagtgggaggacagaagcgagggcgtgttcagattcctgaagagcgaggccgtggcccagctgtggggcaagaagaagaacaacagcagcatgacctacgagaagctgagcagagccatgagatactactacaagagagagatcctggagagagtggacggcagaagactggtgtacaagttcggcaagaacgccagaggctggagagagaacgagaactag

SEQ ID NO: 80726 - DNA, 903 bp, Artificial Sequence; identical to SEQ ID NO: 80723
  Description of Artificial Sequence: Synthetic coding sequence

SEQ ID NO: 80727 - DNA, 834 bp, Artificial Sequence
  Description of Artificial Sequence: Synthetic coding sequence
atgatcctggagggcggcggcgtgatgaacctgaaccccggcaacaacctgctgcaccagccccccgcctggaccgacagctacagcacctgcaacgtgagcagcggcttcttcggcggccagtggcacgagatccacccccagtactggaccaagtaccaggtgtgggagtggctgcagcacctgctggacaccaaccagctggacgccaactgcatccccttccaggagttcgacatcaacggcgagcacctgtgcagcatgagcctgcaggagttcaccagagccgccggcaccgccggccagctgctgtacagcaacctgcagcacctgaagtggaacggccagtgcagcagcgacctgttccagagcacccacaacgtgatcgtgaagaccgagcagaccgagcccagcatcatgaacacctggaaggacgagaactacctgtacgacaccaactacggcagcaccgtggccgagagccccgacatgaagaaggagcaggacccccccgccaagtgccacaccaagaagcacaaccccagaggcacccacctgtgggagttcatcagagacatcctgctgaaccccgacaagaaccccggcctgatcaagtgggaggacagaagcgagggcgtgttcagattcctgaagagcgaggccgtggcccagctgtggggcaagaagaagaacaacagcagcatgacctacgagaagctgagcagagccatgagatactactacaagagagagatcctggagagagtggacggcagaagactggtgtacaagttcggcaagaacgccagaggctggagagagaacgagaactag

SEQ ID NO: 80728 - DNA, 555 bp, Artificial Sequence
  Description of Artificial Sequence: Synthetic coding sequence
atggacctgtggaactgggacgaggccagcccccaggaggtgccccccggcaacaagctggccggcctggagggcgccaagctgggcttctgcttccccgacctggccctgcagggcgacacccccaccgccaccgccgagacctgctggaagggcaccagcagcagcctggccagcttcccccagctggactggggcagcgccctgctgcaccccgaggtgccctggggcgccgagcccgacagccaggccctgccctggagcggcgactggaccgacatggcctgcaccgcctgggacagctggagcggcgccagccagaccctgggccccgcccccctgggccccggccccatccccgccgccggcagcgagggcgccgccggccagaactgcagcccccccgcccccggcctgtaccacctgctggagcccggcgccgcctgcggctggcaccacctgttcgaggccgtgcccgagctgagcagccacagactgctgagaaccgagcccgccgtgggcccctgccagttcggcagcatgccccagaactag

SEQ ID NO: 80729 - DNA, 468 bp, Artificial Sequence
  Description of Artificial Sequence: Synthetic coding sequence
atggacctgtggaactgggacgaggccagcccccaggaggtgccccccggcaacaagctggccggcctggagggcgccaagctgggcttctgcttccccgacctggccctgcagggcgacacccccaccgccaccgccgagacctgctggaagggccccatccagctgtggcagttcctgctggagctgctgcacgacggcgccagaagcagctgcatcagatggaccggcaacagcagagagttccagctgtgcgaccccaaggaggtggccagactgtggggcgagagaaagagaaagcccggcatgaactacgagaagctgagcagaggcctgagatactactacagaagagacatcgtgagaaagagcggcggcagaaagtacacctacagattcggcggcagagtgcccagcctggcctaccccgactgcgccggcggcggcagaggcgccgagacccagtag

SEQ ID NO: 80730 - DNA, 1029 bp, Artificial Sequence
  Description of Artificial Sequence: Synthetic coding sequence
atggacctgtggaactgggacgaggccagcccccaggaggtgccccccggcaacaagctggccggcctggagggcgccaagctgggcttctgcttccccgacctggccctgcagggcgacacccccaccgccaccgccgagacctgctggaagggcaccagcagcagcctggccagcttcccccagctggactggggcagcgccctgctgcaccccgaggtgccctggggcgccgagcccgacagccaggccctgccctggagcggcgactggaccgacatggcctgcaccgcctgggacagctggagcggcgccagccagaccctgggccccgcccccctgggccccggccccatccccgccgccggcagcgagggcgccgccggccagaactgcgtgcccgtggccggcgaggccaccagctggagcagagcccaggccgccggcagcaacaccagctgggactgcagcgtgggccccgacggcgacacctactggggcagcggcctgggcggcgagcccagaaccgactgcaccatcagctggggcggccccgccggccccgactgcaccaccagctggaaccccggcctgcacgccggcggcaccaccagcctgaagagataccagagcagcgccctgaccgtgtgcagcgagcccagcccccagagcgacagagccagcctggccagatgccccaagaccaaccacagaggccccatccagctgtggcagttcctgctggagctgctgcacgacggcgccagaagcagctgcatcagatggaccggcaacagcagagagttccagctgtgcgaccccaaggaggtggccagactgtggggcgagagaaagagaaagcccggcatgaactacgagaagctgagcagaggcctgagatactactacagaagagacatcgtgagaaagagcggcggcagaaagtacacctacagattcggcggcagagtgcccagcctggcctaccccgactgcgccggcggcggcagaggcgccgagacccagtag

SEQ ID NO: 80731 - DNA, 1029 bp, Artificial Sequence; identical to SEQ ID NO: 80730
  Description of Artificial Sequence: Synthetic coding sequence

SEQ ID NO: 80732 - DNA, 432 bp, Artificial Sequence
  Description of Artificial Sequence: Synthetic coding sequence
atgaaggccggctgcagcatcgtggagaagcccgagggcggcggcggctaccagttccccgactgggcctacaagaccgagagcagccccggcagcagacagatccagctgtggcacttcatcctggagctgctgcagaaggaggagttcagacacgtgatcgcctggcagcagggcgagtacggcgagttcgtgatcaaggaccccgacgaggtggccagactgtggggcagaagaaagtgcaagccccagatgaactacgacaagctgagcagagccctgagatactactacaacaagagaatcctgcacaagaccaagggcaagagattcacctacaagttcaacttcaacaagctggtgatgcccaactaccccttcatcaacatcagaagcagcggcaagatccagaccctgctggtgggcaactag

SEQ ID NO: 80733 - DNA, 1539 bp, Artificial Sequence
  Description of Artificial Sequence: Synthetic coding sequence
atgaaggccggctgcagcatcgtggagaagcccgagggcggcggcggctaccagttccccgactgggcctacaagaccgagagcagccccggcagcagacagatccagctgtggcacttcatcctggagctgctgcagaaggaggagttcagacacgtgatcgcctggcagcagggcgagtacggcgagttcgtgatcaaggaccccgacgaggtggccagactgtggggcagaagaaagtgcaagccccagatgaactacgacaagctgagcagagccctgagatactactacaacaagagaatcctgcacaagaccaagggcaagagattcacctacaagttcaacttcaacaagctggtgatgcccaactaccccttcatcaacatcagaagcagcggcgtggtgccccagagcgccccccccgtgcccaccgccagcagcagattccacttcccccccctggacacccacagccccaccaacgacgtgcagcccggcagattcagcgccagcagcctgaccgccagcggccaggagagcagcaacggcaccgacagaaagaccgagctgagcgagctggaggacggcagcgccgccgactggagaagaggcgtggaccccgtgagcagcagaaacgccatcggcggcggcggcatcggccaccagaagagaaagcccgacatcatgctgcccctgttcgccagacccggcatgtaccccgacccccacagccccttcgccgtgagccccatccccggcagaggcggcgtgctgaacgtgcccatcagccccgccctgagcctgacccccaccatcttcagctacagccccagccccggcctgagccccttcaccagcagcagctgcttcagcttcaaccccgaggagatgaagcactacctgcacagccaggcctgcagcgtgttcaactaccacctgagccccagaaccttccccagataccccggcctgatggtgccccccctgcagtgccagatgcaccccgaggagagcacccagttcagcatcaagctgcagcccccccccgtgggcagaaagaacagagagagagtggagagcagcgaggagagcgcccccgtgaccacccccaccatggccagcatcccccccagaatcaaggtggagcccgccagcgagaaggaccccgagagcctgagacagagcgccagagagaaggaggagcacacccaggaggagggcaccgtgcccagcagaaccatcgaggaggagaagggcaccatcttcgccagacccgccgccccccccatctggcccagcgtgcccatcagcacccccagcggcgagcccctggaggtgaccgaggacagcgaggacagacccggcaaggagcccagcgcccccgagaagaaggaggacgccctgatgccccccaagctgagactgaagagaagatggaacgacgaccccgaggccagagagctgagcaagagcggcaagttcctgtggaacggcagcggcccccagggcctggccaccgccgccgccgacgcctag

SEQ ID NO: 80734 - DNA, 1533 bp, Artificial Sequence
  Description of Artificial Sequence: Synthetic coding sequence
atggacggcttctacgaccagcaggtgcccttcatggtgcccggcaagagcagaagcgaggagtgcagaggcagacccgtgatcgacagaaagagaaagttcctggacaccgacctggcccacgacagcgaggagctgttccaggacctgagccagctgcaggaggcctggctggccgaggcccaggtgcccgacgacgagcagttcgtgcccgacttccagagcgacaacctggtgctgcacgcccccccccccaccaagatcaagagagagctgcacagccccagcagcgagctgagcagctgcagccacgagcaggccctgggcgccaactacggcgagaagtgcctgtacaactactgcgcctacgacagaaagccccccagcggcttcaagcccctgaccccccccaccacccccctgagccccacccaccagaaccccctgttcccccccccccaggccaccctgcccaccagcggccacgcccccgccgccggccccgtgcagggcgtgggccccgcccccgccccccacagcctgcccgagcccggcccccagcagcagaccttcgccgtgcccagacccccccaccagcccctgcagatgcccaagatgatgcccgagaaccagtaccccagcgagcagagattccagagacagctgagcgagccctgccaccccttccccccccagcccggcgtgcccggcgacaacagacccagctaccacagacagatgagcgagcccatcgtgcccgccgcccccccccccccccagggcttcaagcaggagtaccacgaccccctgtacgagcacggcgtgcccggcatgcccggcccccccgcccacggcttccagagccccatgggcatcaagcaggagcccagagactactgcgtggacagcgaggtgcccaactgccagagcagctacatgagaggcggctacttcagcagcagccacgagggcttcagctacgagaaggaccccagactgtacttcgacgacacctgcgtggtgcccgagagactggagggcaaggtgaagcaggagcccaccatgtacagagagggccccccctaccagagaagaggcagcctgcagctgtggcagttcctggtgaccctgctggacgaccccgccaacgcccacttcatcgcctggaccggcagaggcatggagttcaagctgatcgagcccgaggaggtggccagaagatggggcatccagaagaacagacccgccatgaactacgacaagctgagcagaagcctgagatactactacgagaagggcatcatgcagaaggtggccggcgagagatacgtgtacaagttcgtgtgcgaccccgacgccctgttcagcatggccttccccgacaaccagagacccttcctgaaggccgagagcgagtgccacctgagcgaggaggacaccctgcccctgacccacttcgaggacagccccgcctacctgctggacatggacagatgcagcagcctgccctacgccgagggcttcgcctactag

SEQ ID NO: 80735 - DNA, 399 bp, Artificial Sequence
  Description of Artificial Sequence: Synthetic coding sequence
atggacggcttctacgaccagcaggtgcccttcatggtgcccggcaagagcagaagcgaggagtgcagaggcagacccgtgatcgacagaaagagaaagttcctggacaccgacctggcccacgacagcgaggagctgttccaggacctgagccagctgcaggaggcctggctggccgaggcccaggtgcccgacgacgagcagttcgtgcccgacttccagagcgacaacctggtgctgcacgcccccccccccaccaagatcaagagagagctgcacagccccagcagcgagctgagcagctgcagccacgagcaggccctgggcgccaactacggcgagaagtgcctgtacaactactgcgcctacgacagaaagccccccagcggcttcaagtag

SEQ ID NO: 80736 - DNA, 423 bp, Artificial Sequence
  Description of Artificial Sequence: Synthetic coding sequence
atggacggcttctacgaccagcaggtgcccttcatggtgcccggcaagagcagaagcgaggagtgcagaggcagacccgtgatcgacagaaagagaaagttcctggacaccgacctggcccacgacagcgaggagctgttccaggacctgagccagctgcaggaggcctggctggccgaggcccaggtgcccgacgacgagcagttcgtgcccgacttccagagcgacaacctggtgctgcacgcccccccccccaccaagatcaagagagagctgcacagccccagcagcgagctgagcagctgcagccacgagcaggccctgggcgccaactacggcgagaagtgcctgtacaactactgcgcctacgacagaaagccccccagcggcttcaagcccctgaccccccccaccaccccctag

SEQ ID NO: 80737 - DNA, 1533 bp, Artificial Sequence; identical to SEQ ID NO: 80734
  Description of Artificial Sequence: Synthetic coding sequence

SEQ ID NO: 80738 - DNA, 453 bp, Artificial Sequence
  Description of Artificial Sequence: Synthetic coding sequence
atggacggcttctacgaccagcaggtgcccttcatggtgcccggcaagagcagaagcgaggagtgcagaggcagacccgtgatcgacagaaagagaaagttcctggacaccgacctggcccacgacagcgaggagctgttccaggacctgagccagctgcaggaggcctggctggccgaggcccaggtgcccgacgacgagcagttcgtgcccgacttccagagcgacaacctggtgctgcacgcccccccccccaccaagatcaagagagagctgcacagccccagcagcgagctgagcagctgcagccacgagcaggccctgggcgccaactacggcgagaagtgcctgtacaactactgcgcctacgacagaaagccccccagcggcttcaagcccctgaccccccccaccacccccctgagccccacccaccagaaccccctgttctag

SEQ ID NO: 80739 - DNA, 1659 bp, Artificial Sequence
  Description of Artificial Sequence: Synthetic coding sequence
atgagcgagagaagatgcccccccgagcacagagagggcgtgaacgacaccggcggcagcctgttcccccagaagctgctgaacgccgagaccagccagagcggcatcagagacgccgagagcaccatggacggcttctacgaccagcaggtgcccttcatggtgcccggcaagagcagaagcgaggagtgcagaggcagacccgtgatcgacagaaagagaaagttcctggacaccgacctggcccacgacagcgaggagctgttccaggacctgagccagctgcaggaggcctggctggccgaggcccaggtgcccgacgacgagcagttcgtgcccgacttccagagcgacaacctggtgctgcacgcccccccccccaccaagatcaagagagagctgcacagccccagcagcgagctgagcagctgcagccacgagcaggccctgggcgccaactacggcgagaagtgcctgtacaactactgcgcctacgacagaaagccccccagcggcttcaagcccctgaccccccccaccacccccctgagccccacccaccagaaccccctgttcccccccccccaggccaccctgcccaccagcggccacgcccccgccgccggccccgtgcagggcgtgggccccgcccccgccccccacagcctgcccgagcccggcccccagcagcagaccttcgccgtgcccagacccccccaccagcccctgcagatgcccaagatgatgcccgagaaccagtaccccagcgagcagagattccagagacagctgagcgagccctgccaccccttccccccccagcccggcgtgcccggcgacaacagacccagctaccacagacagatgagcgagcccatcgtgcccgccgcccccccccccccccagggcttcaagcaggagtaccacgaccccctgtacgagcacggcgtgcccggcatgcccggcccccccgcccacggcttccagagccccatgggcatcaagcaggagcccagagactactgcgtggacagcgaggtgcccaactgccagagcagctacatgagaggcggctacttcagcagcagccacgagggcttcagctacgagaaggaccccagactgtacttcgacgacacctgcgtggtgcccgagagactggagggcaaggtgaagcaggagcccaccatgtacagagagggccccccctaccagagaagaggcagcctgcagctgtggcagttcctggtgaccctgctggacgaccccgccaacgcccacttcatcgcctggaccggcagaggcatggagttcaagctgatcgagcccgaggaggtggccagaagatggggcatccagaagaacagacccgccatgaactacgacaagctgagcagaagcctgagatactactacgagaagggcatcatgcagaaggtggccggcgagagatacgtgtacaagttcgtgtgcgaccccgacgccctgttcagcatggccttccccgacaaccagagacccttcctgaaggccgagagcgagtgccacctgagcgaggaggacaccctgcccctgacccacttcgaggacagccccgcctacctgctggacatggacagatgcagcagcctgccctacgccgagggcttcgcctactag

SEQ ID NO: 80740 - DNA, 1359 bp, Artificial Sequence
  Description of Artificial Sequence: Synthetic coding sequence
atgagcgagacccccgcccagtgcagcatcaagcaggagagaatcagctacaccccccccgagagccccgtgcccagctacgccagcagcacccccctgcacgtgcccgtgcccagagccctgagaatggaggaggacagcatcagactgcccgcccacctgagactgcagcccatctactggagcagagacgacgtggcccagtggctgaagtgggccgagaacgagttcagcctgagacccatcgacagcaacaccttcgagatgaacggcaaggccctgctgctgctgaccaaggaggacttcagatacagaagcccccacagcggcgacgtgctgtacgagctgctgcagcacatcctgaagcagagaaagcccagaatcctgttcagccccttcttccaccccggcaacagcatccacacccagcccgaggtgatcctgcaccagaaccacgaggaggacaactgcgtgcagagaacccccagacccagcgtggacaacgtgcaccacaacccccccaccatcgagctgctgcacagaagcagaagccccatcaccaccaaccacagacccagccccgaccccgagcagagacccctgagaagccccctggacaacatgatcagaagactgagccccgccgagagagcccagggccccagaccccaccaggagaacaaccaccaggagagctaccccctgagcgtgagccccatggagaacaaccactgccccgccagcagcgagagccaccccaagcccagcagccccagacaggagagcaccagagtgatccagctgatgcccagccccatcatgcaccccctgatcctgaaccccagacacagcgtggacttcaagcagagcagactgagcgaggacggcctgcacagagagggcaagcccatcaacctgagccacagagaggacctggcctacatgaaccacatcatggtgagcgtgagcccccccgaggagcacgccatgcccatcggcagaatcgccgactgcagactgctgtgggactacgtgtaccagctgctgagcgacagcagatacgagaacttcatcagatgggaggacaaggagagcaagatcttcagaatcgtggaccccaacggcctggccagactgtggggcaaccacaagaacagaaccaacatgacctacgagaagatgagcagagccctgagacactactacaagctgaacatcatcagaaaggagcccggccagagactgctgttcagattcatgaagacccccgacgagatcatgagcggcagaaccgacagactggagcacctggagagccaggagctggacgagcagatctaccaggaggacgagtgctag

SEQ ID NO: 80741 - DNA, 954 bp, Artificial Sequence
  Description of Artificial Sequence: Synthetic coding sequence
atgcaggagggcgagctggccatcagccccatcagccccgtggccgccatgccccccctgggcacccacgtgcaggccagatgcgaggcccagatcaacctgctgggcgagggcggcatctgcaagctgcccggcagactgagaatccagcccgccctgtggagcagagaggacgtgctgcactggctgagatgggccgagcaggagtacagcctgccctgcaccgccgagcacggcttcgagatgaacggcagagccctgtgcatcctgaccaaggacgacttcagacacagagcccccagcagcggcgacgtgctgtacgagctgctgcagtacatcaagacccagagaagagccctggtgtgcggccccttcttcggcggcatcttcagactgaagacccccacccagcacagccccgtgccccccgaggaggtgaccggccccagccagatggacaccagaagaggccacctgctgcagccccccgaccccggcctgaccagcaacttcggccacctggacgaccccggcctggccagatggacccccggcaaggaggagagcctgaacctgtgccactgcgccgagctgggctgcagaacccagggcgtgtgcagcttccccgccatgccccaggcccccatcgacggcagaatcgccgactgcagactgctgtgggactacgtgtaccagctgctgctggacaccagatacgagccctacatcaagtgggaggacaaggacgccaagatcttcagagtggtggaccccaacggcctggccagactgtggggcaaccacaagaacagagtgaacatgacctacgagaagatgagcagagccctgagacactactacaagctgaacatcatcaagaaggagcccggccagaagctgctgttcagaaacggcctgcagctgatcttcatcttcatctggagcttccagtag

SEQ ID NO: 80742 - DNA, 1026 bp, Artificial Sequence
  Description of Artificial Sequence: Synthetic coding sequence
atgcaggagggcgagctggccatcagccccatcagccccgtggccgccatgccccccctgggcacccacgtgcaggccagatgcgaggcccagatcaacctgctgggcgagggcggcatctgcaagctgcccggcagactgagaatccagcccgccctgtggagcagagaggacgtgctgcactggctgagatgggccgagcaggagtacagcctgccctgcaccgccgagcacggcttcgagatgaacggcagagccctgtgcatcctgaccaaggacgacttcagacacagagcccccagcagcggcgacgtgctgtacgagctgctgcagtacatcaagacccagagaagagccctggtgtgcggccccttcttcggcggcatcttcagactgaagacccccacccagcacagccccgtgccccccgaggaggtgaccggccccagccagatggacaccagaagaggccacctgctgcagccccccgaccccggcctgaccagcaacttcggccacctggacgaccccggcctggccagatggacccccggcaaggaggagagcctgaacctgtgccactgcgccgagctgggctgcagaacccagggcgtgtgcagcttccccgccatgccccaggcccccatcgacggcagaatcgccgactgcagactgctgtgggactacgtgtaccagctgctgctggacaccagatacgagccctacatcaagtgggaggacaaggacgccaagatcttcagagtggtggaccccaacggcctggccagactgtggggcaaccacaagaacagagtgaacatgacctacgagaagatgagcagagccctgagacactactacaagctgaacatcatcaagaaggagcccggccagaagctgctgttcagattcctgaagacccccggcaagatggtgcaggacaagcacagccacctggagcccctggagagccaggagcaggacagaatcgagttcaaggacaagagacccgagatcagcccctag

SEQ ID NO: 80743 - DNA, 795 bp, Artificial Sequence
  Description of Artificial Sequence: Synthetic coding sequence
atgcaggagggcgagctggccatcagccccatcagccccgtggccgccatgccccccctgggcacccacgtgcaggccagatgcgaggcccagatcaacctgctgggcgagggcggcatctgcaagctgcccggcagactgagaatccagcccgccctgtggagcagagaggacgtgctgcactggctgagatgggccgagcaggagtacagcctgccctgcaccgccgagcacggcttcgagatgaacggcagagccctgtgcatcctgaccaaggacgacttcagacacagagcccccagcagcggcgacgtgctgtacgagctgctgcagtacatcaagacccagagaagagccctggtgtgcggccccttcttcggcggcatcttcagactgaagacccccacccagcacagccccgtgccccccgaggactgcagactgctgtgggactacgtgtaccagctgctgctggacaccagatacgagccctacatcaagtgggaggacaaggacgccaagatcttcagagtggtggaccccaacggcctggccagactgtggggcaaccacaagaacagagtgaacatgacctacgagaagatgagcagagccctgagacactactacaagctgaacatcatcaagaaggagcccggccagaagctgctgttcagattcctgaagacccccggcaagatggtgcaggacaagcacagccacctggagcccctggagagccaggagcaggacagaatcgagttcaaggacaagagacccgagatcagcccctag

SEQ ID NO: 80744 - DNA, 861 bp, Artificial Sequence
  Description of Artificial Sequence: Synthetic coding sequence
atgcaggagggcgagctggccatcagccccatcagccccgtggccgccatgccccccctgggcacccacgtgcaggccagatgcgaggcccagatcaacctgctgggcgagggcggcatctgcaagctgcccggcagactgagagacgtgctgtacgagctgctgcagtacatcaagacccagagaagagccctggtgtgcggccccttcttcggcggcatcttcagactgaagacccccacccagcacagccccgtgccccccgaggaggtgaccggccccagccagatggacaccagaagaggccacctgctgcagccccccgaccccggcctgaccagcaacttcggccacctggacgaccccggcctggccagatggacccccggcaaggaggagagcctgaacctgtgccactgcgccgagctgggctgcagaacccagggcgtgtgcagcttccccgccatgccccaggcccccatcgacggcagaatcgccgactgcagactgctgtgggactacgtgtaccagctgctgctggacaccagatacgagccctacatcaagtgggaggacaaggacgccaagatcttcagagtggtggaccccaacggcctggccagactgtggggcaaccacaagaacagagtgaacatgacctacgagaagatgagcagagccctgagacactactacaagctgaacatcatcaagaaggagcccggccagaagctgctgttcagattcctgaagacccccggcaagatggtgcaggacaagcacagccacctggagcccctggagagccaggagcaggacagaatcgagttcaaggacaagagacccgagatcagcccctag

SEQ ID NO: 80745 - DNA, 573 bp, Artificial Sequence
  Description of Artificial Sequence: Synthetic coding sequence
atggacaccagaagaggccacctgctgcagccccccgaccccggcctgaccagcaacttcggccacctggacgaccccggcctggccagatggacccccggcaaggaggagagcctgaacctgtgccactgcgccgagctgggctgcagaacccagggcgtgtgcagcttccccgccatgccccaggcccccatcgacggcagaatcgccgactgcagactgctgtgggactacgtgtaccagctgctgctggacaccagatacgagccctacatcaagtgggaggacaaggacgccaagatcttcagagtggtggaccccaacggcctggccagactgtggggcaaccacaagaacagagtgaacatgacctacgagaagatgagcagagccctgagacactactacaagctgaacatcatcaagaaggagcccggccagaagctgctgttcagattcctgaagacccccggcaagatggtgcaggacaagcacagccacctggagcccctggagagccaggagcaggacagaatcgagttcaaggacaagagacccgagatcagcccctag

SEQ ID NO: 80746 - DNA, 1242 bp, Artificial Sequence
  Description of Artificial Sequence: Synthetic coding sequence
atggccagctgcgccgagcccagcgagcccagcgcccccctgcccgccggcgtgccccccctggaggacttcgaggtgctggacggcgtggaggacgccgagggcgaggaggaggaggaggaggaggaggaggaggaggacgacctgagcgagctgccccccctggaggacatgggccagccccccgccgaggaggccgagcagcccggcgccctggccagagagttcctggccgccatggagcccgagcccgcccccgcccccgcccccgaggagtggctggacatcctgggcaacggcctgctgagaaagaagaccctggtgcccggcccccccggcagcagcagacccgtgaagggccaggtggtgaccgtgcacctgcagaccagcctggagaacggcaccagagtgcaggaggagcccgagctggtgttcaccctgggcgactgcgacgtgatccaggccctggacctgagcgtgcccctgatggacgtgggcgagaccgccatggtgaccgccgacagcaagtactgctacggcccccagggcagcagaagcccctacatccccccccacgccgccctgtgcctggaggtgaccctgaagaccgccgtggacggccccgacctggagatgctgaccggccaggagagagtggccctggccaacagaaagagagagtgcggcaacgcccactaccagagagccgacttcgtgctggccgccaacagctacgacctggccatcaaggccatcaccagcagcgccaaggtggacatgaccttcgaggaggaggcccagctgctgcagctgaaggtgaagtgcctgaacaacctggccgccagccagctgaagctggaccactacagagccgccctgagaagctgcagcctggtgctggagcaccagcccgacaacatcaaggccctgttcagaaagggcaaggtgctggcccagcagggcgagtacagcgaggccatccccatcctgagagccgccctgaagctggagcccagcaacaagaccatccacgccgagctgagcaagctggtgaagaagcacgccgcccagagaagcaccgagaccgccctgtacagaaagatgctgggcaaccccagcagactgcccgccaagtgccccggcaagggcgcctggagcatcccctggaagtggctgttcggcgccaccgccgtggccctgggcggcgtggccctgagcgtggtgatcgccgccagaaactag

SEQ ID NO: 80747 - DNA, 1422 bp, Artificial Sequence
  Description of Artificial Sequence: Synthetic coding sequence
atgaactacgacaagctgagcagagccctgagatactactacaacaagagaatcctgcacaagaccaagggcaagagattcacctacaagttcaacttcaacaagctggtgctggtgaactaccccttcatcgacgtgggcctggccggcggcgccgtgccccagagcgccccccccgtgcccagcggcggcagccacttcagattcccccccagcacccccagcgaggtgctgagccccaccgaggaccccagaagcccccccgcctgcagcagcagcagcagcagcctgttcagcgccgtggtggccagaagactgggcagaggcagcgtgagcgactgcagcgacggcaccagcgagctggaggagcccctgggcgaggaccccagagccagaccccccggcccccccgacctgggcgccttcagaggcccccccctggccagactgccccacgaccccggcgtgttcagagtgtaccccagacccagaggcggccccgagcccctgagccccttccccgtgagccccctggccggccccggcagcctgctgcccccccagctgagccccgccctgcccatgacccccacccacctggcctacacccccagccccaccctgagccccatgtaccccagcggcggcggcggccccagcggcagcggcggcggcagccacttcagcttcagccccgaggacatgaagagatacctgcaggcccacacccagagcgtgtacaactaccacctgagccccagagccttcctgcactaccccggcctggtggtgccccagccccagagacccgacaagtgccccctgccccccatggcccccgagaccccccccgtgcccagcagcgccagcagcagcagcagcagcagcagcagccccttcaagttcaagctgcagcccccccccctgggcagaagacagagagccgccggcgagaaggccgtggccggcgccgacaagagcggcggcagcgccggcggcctggccgagggcgccggcgccctggcccccccccccccccccccccagatcaaggtggagcccatcagcgagggcgagagcgaggaggtggaggtgaccgacatcagcgacgaggacgaggaggacggcgaggtgttcaagacccccagagccccccccgccccccccaagcccgagcccggcgaggcccccggcgccagccagtgcatgcccctgaagctgagattcaagagaagatggagcgaggactgcagactggagggcggcggcggccccgccggcggcttcgaggacgagggcgaggacaagaaggtgagaggcgagggccccggcgaggccggcggccccctgacccccagaagagtgagcagcgacctgcagcacgccaccgcccagctgagcctggagcacagagacagctag

SEQ ID NO: 80748 - DNA, 2478 bp, Artificial Sequence
  Description of Artificial Sequence: Synthetic coding sequence
atggccgccgacgagggcagcgccgagaagcaggccggcgaggcccacatggccgccgacggcgagaccaacggcagctgcgagaacagcgacgccagcagccacgccaacgccgccaagcacacccaggacagcgccagagtgaacccccaggacggcaccaacaccctgaccagaatcgccgagaacggcgtgagcgagagagacagcgaggccgccaagcagaaccacgtgaccgccgacgacttcgtgcagaccagcgtgatcggcagcaacggctacatcctgaacaagcccgccctgcaggcccagcccctgagaaccaccagcaccctggccagcagcctgcccggccacgccgccaagaccctgcccggcggcgccggcaagggcagaacccccagcgccttcccccagacccccgccgccccccccgccaccctgggcgagggcagcgccgacaccgaggacagaaagctgcccgcccccggcgccgacgtgaaggtgcacagagccagaaagaccatgcccaagagcgtggtgggcctgcacgccgccagcaaggaccccagagaggtgagagaggccagagaccacaaggagcccaaggaggagatcaacaagaacatcagcgacttcggcagacagcagctgctgccccccttccccagcctgcaccagagcctgccccagaaccagtgctacatggccaccaccaagagccagaccgcctgcctgcccttcgtgctggccgccgccgtgagcagaaagaagaagagaagaatgggcacctacagcctggtgcccaagaagaagaccaaggtgctgaagcagagaaccgtgatcgagatgttcaagagcatcacccacagcaccgtgggcagcaagggcgagaaggacctgggcgccagcagcctgcacgtgaacggcgagagcctggagatggacagcgacgaggacgacagcgaggagctggaggaggacgacggccacggcgccgagcaggccgccgccttccccaccgaggacagcagaaccagcaaggagagcatgagcgaggccgacagagcccagaagatggacggcgagagcgaggaggagcaggagagcgtggacaccggcgaggaggaggagggcggcgacgagagcgacctgagcagcgagagcagcatcaagaagaagttcctgaagagaaagggcaagaccgacagcccctggatcaagcccgccagaaagagaagaagaagaagcagaaagaagcccagcggcgccctgggcagcgagagctacaagagcagcgccggcagcgccgagcagaccgcccccggcgacagcaccggctacatggaggtgagcctggacagcctggacctgagagtgaagggcatcctgagcagccaggccgagggcctggccaacggccccgacgtgctggagaccgacggcctgcaggaggtgcccctgtgcagctgcagaatggagacccccaagagcagagagatcaccaccctggccaacaaccagtgcatggccaccgagagcgtggaccacgagctgggcagatgcaccaacagcgtggtgaagtacgagctgatgagacccagcaacaaggcccccctgctggtgctgtgcgaggaccacagaggcagaatggtgaagcaccagtgctgccccggctgcggctacttctgcaccgccggcaacttcatggagtgccagcccgagagcagcatcagccacagattccacaaggactgcgccagcagagtgaacaacgccagctactgcccccactgcggcgaggagagcagcaaggccaaggaggtgaccatcgccaaggccgacaccaccagcaccgtgacccccgtgcccggccaggagaagggcagcgccctggagggcagagccgacaccaccaccggcagcgccgccggcccccccctgagcgaggacgacaagctgcagggcgccgccagccacgtgcccgagggcttcgaccccaccggccccgccggcctgggcagacccacccccggcctgagccagggccccggcaaggagaccctggagagcgccctgatcgccctggacagcgagaagcccaagaagctgagattccaccccaagcagctgtacttcagcgccagacagggcgagctgcagaaggtgctgctgatgctggtggacggcatcgaccccaacttcaagatggagcaccagaacaagagaagccccctgcacgccgccgccgaggccggccacgtggacatctgccacatgctggtgcaggccggcgccaacatcgacacctgcagcgaggaccagagaacccccctgatggaggccgccgagaacaaccacctggaggccgtgaagtacctgatcaaggccggcgccctggtggaccccaagatccagaagaccagcaaggtgtacaccgagagccaggagacccagagaagccagaccatcctgtag

SEQ ID NO: 80749 - DNA, 3462 bp, Artificial Sequence
  Description of Artificial Sequence: Synthetic coding sequence
atggccgccgacgagggcagcgccgagaagcaggccggcgaggcccacatggccgccgacggcgagaccaacggcagctgcgagaacagcgacgccagcagccacgccaacgccgccaagcacacccaggacagcgccagagtgaacccccaggacggcaccaacaccctgaccagaatcgccgagaacggcgtgagcgagagagacagcgaggccgccaagcagaaccacgtgaccgccgacgacttcgtgcagaccagcgtgatcggcagcaacggctacatcctgaacaagcccgccctgcaggcccagcccctgagaaccaccagcaccctggccagcagcctgcccggccacgccgccaagaccctgcccggcggcgccggcaagggcagaacccccagcgccttcccccagacccccgccgccccccccgccaccctgggcgagggcagcgccgacaccgaggacagaaagctgcccgcccccggcgccgacgtgaaggtgcacagagccagaaagaccatgcccaagagcgtggtgggcctgcacgccgccagcaaggaccccagagaggtgagagaggccagagaccacaaggagcccaaggaggagatcaacaagaacatcagcgacttcggcagacagcagctgctgccccccttccccagcctgcaccagagcctgccccagaaccagtgctacatggccaccaccaagagccagaccgcctgcctgcccttcgtgctggccgccgccgtgagcagaaagaagaagagaagaatgggcacctacagcctggtgcccaagaagaagaccaaggtgctgaagcagagaaccgtgatcgagatgttcaagagcatcacccacagcaccgtgggcagcaagggcgagaaggacctgggcgccagcagcctgcacgtgaacggcgagagcctggagatggacagcgacgaggacgacagcgaggagctggaggaggacgacggccacggcgccgagcaggccgccgccttccccaccgaggacagcagaaccagcaaggagagcatgagcgaggccgacagagcccagaagatggacggcgagagcgaggaggagcaggagagcgtggacaccggcgaggaggaggagggcggcgacgagagcgacctgagcagcgagagcagcatcaagaagaagttcctgaagagaaagggcaagaccgacagcccctggatcaagcccgccagaaagagaagaagaagaagcagaaagaagcccagcggcgccctgggcagcgagagctacaagagcagcgccggcagcgccgagcagaccgcccccggcgacagcaccggctacatggaggtgagcctggacagcctggacctgagagtgaagggcatcctgagcagccaggccgagggcctggccaacggccccgacgtgctggagaccgacggcctgcaggaggtgcccctgtgcagctgcagaatggagacccccaagagcagagagatcaccaccctggccaacaaccagtgcatggccaccgagagcgtggaccacgagctgggcagatgcaccaacagcgtggtgaagtacgagctgatgagacccagcaacaaggcccccctgctggtgctgtgcgaggaccacagaggcagaatggtgaagcaccagtgctgccccggctgcggctacttctgcaccgccggcaacttcatggagtgccagcccgagagcagcatcagccacagattccacaaggactgcgccagcagagtgaacaacgccagctactgcccccactgcggcgaggagagcagcaaggccaaggaggtgaccatcgccaaggccgacaccaccagcaccgtgacccccgtgcccggccaggagaagggcagcgccctggagggcagagccgacaccaccaccggcagcgccgccggcccccccctgagcgaggacgacaagctgcagggcgccgccagccacgtgcccgagggcttcgaccccaccggccccgccggcctgggcagacccacccccggcctgagccagggccccggcaaggagaccctggagagcgccctgatcgccctggacagcgagaagcccaagaagctgagattccaccccaagcagctgtacttcagcgccagacagggcgagctgcagaaggtgctgctgatgctggtggacggcatcgaccccaacttcaagatggagcaccagaacaagagaagccccctgcacgccgccgccgaggccggccacgtggacatctgccacatgctggtgcaggccggcgccaacatcgacacctgcagcgaggaccagagaacccccctgatggaggccgccgagaacaaccacctggaggccgtgaagtacctgatcaaggccggcgccctggtggaccccaaggacgccgagggcagcacctgcctgcacctggccgccaagaagggccactacgaggtggtgcagtacctgctgagcaacggccagatggacgtgaactgccaggacgacggcggctggacccccatgatctgggccaccgagtacaagcacgtggacctggtgaagctgctgctgagcaagggcagcgacatcaacatcagagacaacgaggagaacatctgcctgcactgggccgccttcagcggctgcgtggacatcgccgagatcctgctggccgccaagtgcgacctgcacgccgtgaacatccacggcgacagccccctgcacatcgccgccagagagaacagatacgactgcgtggtgctgttcctgagcagagacagcgacgtgaccctgaagaacaaggagggcgagacccccctgcagtgcgccagcctgaacagccaggtgtggagcgccctgcagatgagcaaggccctgcaggacagcgcccccgacagacccagccccgtggagagaatcgtgagcagagacatcgccagaggctacgagagaatccccatcccctgcgtgaacgccgtggacagcgagccctgccccagcaactacaagtacgtgagccagaactgcgtgaccagccccatgaacatcgacagaaacatcacccacctgcagtactgcgtgtgcatcgacgactgcagcagcagcaactgcatgtgcggccagctgagcatgagatgctggtacgacaaggacggcagactgctgcccgagttcaacatggccgagccccccctgatcttcgagtgcaaccacgcctgcagctgctggagaaactgcagaaacagagtggtgcagaacggcctgagagccagactgcagctgtacagaaccagagacatgggctggggcgtgagaagcctgcaggacatcccccccggcaccttcgtgtgcgagtacgtgggcgagctgatcagcgacagcgaggccgacgtgagagaggaggacagctacctgttcgacctggacaacaaggtgatcagcgcctag

SEQ ID NO: 80750 - DNA, 3897 bp, Artificial Sequence
  Description of Artificial Sequence: Synthetic coding sequence
atggccgccgccgacgccgaggccgtgcccgccagaggcgagccccagcaggactgctgcgtgaagaccgagctgctgggcgaggagacccccatggccgccgacgagggcagcgccgagaagcaggccggcgaggcccacatggccgccgacggcgagaccaacggcagctgcgagaacagcgacgccagcagccacgccaacgccgccaagcacacccaggacagcgccagagtgaacccccaggacggcaccaacaccctgaccagaatcgccgagaacggcgtgagcgagagagacagcgaggccgccaagcagaaccacgtgaccgccgacgacttcgtgcagaccagcgtgatcggcagcaacggctacatcctgaacaagcccgccctgcaggcccagcccctgagaaccaccagcaccctggccagcagcctgcccggccacgccgccaagaccctgcccggcggcgccggcaagggcagaacccccagcgccttcccccagacccccgccgccccccccgccaccctgggcgagggcagcgccgacaccgaggacagaaagctgcccgcccccggcgccgacgtgaaggtgcacagagccagaaagaccatgcccaagagcgtggtgggcctgcacgccgccagcaaggaccccagagaggtgagagaggccagagaccacaaggagcccaaggaggagatcaacaagaacatcagcgacttcggcagacagcagctgctgccccccttccccagcctgcaccagagcctgccccagaaccagtgctacatggccaccaccaagagccagaccgcctgcctgcccttcgtgctggccgccgccgtgagcagaaagaagaagagaagaatgggcacctacagcctggtgcccaagaagaagaccaaggtgctgaagcagagaaccgtgatcgagatgttcaagagcatcacccacagcaccgtgggcagcaagggcgagaaggacctgggcgccagcagcctgcacgtgaacggcgagagcctggagatggacagcgacgaggacgacagcgaggagctggaggaggacgacggccacggcgccgagcaggccgccgccttccccaccgaggacagcagaaccagcaaggagagcatgagcgaggccgacagagcccagaagatggacggcgagagcgaggaggagcaggagagcgtggacaccggcgaggaggaggagggcggcgacgagagcgacctgagcagcgagagcagcatcaagaagaagttcctgaagagaaagggcaagaccgacagcccctggatcaagcccgccagaaagagaagaagaagaagcagaaagaagcccagcggcgccctgggcagcgagagctacaagagcagcgccggcagcgccgagcagaccgcccccggcgacagcaccggctacatggaggtgagcctggacagcctggacctgagagtgaagggcatcctgagcagccaggccgagggcctggccaacggccccgacgtgctggagaccgacggcctgcaggaggtgcccctgtgcagctgcagaatggagacccccaagagcagagagatcaccaccctggccaacaaccagtgcatggccaccgagagcgtggaccacgagctgggcagatgcaccaacagcgtggtgaagtacgagctgatgagacccagcaacaaggcccccctgctggtgctgtgcgaggaccacagaggcagaatggtgaagcaccagtgctgccccggctgcggctacttctgcaccgccggcaacttcatggagtgccagcccgagagcagcatcagccacagattccacaaggactgcgccagcagagtgaacaacgccagctactgcccccactgcggcgaggagagcagcaaggccaaggaggtgaccatcgccaaggccgacaccaccagcaccgtgacccccgtgcccggccaggagaagggcagcgccctggagggcagagccgacaccaccaccggcagcgccgccggcccccccctgagcgaggacgacaagctgcagggcgccgccagccacgtgcccgagggcttcgaccccaccggccccgccggcctgggcagacccacccccggcctgagccagggccccggcaaggagaccctggagagcgccctgatcgccctggacagcgagaagcccaagaagctgagattccaccccaagcagctgtacttcagcgccagacagggcgagctgcagaaggtgctgctgatgctggtggacggcatcgaccccaacttcaagatggagcaccagaacaagagaagccccctgcacgccgccgccgaggccggccacgtggacatctgccacatgctggtgcaggccggcgccaacatcgacacctgcagcgaggaccagagaacccccctgatggaggccgccgagaacaaccacctggaggccgtgaagtacctgatcaaggccggcgccctggtggaccccaaggacgccgagggcagcacctgcctgcacctggccgccaagaagggccactacgaggtggtgcagtacctgctgagcaacggccagatggacgtgaactgccaggacgacggcggctggacccccatgatctgggccaccgagtacaagcacgtggacctggtgaagctgctgctgagcaagggcagcgacatcaacatcagagacaacgaggagaacatctgcctgcactgggccgccttcagcggctgcgtggacatcgccgagatcctgctggccgccaagtgcgacctgcacgccgtgaacatccacggcgacagccccctgcacatcgccgccagagagaacagatacgactgcgtggtgctgttcctgagcagagacagcgacgtgaccctgaagaacaaggagggcgagacccccctgcagtgcgccagcctgaacagccaggtgtggagcgccctgcagatgagcaaggccctgcaggacagcgcccccgacagacccagccccgtggagagaatcgtgagcagagacatcgccagaggctacgagagaatccccatcccctgcgtgaacgccgtggacagcgagccctgccccagcaactacaagtacgtgagccagaactgcgtgaccagccccatgaacatcgacagaaacatcacccacctgcagtactgcgtgtgcatcgacgactgcagcagcagcaactgcatgtgcggccagctgagcatgagatgctggtacgacaaggacggcagactgctgcccgagttcaacatggccgagccccccctgatcttcgagtgcaaccacgcctgcagctgctggagaaactgcagaaacagagtggtgcagaacggcctgagagccagactgcagctgtacagaaccagagacatgggctggggcgtgagaagcctgcaggacatcccccccggcaccttcgtgtgcgagtacgtgggcgagctgatcagcgacagcgaggccgacgtgagagaggaggacagctacctgttcgacctggacaacaaggacggcgaggtgtactgcatcgacgccagattctacggcaacgtgagcagattcatcaaccaccactgcgagcccaacctggtgcccgtgagagtgttcatggcccaccaggacctgagattccccagaatcgccttcttcagcaccagactgatcgaggccggcgagcagctgggcttcgactacggcgagagattctgggacatcaagggcaagctgttcagctgcagatgcggcagccccaagtgcagacacagcagcgccgccctggcccagagacaggccagcgccgcccaggaggcccaggaggacggcctgcccgacaccagcagcgccgccgccgccgaccccctgtag

SEQ ID NO: 80751 - DNA, 2427 bp, Artificial Sequence
  Description of Artificial Sequence: Synthetic coding sequence
atggccgccgccgacgccgaggccgtgcccgccagaggcgagccccagcaggactgctgcgtgaagaccgagctgctgggcgaggagacccccatggccgccgacgagggcagcgccgagaagcaggccggcgaggcccacatggccgccgacggcgagaccaacggcagctgcgagaacagcgacgccagcagccacgccaacgccgccaagcacacccaggacagcgccagagtgaacccccaggacggcaccaacaccctgaccagaatcgccgagaacggcgtgagcgagagagacagcgaggccgccaagcagaaccacgtgaccgccgacgacttcgtgcagaccagcgtgatcggcagcaacggctacatcctgaacaagcccgccctgcaggcccagcccctgagaaccaccagcaccctggccagcagcctgcccggccacgccgccaagaccctgcccggcggcgccggcaagggcagaacccccagcgccttcccccagacccccgccgccccccccgccaccctgggcgagggcagcgccgacaccgaggacagaaagctgcccgcccccggcgccgacgtgaaggtgcacagagccagaaagaccatgcccaagagcgtggtgggcctgcacgccgccagcaaggaccccagagaggtgagagaggccagagaccacaaggagcccaaggaggagatcaacaagaacatcagcgacttcggcagacagcagctgctgccccccttccccagcctgcaccagagcctgccccagaaccagtgctacatggccaccaccaagagccagaccgcctgcctgcccttcgtgctggccgccgccgtgagcagaaagaagaagagaagaatgggcacctacagcctggtgcccaagaagaagaccaaggtgctgaagcagagaaccgtgatcgagatgttcaagagcatcacccacagcaccgtgggcagcaagggcgagaaggacctgggcgccagcagcctgcacgtgaacggcgagagcctggagatggacagcgacgaggacgacagcgaggagctggaggaggacgacggccacggcgccgagcaggccgccgccttccccaccgaggacagcagaaccagcaaggagagcatgagcgaggccgacagagcccagaagatggacggcgagagcgaggaggagcaggagagcgtggacaccggcgaggaggaggagggcggcgacgagagcgacctgagcagcgagagcagcatcaagaagaagttcctgaagagaaagggcaagaccgacagcccctggatcaagcccgccagaaagagaagaagaagaagcagaaagaagcccagcggcgccctgggcagcgagagctacaagagcagcgccggcagcgccgagcagaccgcccccggcgacagcaccggctacatggaggtgagcctggacagcctggacctgagagtgaagggcatcctgagcagccaggccgagggcctggccaacggccccgacgtgctggagaccgacggcctgcaggaggtgcccctgtgcagctgcagaatggagacccccaagagcagagagatcaccaccctggccaacaaccagtgcatggccaccgagagcgtggaccacgagctgggcagatgcaccaacagcgtggtgaagtacgagctgatgagacccagcaacaaggcccccctgctggtgctgtgcgaggaccacagaggcagaatggtgaagcaccagtgctgccccggctgcggctacttctgcaccgccggcaacttcatggagtgccagcccgagagcagcatcagccacagattccacaaggactgcgccagcagagtgaacaacgccagctactgcccccactgcggcgaggagagcagcaaggccaaggaggtgaccatcgccaaggccgacaccaccagcaccgtgacccccgtgcccggccaggagaagggcagcgccctggagggcagagccgacaccaccaccggcagcgccgccggcccccccctgagcgaggacgacaagctgcagggcgccgccagccacgtgcccgagggcttcgaccccaccggccccgccggcctgggcagacccacccccggcctgagccagggccccggcaaggagaccctggagagcgccctgatcgccctggacagcgagaagcccaagaagctgagattccaccccaagcagctgtacttcagcgccagacagggcgagctgcagaaggtgctgctgatgctggtggacggcatcgaccccaacttcaagatggagcaccagaacaagagaagccccctgcacgccgccgccgaggccggccacgtggacatctgccacatgctggtgcagttctgcagactgggcagccccagaagcagaggctgcctgtggtag

SEQ ID NO: 80752 - DNA, 3702 bp, Artificial Sequence
  Description of Artificial Sequence: Synthetic coding sequence
atgagaggcctgcccagaggcagaggcctgatgagagccagaggcagaggcagagccgccccccccggcagcagaggcagaggcagaggcggcccccacagaggcagaggcagacccagaagcctgctgagcctgcccagagcccaggccagctggaccccccagctgagcaccggcctgaccagcccccccgtgccctgcctgcccagccagggcgaggcccccgccgagatgggcgccctgctgctggagaaggagaccagaggcgccaccgagagagtgcacggcagcctgggcgacacccccagaagcgaggagaccctgcccaaggccacccccgacagcctggagcccgccggccccagcagccccgccagcgtgaccgtgaccgtgggcgacgagggcgccgacacccccgtgggcgccacccccctgatcggcgacgagagcgagaacctggagggcgacggcgacctgagaggcggcagaatcctgctgggccacgccaccaagagcttccccagcagccccagcaagggcggcagctgccccagcagagccaagatgagcatgaccggcgccggcaagagcccccccagcgtgcagagcctggccatgagactgctgagcatgcccggcgcccagggcgccgccgccgccggcagcgagcccccccccgccaccaccagccccgagggccagcccaaggtgcacagagccagaaagaccatgagcaagcccggcaacggccagccccccgtgcccgagaagagaccccccgagatccagcacttcagaatgagcgacgacgtgcacagcctgggcaaggtgaccagcgacctggccaagagaagaaagctgaacagcggcggcggcctgagcgaggagctgggcagcgccagaagaagcggcgaggtgaccctgaccaagggcgaccccggcagcctggaggagtgggagaccgtggtgggcgacgacttcagcctgtactacgacagctacagcgtggacgagagagtggacagcgacagcaagagcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80753 - DNA, 3531 bp, Artificial Sequence
  Description of Artificial Sequence: Synthetic coding sequence
atggccgccgccgccggcgccgccgccgccgccgccgccgagggcgaggcccccgccgagatgggcgccctgctgctggagaaggagaccagaggcgccaccgagagagtgcacggcagcctgggcgacacccccagaagcgaggagaccctgcccaaggccacccccgacagcctggagcccgccggccccagcagccccgccagcgtgaccgtgaccgtgggcgacgagggcgccgacacccccgtgggcgccacccccctgatcggcgacgagagcgagaacctggagggcgacggcgacctgagaggcggcagaatcctgctgggccacgccaccaagagcttccccagcagccccagcaagggcggcagctgccccagcagagccaagatgagcatgaccggcgccggcaagagcccccccagcgtgcagagcctggccatgagactgctgagcatgcccggcgcccagggcgccgccgccgccggcagcgagcccccccccgccaccaccagccccgagggccagcccaaggtgcacagagccagaaagaccatgagcaagcccggcaacggccagccccccgtgcccgagaagagaccccccgagatccagcacttcagaatgagcgacgacgtgcacagcctgggcaaggtgaccagcgacctggccaagagaagaaagctgaacagcggcggcggcctgagcgaggagctgggcagcgccagaagaagcggcgaggtgaccctgaccaagggcgaccccggcagcctggaggagtgggagaccgtggtgggcgacgacttcagcctgtactacgacagctacagcgtggacgagagagtggacagcgacagcaagagcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80754 - DNA, 3633 bp, Artificial Sequence
  Description of Artificial Sequence: Synthetic coding sequence
atggccgccgccgccggcgccgccgccgccgccgccgccgagggcgaggcccccgccgagatgggcgccctgctgctggagaaggagaccagaggcgccaccgagagagtgcacggcagcctgggcgacacccccagaagcgaggagaccctgcccaaggccacccccgacagcctggagcccgccggccccagcagccccgccagcgtgaccgtgaccgtgggcgacgagggcgccgacacccccgtgggcgccacccccctgatcggcgacgagagcgagaacctggagggcgacggcgacctgagaggcggcagaatcctgctgggccacgccaccaagagcttccccagcagccccagcaagggcggcagctgccccagcagagccaagatgagcatgaccggcgccggcaagagcccccccagcgtgcagagcctggccatgagactgctgagcatgcccggcgcccagggcgccgccgccgccggcagcgagcccccccccgccaccaccagccccgagggccagcccaaggtgcacagagccagaaagaccatgagcaagcccggcaacggccagccccccgtgcccgagaagagaccccccgagatccagcacttcagaatgagcgacgacgtgcacagcctgggcaaggtgaccagcgacctggccaagagaagaaagctgaacagcggcggcggcctgagcgaggagctgggcagcgccagaagaagcggcgaggtgaccctgaccaagggcgaccccggcagcctggaggagtgggagaccgtggtgggcgacgacttcagcctgtactacgacagctacagcgtggacgagagagtggacagcgacagcaagagcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgaacggcgtgggcagcagcggccccagcgagtacatggaggtgcccctgggcagcctggagctgcccagcgagggcaccctgagccccaaccacgccggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80755 - DNA, 3531 bp, Artificial Sequence; identical to SEQ ID NO: 80753
  Description of Artificial Sequence: Synthetic coding sequence

SEQ ID NO: 80756 - DNA, 3633 bp, Artificial Sequence; identical to SEQ ID NO: 80754
  Description of Artificial Sequence: Synthetic coding sequence

SEQ ID NO: 80757 - DNA, 3804 bp, Artificial Sequence
  Description of Artificial Sequence: Synthetic coding sequence
atgagaggcctgcccagaggcagaggcctgatgagagccagaggcagaggcagagccgccccccccggcagcagaggcagaggcagaggcggcccccacagaggcagaggcagacccagaagcctgctgagcctgcccagagcccaggccagctggaccccccagctgagcaccggcctgaccagcccccccgtgccctgcctgcccagccagggcgaggcccccgccgagatgggcgccctgctgctggagaaggagaccagaggcgccaccgagagagtgcacggcagcctgggcgacacccccagaagcgaggagaccctgcccaaggccacccccgacagcctggagcccgccggccccagcagccccgccagcgtgaccgtgaccgtgggcgacgagggcgccgacacccccgtgggcgccacccccctgatcggcgacgagagcgagaacctggagggcgacggcgacctgagaggcggcagaatcctgctgggccacgccaccaagagcttccccagcagccccagcaagggcggcagctgccccagcagagccaagatgagcatgaccggcgccggcaagagcccccccagcgtgcagagcctggccatgagactgctgagcatgcccggcgcccagggcgccgccgccgccggcagcgagcccccccccgccaccaccagccccgagggccagcccaaggtgcacagagccagaaagaccatgagcaagcccggcaacggccagccccccgtgcccgagaagagaccccccgagatccagcacttcagaatgagcgacgacgtgcacagcctgggcaaggtgaccagcgacctggccaagagaagaaagctgaacagcggcggcggcctgagcgaggagctgggcagcgccagaagaagcggcgaggtgaccctgaccaagggcgaccccggcagcctggaggagtgggagaccgtggtgggcgacgacttcagcctgtactacgacagctacagcgtggacgagagagtggacagcgacagcaagagcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgaacggcgtgggcagcagcggccccagcgagtacatggaggtgcccctgggcagcctggagctgcccagcgagggcaccctgagccccaaccacgccggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80758 - DNA, 3804 bp, Artificial Sequence; identical to SEQ ID NO: 80757
  Description of Artificial Sequence: Synthetic coding sequence

SEQ ID NO: 80759 - DNA, 3702 bp, Artificial Sequence; identical to SEQ ID NO: 80752
  Description of Artificial Sequence: Synthetic coding sequence

SEQ ID NO: 80760 - DNA, 3804 bp, Artificial Sequence
  Description of Artificial Sequence: Synthetic coding sequence
atgagaggcctgcccagaggcagaggcctgatgagagccagaggcagaggcagagccgccccccccggcagcagaggcagaggcagaggcggcccccacagaggcagaggcagacccagaagcctgctgagcctgcccagagcccaggccagctggaccccccagctgagcaccggcctgaccagcccccccgtgccctgcctgcccagccagggcgaggcccccgccgagatgggcgccctgctgctggagaaggagaccagaggcgccaccgagagagtgcacggcagcctgggcgacacccccagaagcgaggagaccctgcccaaggccaaccccgacagcctggagcccgccggccccagcagccccgccagcgtgaccgtgaccgtgggcgacgagggcgccgacacccccgtgggcgccacccccctgatcggcgacgagagcgagaacctggagggcgacggcgacctgagaggcggcagaatcctgctgggccacgccaccaagagcttccccagcagccccagcaagggcggcagctgccccagcagagccaagatgagcatgaccggcgccggcaagagcccccccagcgtgcagagcctggccatgagactgctgagcatgcccggcgcccagggcgccgccgccgccggcagcgagcccccccccgccaccaccagccccgagggccagcccaaggtgcacagagccagaaagaccatgagcaagcccggcaacggccagccccccgtgcccgagaagagaccccccgagatccagcacttcagaatgagcgacgacgtgcacagcctgggcaaggtgaccagcgacctggccaagagaagaaagctgaacagcggcggcggcctgagcgaggagctgggcagcgccagaagaagcggcgaggtgaccctgaccaagggcgaccccggcagcctggaggagtgggagaccgtggtgggcgacgacttcagcctgtactacgacagctacagcgtggacgagagagtggacagcgacagcaagagcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgaacggcgtgggcagcagcggccccagcgagtacatggaggtgcccctgggcagcctggagctgcccagcgagggcaccctgagccccaaccacgccggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80761 - DNA, 897 bp, Artificial Sequence
  Description of Artificial Sequence: Synthetic coding sequence
tgaagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccagggccagctgcccccccccagcctgcccagccacccccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaactag

SEQ ID NO: 80762 - DNA, 3633 bp, Artificial Sequence
  Description of Artificial Sequence: Synthetic coding sequence
atggccgccgccgccggcgccgccgccgccgccgccgccgagggcgaggcccccgccgagatgggcgccctgctgctggagaaggagaccagaggcgccaccgagagagtgcacggcagcctgggcgacacccccagaagcgaggagaccctgcccaaggccaaccccgacagcctggagcccgccggccccagcagccccgccagcgtgaccgtgaccgtgggcgacgagggcgccgacacccccgtgggcgccacccccctgatcggcgacgagagcgagaacctggagggcgacggcgacctgagaggcggcagaatcctgctgggccacgccaccaagagcttccccagcagccccagcaagggcggcagctgccccagcagagccaagatgagcatgaccggcgccggcaagagcccccccagcgtgcagagcctggccatgagactgctgagcatgcccggcgcccagggcgccgccgccgccggcagcgagcccccccccgccaccaccagccccgagggccagcccaaggtgcacagagccagaaagaccatgagcaagcccggcaacggccagccccccgtgcccgagaagagaccccccgagatccagcacttcagaatgagcgacgacgtgcacagcctgggcaaggtgaccagcgacctggccaagagaagaaagctgaacagcggcggcggcctgagcgaggagctgggcagcgccagaagaagcggcgaggtgaccctgaccaagggcgaccccggcagcctggaggagtgggagaccgtggtgggcgacgacttcagcctgtactacgacagctacagcgtggacgagagagtggacagcgacagcaagagcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgaacggcgtgggcagcagcggccccagcgagtacatggaggtgcccctgggcagcctggagctgcccagcgagggcaccctgagccccaaccacgccggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80763 - DNA, 897 bp, Artificial Sequence; identical to SEQ ID NO: 80761
  Description of Artificial Sequence: Synthetic coding sequence

SEQ ID NO: 80764 - DNA, 3531 bp, Artificial Sequence; identical to SEQ ID NO: 80753
  Description of Artificial Sequence: Synthetic coding sequence

SEQ ID NO: 80765 - DNA, 3804 bp, Artificial Sequence; identical to SEQ ID NO: 80757
  Description of Artificial Sequence: Synthetic coding sequence

SEQ ID NO: 80766 - DNA, 3633 bp, Artificial Sequence; identical to SEQ ID NO: 80762
  Description of Artificial Sequence: Synthetic coding sequence

SEQ ID NO: 80767 - DNA, 897 bp, Artificial Sequence; identical to SEQ ID NO: 80761
  Description of Artificial Sequence: Synthetic coding sequence

SEQ ID NO: 80768 - DNA, 2769 bp, Artificial Sequence
  Description of Artificial Sequence: Synthetic coding sequence
agcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgaacggcgtgggcagcagcggccccagcgagtacatggaggtgcccctgggcagcctggagctgcccagcgagggcaccctgagccccaaccacgccggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80769 - DNA, 3702 bp, Artificial Sequence
  Description of Artificial Sequence: Synthetic coding sequence
atgagaggcctgcccagaggcagaggcctgatgagagccagaggcagaggcagagccgccccccccggcagcagaggcagaggcagaggcggcccccacagaggcagaggcagacccagaagcctgctgagcctgcccagagcccaggccagctggaccccccagctgagcaccggcctgaccagcccccccgtgccctgcctgcccagccagggcgaggcccccgccgagatgggcgccctgctgctggagaaggagaccagaggcgccaccgagagagtgcacggcagcctgggcgacacccccagaagcgaggagaccctgcccaaggccaaccccgacagcctggagcccgccggccccagcagccccgccagcgtgaccgtgaccgtgggcgacgagggcgccgacacccccgtgggcgccacccccctgatcggcgacgagagcgagaacctggagggcgacggcgacctgagaggcggcagaatcctgctgggccacgccaccaagagcttccccagcagccccagcaagggcggcagctgccccagcagagccaagatgagcatgaccggcgccggcaagagcccccccagcgtgcagagcctggccatgagactgctgagcatgcccggcgcccagggcgccgccgccgccggcagcgagcccccccccgccaccaccagccccgagggccagcccaaggtgcacagagccagaaagaccatgagcaagcccggcaacggccagccccccgtgcccgagaagagaccccccgagatccagcacttcagaatgagcgacgacgtgcacagcctgggcaaggtgaccagcgacctggccaagagaagaaagctgaacagcggcggcggcctgagcgaggagctgggcagcgccagaagaagcggcgaggtgaccctgaccaagggcgaccccggcagcctggaggagtgggagaccgtggtgggcgacgacttcagcctgtactacgacagctacagcgtggacgagagagtggacagcgacagcaagagcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80770 - DNA, 3702 bp, Artificial Sequence; identical to SEQ ID NO: 80752
  Description of Artificial Sequence: Synthetic coding sequence

SEQ ID NO: 80771 - DNA, 3633 bp, Artificial Sequence; identical to SEQ ID NO: 80754
  Description of Artificial Sequence: Synthetic coding sequence

SEQ ID NO: 80772 - DNA, 897 bp, Artificial Sequence; identical to SEQ ID NO: 80761
  Description of Artificial Sequence: Synthetic coding sequence

SEQ ID NO: 80773 - DNA, 3804 bp, Artificial Sequence; identical to SEQ ID NO: 80757
  Description of Artificial Sequence: Synthetic coding sequence

SEQ ID NO: 80774 - DNA, 2667 bp, Artificial Sequence
  Description of Artificial Sequence: Synthetic coding sequence
agcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80775 - DNA, 3531 bp, Artificial Sequence
  Description of Artificial Sequence: Synthetic coding sequence
atggccgccgccgccggcgccgccgccgccgccgccgccgagggcgaggcccccgccgagatgggcgccctgctgctggagaaggagaccagaggcgccaccgagagagtgcacggcagcctgggcgacacccccagaagcgaggagaccctgcccaaggccaaccccgacagcctggagcccgccggccccagcagccccgccagcgtgaccgtgaccgtgggcgacgagggcgccgacacccccgtgggcgccacccccctgatcggcgacgagagcgagaacctggagggcgacggcgacctgagaggcggcagaatcctgctgggccacgccaccaagagcttccccagcagccccagcaagggcggcagctgccccagcagagccaagatgagcatgaccggcgccggcaagagcccccccagcgtgcagagcctggccatgagactgctgagcatgcccggcgcccagggcgccgccgccgccggcagcgagcccccccccgccaccaccagccccgagggccagcccaaggtgcacagagccagaaagaccatgagcaagcccggcaacggccagccccccgtgcccgagaagagaccccccgagatccagcacttcagaatgagcgacgacgtgcacagcctgggcaaggtgaccagcgacctggccaagagaagaaagctgaacagcggcggcggcctgagcgaggagctgggcagcgccagaagaagcggcgaggtgaccctgaccaagggcgaccccggcagcctggaggagtgggagaccgtggtgggcgacgacttcagcctgtactacgacagctacagcgtggacgagagagtggacagcgacagcaagagcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80776 - DNA, 3096 bp, Artificial Sequence
  Description of Artificial Sequence: Synthetic coding sequence
agctgccactgcacccccagctggccccccgtgcccgagaagagaccccccgagatccagcacttcagaatgagcgacgacgtgcacagcctgggcaaggtgaccagcgacctggccaagagaagaaagctgaacagcggcggcggcctgagcgaggagctgggcagcgccagaagaagcggcgaggtgaccctgaccaagggcgaccccggcagcctggaggagtgggagaccgtggtgggcgacgacttcagcctgtactacgacagctacagcgtggacgagagagtggacagcgacagcaagagcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgaacggcgtgggcagcagcggccccagcgagtacatggaggtgcccctgggcagcctggagctgcccagcgagggcaccctgagccccaaccacgccggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgtgagcgagagactggtggaggaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80777 - DNA, 3702 bp, Artificial Sequence; identical to SEQ ID NO: 80752
  Description of Artificial Sequence: Synthetic coding sequence

SEQ ID NO: 80778 - DNA, 3804 bp, Artificial Sequence; identical to SEQ ID NO: 80760
  Description of Artificial Sequence: Synthetic coding sequence

SEQ ID NO: 80779 - DNA, 897 bp, Artificial Sequence; identical to SEQ ID NO: 80761
  Description of Artificial Sequence: Synthetic coding sequence

SEQ ID NO: 80780 - DNA, 897 bp, Artificial Sequence; identical to SEQ ID NO: 80761
  Description of Artificial Sequence: Synthetic coding sequence

SEQ ID NO: 80781 - DNA, 3633 bp, Artificial Sequence; identical to SEQ ID NO: 80754
  Description of Artificial Sequence: Synthetic coding sequence

SEQ ID NO: 80782 - DNA, 3531 bp, Artificial Sequence; identical to SEQ ID NO: 80753
  Description of Artificial Sequence: Synthetic coding sequence

SEQ ID NO: 80783 - DNA, 3702 bp, Artificial Sequence; identical to SEQ ID NO: 80769
  Description of Artificial Sequence: Synthetic coding sequence

SEQ ID NO: 80784 - DNA, 897 bp, Artificial Sequence; identical to SEQ ID NO: 80761
  Description of Artificial Sequence: Synthetic coding sequence

SEQ ID NO: 80785 - DNA, 3531 bp, Artificial Sequence; identical to SEQ ID NO: 80775
  Description of Artificial Sequence: Synthetic coding sequence

SEQ ID NO: 80786 - DNA, 2667 bp, Artificial Sequence; identical to SEQ ID NO: 80774
  Description of Artificial Sequence: Synthetic coding sequence

SEQ ID NO: 80787 - DNA, 2769 bp, Artificial Sequence; identical to SEQ ID NO: 80768
  Description of Artificial Sequence: Synthetic coding sequence

SEQ ID NO: 80788 - DNA, 3096 bp, Artificial Sequence
  Description of Artificial Sequence: Synthetic coding sequence
agctgccactgcacccccagcagaccccccgtgcccgagaagagaccccccgagatccagcacttcagaatgagcgacgacgtgcacagcctgggcaaggtgaccagcgacctggccaagagaagaaagctgaacagcggcggcggcctgagcgaggagctgggcagcgccagaagaagcggcgaggtgaccctgaccaagggcgaccccggcagcctggaggagtgggagaccgtggtgggcgacgacttcagcctgtactacgacagctacagcgtggacgagagagtggacagcgacagcaagagcgaggtggaggccctgaccgagcagctgagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaagtggagaaaggacagcccctgggtgaagcccagcagaaagagaagaaagagagagccccccagagccaaggagcccagaggcgtgaacggcgtgggcagcagcggccccagcgagtacatggaggtgcccctgggcagcctggagctgcccagcgagggcaccctgagccccaaccacgccggcgtgagcaacgacaccagcagcctggagaccgagagaggcttcgaggagctgcccctgtgcagctgcagaatggaggcccccaagatcgacagaatcagcgagagagccggccacaagtgcatggccaccgagagcgtggacggcgagctgagcggctgcaacgccgccatcctgaagagagagaccatgagacccagcagcagagtggccctgatggtgctgtgcgagacccacagagccagaatggtgaagcaccactgctgccccggctgcggctacttctgcaccgccggcaccttcctggagtgccaccccgacttcagagtggcccacagattccacaaggcctgcgtgagccagctgaacggcatggtgttctgcccccactgcggcgaggacgccagcgaggcccaggaggtgaccatccccagaggcgacggcgtgaccccccccgccggcaccgccgcccccgcccccccccccctgagccaggacgtgcccggcagagccgacaccagccagcccagcgccagaatgagaggccacggcgagcccagaagacccccctgcgaccccctggccgacaccatcgacagcagcggccccagcctgaccctgcccaacggcggctgcctgagcgccgtgggcctgcccctgggccccggcagagaggccctggagaaggccctggtgatccaggagagcgagagaagaaagaagctgagattccaccccagacagctgtacctgagcgtgaagcagggcgagctgcagaaggtgatcctgatgctgctggacaacctggaccccaacttccagagcgaccagcagagcaagagaacccccctgcacgccgccgcccagaagggcagcgtggagatctgccacgtgctgctgcaggccggcgccaacatcaacgccgtggacaagcagcagagaacccccctgatggaggccgtggtgaacaaccacctggaggtggccagatacatggtgcagagaggcggctgcgtgtacagcaaggaggaggacggcagcacctgcctgcaccacgccgccaagatcggcaacctggagatggtgagcctgctgctgagcaccggccaggtggacgtgaacgcccaggacagcggcggctggacccccatcatctgggccgccgagcacaagcacatcgaggtgatcagaatgctgctgaccagaggcgccgacgtgaccctgaccgacaacgtgagcgagagactggtggaggaggagaacatctgcctgcactgggccagcttcaccggcagcgccgccatcgccgaggtgctgctgaacgccagatgcgacctgcacgccgtgaactaccacggcgacacccccctgcacatcgccgccagagagagctaccacgactgcgtgctgctgttcctgagcagaggcgccaaccccgagctgagaaacaaggagggcgacaccgcctgggacctgacccccgagagaagcgacgtgtggttcgccctgcagctgaacagaaagctgagactgggcgtgggcaacagagccatcagaaccgagaagatcatctgcagagacgtggccagaggctacgagaacgtgcccatcccctgcgtgaacggcgtggacggcgagccctgccccgaggactacaagtacatcagcgagaactgcgagaccagcaccatgaacatcgacagaaacatcacccacctgcagcactgcacctgcgtggacgactgcagcagcagcaactgcctgtgcggccagctgagcatcagatgctggtacgacaaggacggcagactgctgcaggagttcaacaagatcgagccccccctgatcttcgagtgcaaccaggcctgcagctgctggagaaactgcaagaacagagtggtgcagagcggcatcaaggtgagactgcagctgtacagaaccgccaagatgggctggggcgtgagagccctgcagaccatcccccagggcaccttcatctgcgagtacgtgggcgagctgatcagcgacgccgaggccgacgtgagagaggacgacagctacctgttcgacctggacaacaaggacggcgaggtgtactgcatcgacgccagatactacggcaacatcagcagattcatcaaccacctgtgcgaccccaacatcatccccgtgagagtgttcatgctgcaccaggacctgagattccccagaatcgccttcttcagcagcagagacatcagaaccggcgaggagctgggcttcgactacggcgacagattctgggacatcaagagcaagtacttcacctgccagtgcggcagcgagaagtgcaagcacagcgccgaggccatcgccctggagcagagcagactggccagactggacccccaccccgagctgctgcccgagctgggcagcctgccccccgtgaacacctag

SEQ ID NO: 80789 - DNA, 3096 bp, Artificial Sequence; identical to SEQ ID NO: 80776
  Description of Artificial Sequence: Synthetic coding sequence

SEQ ID NO: 80790 - DNA, 3096 bp, Artificial Sequence; identical to SEQ ID NO: 80776
  Description of Artificial Sequence: Synthetic coding sequence

SEQ ID NO: 80791 - DNA, 3096 bp, Artificial Sequence; identical to SEQ ID NO: 80788
  Description of Artificial Sequence: Synthetic coding sequence

SEQ ID NO: 80792 - DNA, 3096 bp, Artificial Sequence; identical to SEQ ID NO: 80776
  Description of Artificial Sequence: Synthetic coding sequence

SEQ ID NO: 80793 - DNA, 2178 bp, Artificial Sequence
  Description of Artificial Sequence: Synthetic coding sequence
atggccgacgaggacctgatcttcagactggagggcgtggacggcggccagagccccagagccggccacgacggcgacagcgacggcgacagcgacgacgaggagggctacttcatctgccccatcaccgacgaccccagcagcaaccagaacgtgaacagcaaggtgaacaagtactacagcaacctgaccaagagcgagagatacagcagcagcggcagccccgccaacagcttccacttcaaggaggcctggaagcacgccatccagaaggccaagcacatgcccgacccctgggccgagttccacctggaggacatcgccaccgagagagccaccagacacagatacaacgccgtgaccggcgagtggctggacgacgaggtgctgatcaagatggccagccagcccttcggcagaggcgccatgagagagtgcttcagaaccaagaagctgagcaacttcctgcacgcccagcagtggaagggcgccagcaactacgtggccaagagatacatcgagcccgtggacagagacgtgtacttcgaggacgtgagactgcagatggaggccaagctgtggggcgaggagtacaacagacacaagccccccaagcaggtggacatcatgcagatgtgcatcatcgagctgaaggacagacccggcaagcccctgttccacctggagcactacatcgagggcaagtacatcaagtacaacagcaacagcggcttcgtgagagacgacaacatcagactgaccccccaggccttcagccacttcaccttcgagagaagcggccaccagctgatcgtggtggacatccagggcgtgggcgacctgtacaccgacccccagatccacaccgagaccggcaccgacttcggcgacggcaacctgggcgtgagaggcatggccctgttcttctacagccacgcctgcaacagaatctgcgagagcatgggcctggcccccttcgacctgagccccagagagagagacgccgtgaaccagaacaccaagctgctgcagagcgccaagaccatcctgagaggcaccgaggagaagtgcggcagcccccaggtgagaaccctgagcggcagcagaccccccctgctgagacccctgagcgagaacagcggcgacgagaacatgagcgacgtgaccttcgacagcctgcccagcagccccagcagcgccaccccccacagccagaagctggaccacctgcactggcccgtgttcagcgacctggacaacatggccagcagagaccacgaccacctggacaaccacagagagagcgagaacagcggcgacagcggctaccccagcgagaagagaggcgagctggacgaccccgagcccagagagcacggccacagctacagcaacagaaagtacgagagcgacgaggacagcctgggcagcagcggcagagtgtgcgtggagaagtggaacctgctgaacagcagcagactgcacctgcccagagccagcgccgtggccctggaggtgcagagactgaacgccctggacctggagaagaagatcggcaagagcatcctgggcaaggtgcacctggccatggtgagataccacgagggcggcagattctgcgagaagggcgaggagtgggaccaggagagcgccgtgttccacctggagcacgccgccaacctgggcgagctggaggccatcgtgggcctgggcctgatgtacagccagctgccccaccacatcctggccgacgtgagcctgaaggagaccgaggagaacaagaccaagggcttcgactacctgctgaaggccgccgaggccggcgacagacagagcatgatcctggtggccagagccttcgacagcggccagaacctgagccccgacagatgccaggactggctggaggccctgcactggtacaacaccgccctggagatgaccgactgcgacgagggcggcgagtacgacggcatgcaggacgagcccagatacatgatgctggccagagaggccgagatgctgttcaccggcggctacggcctggagaaggacccccagagaagcggcgacctgtacacccaggccgccgaggccgccatggaggccatgaagggcagactggccaaccagtactaccagaaggccgaggaggcctgggcccagatggaggagtag

SEQ ID NO: 80794 - DNA, 1389 bp, Artificial Sequence
  Description of Artificial Sequence: Synthetic coding sequence
atgggcaaggagaagacccacatcaacatcgtggtgatcggccacgtggacagcggcaagagcaccaccaccggccacctgatctacaagtgcggcggcatcgacaagagaaccatcgagaagttcgagaaggaggccgccgagatgggcaagggcagcttcaagtacgcctgggtgctggacaagctgaaggccgagagagagagaggcatcaccatcgacatcagcctgtggaagttcgagaccagcaagtactacgtgaccatcatcgacgcccccggccacagagacttcatcaagaacatgatcaccggcaccagccaggccgactgcgccgtgctgatcgtggccgccggcgtgggcgagttcgaggccggcatcagcaagaacggccagaccagagagcacgccctgctggcctacaccctgggcgtgaagcagctgatcgtgggcgtgaacaagatggacagcaccgagcccccctacagccagaagagatacgaggagatcgtgaaggaggtgagcacctacatcaagaagatcggctacaaccccgacaccgtggccttcgtgcccatcagcggctggaacggcgacaacatgctggagcccagcgccaacatgccctggttcaagggctggaaggtgaccagaaaggacggcaacgccagcggcaccaccctgctggaggccctggactgcatcctgccccccaccagacccaccgacaagcccctgagactgcccctgcaggacgtgtacaagatcggcggcatcggcaccgtgcccgtgggcagagtggagaccggcgtgctgaagcccggcatggtggtgaccttcgcccccgtgaacgtgaccaccgaggtgaagagcgtggagatgcaccacgaggccctgagcgaggccctgcccggcgacaacgtgggcttcaacgtgaagaacgtgagcgtgaaggacgtgagaagaggcaacgtggccggcgacagcaagaacgacccccccatggaggccgccggcttcaccgcccaggtgatcatcctgaaccaccccggccagatcagcgccggctacgcccccgtgctggactgccacaccgcccacatcgcctgcaagttcgccgagctgaaggagaagatcgacagaagaagcggcaagaagctggaggacggccccaagttcctgaagagcggcgacgccgccatcgtggacatggtgcccggcaagcccatgtgcgtggagagcttcagcgactacccccccctgggcagattcgccgtgagagacatgagacagaccgtggccgtgggcgtgatcaaggccgtggacaagaaggccgccggcgccggcaaggtgaccaagagcgcccagaaggcccagaaggccaagtag

SEQ ID NO: 80795 - DNA, 1389 bp, Artificial Sequence; identical to SEQ ID NO: 80794
  Description of Artificial Sequence: Synthetic coding sequence

SEQ ID NO: 80796 - DNA, 1389 bp, Artificial Sequence; identical to SEQ ID NO: 80794
  Description of Artificial Sequence: Synthetic coding sequence

SEQ ID NO: 80797 - DNA, 438 bp, Artificial Sequence
  Description of Artificial Sequence: Synthetic coding sequence
atgggcaaggagaagacccacatcaacatcgtggtgatcggccacgtggacagcggcaagagcaccaccaccggccacctgatctacaagtgcggcggcatcgacaagagaaccatcgagaagttcgagaaggaggccgccgagatgggcaagggcagcttcaagtacgcctgggtgctggacaagctgaaggccgagagagagagaggcatcaccatcgacatcagcctgtggaagttcgagaccagcaagtactacgtgaccatcatcgacgcccccggccacagagacttcatcaagaacatgatcaccggcaccagccaggccgactgcgccgtgctgatcgtggccgccggcgtgggcgagttcgaggccggcatcagcaagaacggccagaccagagagcacgccctgctggcctacaccctgggcgtgtag

SEQ ID NO: 80798 - DNA, 1281 bp, Artificial Sequence
  Description of Artificial Sequence: Synthetic coding sequence
atgggcaaggagaagacccacatcaacatcgtggtgatcggccacgtggacagcggcaagagcaccaccaccggccacctgatctacaagtgcggcggcatcgacaagagaaccatcgagaagttcgagaaggaggccgccgagatgggcaagggcagcttcaagtacgcctgggtgctggacaagctgaaggccgagagagagagaggcatcaccatcgacatcagcctgtggaagttcgagaccagcaagtactacgtgaccatcatcgacgcccccggccacagagacttcatcaagaacatgatcaccggcaccagccaggccgactgcgccgtgctgatcgtggccgccggcgtgggcgagttcgaggccggcatcagcaagaacggccagaccagagagcacgccctgctggcctacaccctgggcgtgaagcagctgatcgtgggcgtgaacaagatggacagcaccgagcccccctacagccagaagagatacgaggagatcgtgaaggaggtgagcacctacatcaagaagatcggctacaaccccgacaccgtggccttcgtgcccatcagcggctggaacggcgacaacatgctggagcccagcgccaacatgccctggttcaagggctggaaggtgaccagaaaggacggcaacgccagcggcaccaccctgctggaggccctggactgcatcctgccccccaccagacccaccgacaagcccctgagactgcccctgcaggacgtgtacaagatcggcggcatcggcaccgtgcccgtgcccagcggcgactggtgcagccccggcatggtggtgaccttcgcccccgtgaacgtgaccaccgaggtgaagagcgtggagatgcaccacgaggccctgagcgaggccctgcccggcgacaacgtgggcttcaacgtgaagaacgtgagcgtgaaggacgtgagaagaggcaacgtggccggcgacagcaagaacgacccccccatggaggccgccggcttcaccgcccaggtgatcatcctgaaccaccccggccagatcagcgccggctacgcccccgtgctggactgccacaccgcccacatcgcctgcaagttcgccgagctgaaggagaagatcgacagaagaagcggcaagaagctggaggacggccccaagttcctgaagagcggcgacgccgccatcgtggacatggtgcccggcaagcccatgtgcgtggagagcttcagcgactacccccccctgggcaagagcctgtgctgcagctag

SEQ ID NO: 80799 - DNA, 1326 bp, Artificial Sequence
  Description of Artificial Sequence: Synthetic coding sequence
atgggcaaggagaagacccacatcaacatcgtggtgatcggccacgtggacagcggcaagagcaccaccaccggccacctgatctacaagtgcggcggcatcgacaagagaaccatcgagaagttcgagaaggaggccgccgagatgggcaagggcagcttcaagtacgcctgggtgctggacaagctgaaggccgagagagagagaggcatcaccatcgacatcagcctgtggaagttcgagaccagcaagtactacgtgaccatcatcgacgcccccggccacagagacttcatcaagaacatgatcaccggcaccagccaggccgactgcgccgtgctgatcgtggccgccggcgtgggcgagttcgaggccggcatcagcaagaacggccagaccagagagcacgccctgctggcctacagccagaagagatacgaggagatcgtgaaggaggtgagcacctacatcaagaagatcggctacaaccccgacaccgtggccttcgtgcccatcagcggctggaacggcgacaacatgctggagcccagcgccaacatgccctggttcaagggctggaaggtgaccagaaaggacggcaacgccagcggcaccaccctgctggaggccctggactgcatcctgccccccaccagacccaccgacaagcccctgagactgcccctgcaggacgtgtacaagatcggcggcatcggcaccgtgcccgtgggcagagtggagaccggcgtgctgaagcccggcatggtggtgaccttcgcccccgtgaacgtgaccaccgaggtgaagagcgtggagatgcaccacgaggccctgagcgaggccctgcccggcgacaacgtgggcttcaacgtgaagaacgtgagcgtgaaggacgtgagaagaggcaacgtggccggcgacagcaagaacgacccccccatggaggccgccggcttcaccgcccaggtgatcatcctgaaccaccccggccagatcagcgccggctacgcccccgtgctggactgccacaccgcccacatcgcctgcaagttcgccgagctgaaggagaagatcgacagaagaagcggcaagaagctggaggacggccccaagttcctgaagagcggcgacgccgccatcgtggacatggtgcccggcaagcccatgtgcgtggagagcttcagcgactacccccccctgggcagattcgccgtgagagacatgagacagaccgtggccgtgggcgtgatcaaggccgtggacaagaaggccgccggcgccggcaaggtgaccaagagcgcccagaaggcccagaaggccaagtag

SEQ ID NO: 80800 - DNA, 324 bp, Artificial Sequence
  Description of Artificial Sequence: Synthetic coding sequence
atgggcaaggagaagacccacatcaacatcgtggtgatcggccacgtggacagcggcaagagcaccaccaccggccacctgatctacaagtgcggcggcatcgacaagagaaccatcgagaagttcgagaaggaggccgccgagatgggcaagggcagcttcaagtacgcctgggtgctggacaagctgaaggccgagagagagagaggcatcaccatcgacatcagcctgtggaagttcgagaccagcaagtactacgtgaccatcatcgacgcccccggccacagagacttcatcaagaacatgatcaccggcaccagctag

SEQ ID NO: 80801 - DNA, 336 bp, Artificial Sequence
  Description of Artificial Sequence: Synthetic coding sequence
atgggcaaggagaagacccacatcaacatcgtggtgatcggccacgtggacagcggcaagagcaccaccaccggccacctgatctacaagtgcggcggcatcgacaagagaaccatcgagaagttcgagaaggaggccgccgagatgggcaagggcagcttcaagtacgcctgggtgctggacaagctgaaggccgagagagagagaggcatcaccatcgacatcagcctgtggaagttcgagaccaccaagcagtggaccagaagactgctggagctggccagaagccccagcctgcccagaaagctgagaagactgaacgagtactacccctag

SEQ ID NO: 80802 - DNA, 1626 bp, Artificial Sequence
  Description of Artificial Sequence: Synthetic coding sequence
atggtgatcaacctgtgcctgccccagttcagacccagaatccactgcaacaagatcagcgccgacggctacgaggtggagaacctgatcagcgaggacctgaccaagagaagccacggcttcagaaccgagtacttcatcaagccccccgtgtacgtgaccgtgagcttccccttcaacgtggagatctgcagaatcaacatcgacctgaccgccggcggcggccagaacgtgaccggcctggagatgtacaccagcgccagcagcagcagagtgagctggaacaccccccagtgcagaaccctgggccccgccgagcccagcgtgcccgacaaggaggccttcaccctggtgggcaaggtgctgctgaagaaccagagccaggtggtgttcagccacagaggcttcaaggccagaccccccttcggcgccatggaggccaccctgcccagccccgccgtggtggcccaggagctgtggaacaagggcgccctgagcctgagccacgtggcccacctgagaatctgcatcacccacgtgaccggcggcggcatcccctgcatcaagagactggaggtgtggggccagcccgccaagacctgcagccaggaggtgatcgacagcatcctgctggtgaccagcgagaacctgccccaggacgtggccctgcaggcccccgccctgcccatggagagcgactgcgaccccggcgaccagcccgagagccagcaggcccccagcagcctgcagaagctggccgagatcatccaggacgtgcccgaggagttcctggaccccatcaccctggagatcatgccctgccccatgctgctgcccagcggcaaggtgatcgaccagagcaccctggagaagtgcaacagaagcgaggccacctggggcagagtgcccagcgaccccttcaccggcgtggccttcaccccccacagccagcccctgccccaccccagcctgaaggccagaatcgaccacttcctgctgcagcacagcatccccggctgccacctgctgggcagagcccagaccgccctggccgtgatccccagcagcatcgtgctgcccagccagaagagaaagatcgagcaggccgagcacgtgcccgacagcaacttcggcgtgaacgccagctgcttcagcgccaccagccccctggtgctgcccaccaccagcgagcacaccgccaagaagatgaaggccaccaacgagcccagcctgacccacatggactgcagcaccggccccctgagccacgagcagaagctgagccagagcctggagatcgccctggccagcaccctgggcagcatgcccagcttcaccgccagactgaccagaggccagctgcagcacctgggcaccagaggcagcaacaccagctggagacccggcaccggcagcgagcagcccggcagcatcctgggccccgagtgcgccagctgcaagagagtgttcagcccctacttcaagaaggagcccgtgtaccagctgccctgcggccacctgctgtgcagaccctgcctgggcgagaagcagagaagcctgcccatgacctgcaccgcctgccagagacccgtggccagccaggacgtgctgagagtgcacttctag

SEQ ID NO: 80803 - DNA, 1392 bp, Artificial Sequence
  Description of Artificial Sequence: Synthetic coding sequence
atgggcaaggagaagacccacatcaacatcgtggtgatcggccacgtggacagcggcaagagcaccaccaccggccacctgatctacaagtgcggcggcatcgacaagagaaccatcgagaagttcgagaaggaggccgccgagatgggcaagggcagcttcaagtacgcctgggtgctggacaagctgaaggccgagagagagagaggcatcaccatcgacatcagcctgtggaagttcgagaccaccaagtactacatcaccatcatcgacgcccccggccacagagacttcatcaagaacatgatcaccggcaccagccaggccgactgcgccgtgctgatcgtggccgccggcgtgggcgagttcgaggccggcatcagcaagaacggccagaccagagagcacgccctgctggcctacaccctgggcgtgaagcagctgatcgtgggcgtgaacaagatggacagcaccgagcccgcctacagcgagaagagatacgacgagatcgtgaaggaggtgagcgcctacatcaagaagatcggctacaaccccgccaccgtgcccttcgtgcccatcagcggctggcacggcgacaacatgctggagcccagccccaacatgccctggttcaagggctggaaggtggagagaaaggagggcaacgccagcggcgtgagcctgctggaggccctggacaccatcctgccccccaccagacccaccgacaagcccctgagactgcccctgcaggacgtgtacaagatcggcggcatcggcaccgtgcccgtgggcagagtggagaccggcatcctgagacccggcatggtggtgaccttcgcccccgtgaacatcaccaccgaggtgaagagcgtggagatgcaccacgaggccctgagcgaggccctgcccggcgacaacgtgggcttcaacgtgaagaacgtgagcgtgaaggacatcagaagaggcaacgtgtgcggcgacagcaagagcgaccccccccaggaggccgcccagttcaccagccaggtgatcatcctgaaccaccccggccagatcagcgccggctacagccccgtgatcgactgccacaccgcccacatcgcctgcaagttcgccgagctgaaggagaagatcgacagaagaagcggcaagaagctggaggacaaccccaagagcctgaagagcggcgacgccgccatcgtggagatggtgcccggcaagcccatgtgcgtggagagcttcagccagtacccccccctgggcagattcgccgtgagagacatgagacagaccgtggccgtgggcgtgatcaagaacgtggagaagaagagcggcggcgccggcaaggtgaccaagagcgcccagaaggcccagaaggccggcaagtag

SEQ ID NO: 80804 - DNA, 678 bp, Artificial Sequence
  Description of Artificial Sequence: Synthetic coding sequence
atgggcttcggcgacctgaagagccccgccggcctgcaggtgctgaacgactacctggccgacaagagctacatcgagggctacgtgcccagccaggccgacgtggccgtgttcgaggccgtgagcagccccccccccgccgacctgtgccacgccctgagatggtacaaccacatcaagagctacgagaaggagaaggccagcctgcccggcgtgaagaaggccctgggcaagtacggccccgccgacgtggaggacaccaccggcagcggcgccaccgacagcaaggacgacgacgacatcgacctgttcggcagcgacgacgaggaggagagcgaggaggccaagagactgagagaggagagactggcccagtacgagagcaagaaggccaagaagcccgccctggtggccaagagcagcatcctgctggacgtgaagccctgggacgacgagaccgacatggccaagctggaggagtgcgtgagaagcatccaggccgacggcctggtgtggggcagcagcaagctggtgcccgtgggctacggcatcaagaagctgcagatccagtgcgtggtggaggacgacaaggtgggcaccgacatgctggaggagcagatcaccgccttcgaggactacgtgcagagcatggacgtggccgccttcaacaagatctag

SEQ ID NO: 80805 - DNA, 678 bp, Artificial Sequence; identical to SEQ ID NO: 80804
  Description of Artificial Sequence: Synthetic coding sequence

SEQ ID NO: 80806 - DNA, 678 bp, Artificial Sequence; identical to SEQ ID NO: 80804
  Description of Artificial Sequence: Synthetic coding sequence

SEQ ID NO: 80807 - DNA, 372 bp, Artificial Sequence
  Description of Artificial Sequence: Synthetic coding sequence
atgggcttcggcgacctgaagagccccgccggcctgcaggtgctgaacgactacctggccgacaagagctacatcgagggctacgtgcccagccaggccgacgtggccgtgttcgaggccgtgagcagccccccccccgccgacctgtgccacgccctgagatggtacaaccacatcaagagctacgagaaggagaaggccagcctgcccggcgtgaagaaggccctgggcaagtacggccccgccgacgtggaggacaccaccggcagcggcgccaccgacagcaaggacgacgacgacatcgacctgttcggcagcgacgacgaggaggagagcgaggaggccaagagactgagagaggagagactgtag

SEQ ID NO: 80808 - DNA, 846 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggcagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggacaaggaggccgcccagctgagagaggagagactgagacagtacgccgagaagaaggccaagaagcccgccctggtggccaagagcagcatcctgctggacgtgaagccctgggacgacgagaccgacatggcccagctggaggcctgcgtgagaagcatccagctggacggcctggtgtggggcgccagcaagctggtgcccgtgggctacggcatcagaaagctgcagatccagtgcgtggtggaggacgacaaggtgggcaccgacctgctggaggaggagatcaccaagttcgaggagcacgtgcagagcgtggacatcgccgccttcaacaagatctag

SEQ ID NO: 80809 - DNA, 1896 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggcctgtgcacccacggcaaccaggtggcctgccaccacgtgacctggggcatctgggtgaacaagagcagcttcgaccaggccgagagagccttcgtggagtggagccaggccctgctgctggcccccgacggcagcagaagacagggcacccccaacaccggccagcaggtggccgtgcccgacctggcccaccagcccagcccccccgtgaacggccagccccccctgggcagcctgcaggccctggtgagagaggtgtggctggagaagcccagatacgacgccgccgagagaggcttctacgaggccctgttcgacggccacccccccggcaaggtgagactgcaggagagagccggcctggccgagggcgccagaagaggcagaagagacagaagaggcagaaacatcctgggcaacaagagagccggcctgagaagagccgacggcgaggcccccagcgccctgccctactgctacttcctgcagaaggacgccgaggccccctggctgagcaagcccgcctacgacagcgccgagtgcagacaccacgccgccgaggccctgagagtggcctggtgcctggaggccgccagcctgagccacagacccggccccagaagcggcctgagcgtgagcagcctgagacccaacagaaagatggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggcagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggacaaggaggccgcccagctgagagaggagagactgagacagtacgccgagaagaaggccaagaagcccgccctggtggccaagagcagcatcctgctggacgtgaagccctgggacgacgagaccgacatggcccagctggaggcctgcgtgagaagcatccagctggacggcctggtgtggggcgccagcaagctggtgcccgtgggctacggcatcagaaagctgcagatccagtgcgtgggcggcagacagggcggcgacagactggccggcggcggcgaccaccaggtgtag

SEQ ID NO: 80810 - DNA, 1728 bp, Artificial Sequence
  Description of Artificial Sequence: Synthetic coding sequence
atgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggcctgtgcacccacggcaaccaggtggcctgccaccacgtgacctggggcatctgggtgaacaagagcagcttcgaccaggccgagagagccttcgtggagtggagccaggccctgctgctggcccccgacggcagcagaagacagggcacccccaacaccggccagcaggtggccgtgcccgacctggcccaccagcccagcccccccgtgaacggccagccccccctgggcagcctgcaggccctggtgagagaggtgtggctggagaagcccagatacgacgccgccgagagaggcttctacgaggccctgttcgacggccacccccccggcaaggtgagactgcaggagagagccggcctggccgagggcgccagaagaggcagaagagacagaagaggcagaaacatcctgggcaacaagagagccggcctgagaagagccgacggcgaggcccccagcgccctgccctactgctacttcctgcagaaggacgccgaggccccctggctgagcaagcccgcctacgacagcgccgagtgcagacaccacgccgccgaggccctgagagtggcctggtgcctggaggccgccagcctgagccacagacccggccccagaagcggcctgagcgtgagcagcctgagacccaacagaaagatggccaccaacttcctggcccacgagaagatctggttcgacaagttcaagtacgacgacgccgagagaagattctacgagcagatgaacggccccgtggccggcgccagcagacagagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggacaaggaggccgcccagctgagagaggagagactgagacagtacgccgagaagaaggccaagaagcccgccctggtggccaagagcagcatcctgctggacgtgaagccctgggacgacgagaccgacatggcccagctggaggcctgcgtgagaagcatccagctggacggcctggtgtggggcgccagcaagctggtgcccgtgggctacggcatcagaaagctgcagatccagtgcgtggtggaggacgacaaggtgggcaccgacctgctggaggaggagatcaccaagttcgaggagcacgtgcagagcgtggacatcgccgccttcaacaagatctag

SEQ ID NO: 80811 - DNA, 846 bp, Artificial Sequence; identical to SEQ ID NO: 80808
  Description of Artificial Sequence: Synthetic coding sequence

SEQ ID NO: 80812 - DNA, 846 bp, Artificial Sequence; identical to SEQ ID NO: 80808
  Description of Artificial Sequence: Synthetic coding sequence

SEQ ID NO: 80813 - DNA, 1944 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggcctgtgcacccacggcaaccaggtggcctgccaccacgtgacctggggcatctgggtgaacaagagcagcttcgaccaggccgagagagccttcgtggagtggagccaggccctgctgctggcccccgacggcagcagaagacagggcacccccaacaccggccagcaggtggccgtgcccgacctggcccaccagcccagcccccccgtgaacggccagccccccctgggcagcctgcaggccctggtgagagaggtgtggctggagaagcccagatacgacgccgccgagagaggcttctacgaggccctgttcgacggccacccccccggcaaggtgagactgcaggagagagccggcctggccgagggcgccagaagaggcagaagagacagaagaggcagaaacatcctgggcaacaagagagccggcctgagaagagccgacggcgaggcccccagcgccctgccctactgctacttcctgcagaaggacgccgaggccccctggctgagcaagcccgcctacgacagcgccgagtgcagacaccacgccgccgaggccctgagagtggcctggtgcctggaggccgccagcctgagccacagacccggccccagaagcggcctgagcgtgagcagcctgagacccaacagaaagatggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggcagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggacaaggaggccgcccagctgagagaggagagactgagacagtacgccgagaagaaggccaagaagcccgccctggtggccaagagcagcatcctgctggacgtgaagccctgggacgacgagaccgacatggcccagctggaggcctgcgtgagaagcatccagctggacggcctggtgtggggcgccagcaagctggtgcccgtgggctacggcatcagaaagctgcagatccagtgcgtggtggaggacgacaaggtgggcaccgacctgctggaggaggagatcaccaagttcgaggagcacgtgcagagcgtggacatcgccgccttcaacaagatctag

SEQ ID NO: 80814 - DNA, 1944 bp, Artificial Sequence; identical to SEQ ID NO: 80813
  Description of Artificial Sequence: Synthetic coding sequence

SEQ ID NO: 80815 - DNA, 774 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggcgccagcagacagagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggacaaggaggccgcccagctgagagaggagagactgagacagtacgccgagaagaaggccaagaagcccgccctggtggccaagagcagcatcctgctggacgtgaagccctgggacgacgagaccgacatggcccagctggaggcctgcgtgagaagcatccagctggacggcctggtgtggggcgccagcaagctggtgcccgtgggctacggcatcagaaagctgcagatccagtgcgtggtggaggacgacaaggtgggcaccgacctgctggaggaggagatcaccaagttcgaggagcacgtgcagagcgtggacatcgccgccttcaacaagatctag

SEQ ID NO: 80816 - DNA, 546 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggcctgtgcacccacggcaaccaggtggcctgccaccacgtgacctggggcatctgggtgaacaagagcagcttcgaccaggccgagagagccttcgtggagtggagctag

SEQ ID NO: 80817 - DNA, 192 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggcctag

SEQ ID NO: 80818 - DNA, 120 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggcgccagcagacagtag

SEQ ID NO: 80819 - DNA, 246 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagatag

SEQ ID NO: 80820 - DNA, 114 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgcctag

SEQ ID NO: 80821 - DNA, 162 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggctag

SEQ ID NO: 80822 - DNA, 192 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggctag

SEQ ID NO: 80823 - DNA, 903 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggcctgtgcacccacggcaaccaggtggcctgccaccacgtgacctggggcatctgggtgaacaagagcagcttcgaccaggccgagagagccttcgtggagtggagccaggccctgctgctggcccccgacggcagcagaagacagggcacccccaacaccggccagcaggtggccgtgcccgacctggcccaccagcccagcccccccgtgaacggccagccccccctgggcagcctgcaggccctggtgagagaggtgtggctggagaagcccagatacgacgccgccgagagaggcttctacgaggccctgttcgacggccacccccccggcaaggtgagactgcaggagagagccggcctggccgagggcgccagaagaggcagaagagacagaagaggcagaaacatcctgggcaacaagagagccggcctgagaagagccgacggcgaggcccccagctag

SEQ ID NO: 80824 - DNA, 66 bp, Artificial Sequence
  Description of Artificial Sequence: Synthetic coding sequence
atgagaagcggcaaggccagctgcaccctggagaccgtgtgggaggacaagcacaagtacgagtag

SEQ ID NO: 80825 - DNA, 474 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggcctgtgcacccacggcaaccaggtggcctgccactag

SEQ ID NO: 80826 - DNA, 774 bp, Artificial Sequence; identical to SEQ ID NO: 80815
  Description of Artificial Sequence: Synthetic coding sequence

SEQ ID NO: 80827 - DNA, 846 bp, Artificial Sequence; identical to SEQ ID NO: 80808
  Description of Artificial Sequence: Synthetic coding sequence

SEQ ID NO: 80828 - DNA, 441 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggctag

SEQ ID NO: 80829 - DNA, 615 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggcagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggacaaggaggccgcccagctgagagaggagagactgagacagtacgccgagaagaaggccaagaagcccgccctggtggccaagagcagcatcctgctggacgtgaagccctag

SEQ ID NO: 80830 - DNA, 390 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctgtag

SEQ ID NO: 80831 - DNA, 501 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggcagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggagtag

SEQ ID NO: 80832 - DNA, 255 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgtag

SEQ ID NO: 80833 - DNA, 600 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggcagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggacaaggaggccgcccagctgagagaggagagactgagacagtacgccgagaagaaggccaagaagcccgccctggtggccaagagcagcatcctgtag

SEQ ID NO: 80834 - DNA, 774 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggcctgtgcacccacggcaaccaggtggcctgccaccacgtgacctggggcatctgggtgaacaagagcagcttcgaccaggccgagagagccttcgtggagtggagccaggccctgctgctggcccccgacggcagcagaagacagggcacccccaacaccggccagcaggtggccgtgcccgacctggcccaccagcccagcccccccgtgaacggccagccccccctgggcagcctgcaggccctggtgagagaggtgtggctggagaagcccagatacgacgccgccgagagaggcttctacgaggccctgttcgacggccacccccccggctag

SEQ ID NO: 80835 - DNA, 540 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggcctgtgcacccacggcaaccaggtggcctgccaccacgtgacctggggcatctgggtgaacaagagcagcttcgaccaggccgagagagccttcgtggagtag

SEQ ID NO: 80836 - DNA, 108 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggctag

SEQ ID NO: 80837 - DNA, 150 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgtag

SEQ ID NO: 80838 - DNA, 120 bp, Artificial Sequence; identical to SEQ ID NO: 80818
  Description of Artificial Sequence: Synthetic coding sequence

SEQ ID NO: 80839 - DNA, 573 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggcctgtgcacccacggcaaccaggtggcctgccaccacgtgacctggggcatctgggtgaacaagagcagcttcgaccaggccgagagagccttcgtggagtggagccaggccctgctgctggcccccgacggctag

SEQ ID NO: 80840 - DNA, 2094 bp, Artificial Sequence
  Description of Artificial Sequence: Synthetic coding sequence
atggaggcccccctgggcagcatcctgagcccctgccccggcagagccgccaccggcagagccggcaccggcagagtgggcaccggcctgagaccccccgccgtgctgcagctgtgccccctgctggccttctacagatgcgtgagaaagatgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggcggcagcagaagagaccccagaaagagccaggacagcagaaagcccctgcagaagaagagaaagagaagccccaagagcggcctgggccccgccgacctggccctgctgggcctgagcgccgagagagtgtggctggacaagagcctgttcgaccaggccgagagcagctacagacagaagctggccgacgtggccgcccaggccgcctggccccccgccctggccccctggggcctgtgcacccacggcaaccaggtggcctgccaccacgtgacctggggcatctgggtgaacaagagcagcttcgaccaggccgagagagccttcgtggagtggagccaggccctgctgctggcccccgacggcagcagaagacagggcacccccaacaccggccagcaggtggccgtgcccgacctggcccaccagcccagcccccccgtgaacggccagccccccctgggcagcctgcaggccctggtgagagaggtgtggctggagaagcccagatacgacgccgccgagagaggcttctacgaggccctgttcgacggccacccccccggcaaggtgagactgcaggagagagccggcctggccgagggcgccagaagaggcagaagagacagaagaggcagaaacatcctgggcaacaagagagccggcctgagaagagccgacggcgaggcccccagcgccctgccctactgctacttcctgcagaaggacgccgaggccccctggctgagcaagcccgcctacgacagcgccgagtgcagacaccacgccgccgaggccctgagagtggcctggtgcctggaggccgccagcctgagccacagacccggccccagaagcggcctgagcgtgagcagcctgagacccaacagaaagatggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggcagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggacaaggaggccgcccagctgagagaggagagactgagacagtacgccgagaagaaggccaagaagcccgccctggtggccaagagcagcatcctgctggacgtgaagccctgggacgacgagaccgacatggcccagctggaggcctgcgtgagaagcatccagctggacggcctggtgtggggcgccagcaagctggtgcccgtgggctacggcatcagaaagctgcagatccagtgcgtggtggaggacgacaaggtgggcaccgacctgctggaggaggagatcaccaagttcgaggagcacgtgcagagcgtggacatcgccgccttcaacaagatctag

SEQ ID NO: 80841 - DNA, 615 bp, Artificial Sequence; identical to SEQ ID NO: 80829
  Description of Artificial Sequence: Synthetic coding sequence

SEQ ID NO: 80842 - DNA, 507 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggcagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggactag

SEQ ID NO: 80843 - DNA, 786 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggcagcagcggccccggcgccagcagcggcaccagcggcgaccacggcgagctggtggtgagaatcgccagcctggaggtggagaaccagagcctgagaggcgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggacaaggaggccgcccagctgagagaggagagactgagacagtacgccgagaagaaggccaagaagcccgccctggtggccaagagcagcatcctgctggacgtgaagccctgggacgacgagaccgacatggcccagctggaggcctgcgtgagaagcatccagctggacggcctggtgtggggcgccagcaagctggtgcccgtgggctacggcatcagaaagctgcagatccagtgcgtggtggaggacgacaaggtgggcaccgacctgctggaggagtag

SEQ ID NO: 80844 - DNA, 96 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgagtag

SEQ ID NO: 80845 - DNA, 207 bp, Artificial Sequence
  Description of Artificial Sequence: Synthetic coding sequence
atgagaagcggcaaggccagctgcaccctggagaccgtgtgggaggacaagcacaagtacgaggaggccgagagaagattctacgagcacgaggccacccaggccgccgccagcgcccagcagctgcccgccgagggccccgccatgaacggccccggccaggacgaccccgaggacgccgacgaggccgaggcccccgacggctag

SEQ ID NO: 80846 - DNA, 789 bp, Artificial Sequence
  Description of Artificial Sequence: Synthetic coding sequence
atggccaccaacttcctggcccacgagaagatctggttcgacaagttcaagtacgacgacgccgagagaagattctacgagcagatgaacggccccgtggccggcgccagcagacaggagaacggcgccagcgtgatcctgagagacatcgccagagccagagagaacatccagaagagcctggccggcagcagcggccccggcgccagcagcggcaccagcggcgaccacgtggtgcaggagctgcagcaggccatcagcaagctggaggccagactgaacgtgctggagaagagcagccccggccacagagccaccgccccccagacccagcacgtgagccccatgagacaggtggagccccccgccaagaagcccgccacccccgccgaggacgacgaggacgacgacatcgacctgttcggcagcgacaacgaggaggaggacaaggaggccgcccagctgagagaggagagactgagacagtacgccgagaagaaggccaagaagcccgccctggtggccaagagcagcatcctgctggacgtgaagccctgggacgacgagaccgacatggcccagctggaggcctgcgtgagaagcatccagctggacggcctggtgtggggcgccagcaagctggtgcccgtgggctacggcatcagaaagctgcagatccagtgcgtggtggaggacgacaaggtgggcaccgacctgctggaggaggagatcaccaagttcgaggagcacgtgcagagcgtggacatcgccgccttcaacaagatctag

SEQ ID NO: 80847 - DNA, 525 bp, Artificial Sequence
  Description of Artificial Sequence: Synthetic coding sequence
atggccgccgccgccgagctgagcctgctggagaagagcctgggcctgagcaagggcaacaagtacagcgcccagggcgagagacagatccccgtgctgcagaccaacaacggccccagcctgaccggcctgaccaccatcgccgcccacctggtgaagcaggccaacaaggagtacctgctgggcagcaccgccgaggagaaggccatcgtgcagcagtggctggagtacagagtgacccaggtggacggccacagcagcaagaacgacatccacaccctgctgaaggacctgaacagctacctggaggacaaggtgtacctgaccggctacaacttcaccctggccgacatcctgctgtactacggcctgcacagattcatcgtggacctgaccgtgcaggagaaggagaagtacctgaacgtgagcagatggttctgccacatccagcactaccccggcatcagacagcacctgagcagcgtggtgttcatcaagaacagactgtacaccaacagccactag

SEQ ID NO: 80848 - DNA, 420 bp, Artificial Sequence
  Description of Artificial Sequence: Synthetic coding sequence
atggccgccgccgccgagctgagcctgctggagaagagcctgggcctgagcaagggcaacaagtacagcgcccagggcgagagacagatccccgtgctgcagaccaacaacggccccagcctgaccggcctgaccaccatcgccgcccacctggtgaagcaggccaacaaggagtacctgctgggcagcaccgccgaggagaaggccatcgtgcagcagtggctggagtacagagtgacccaggtggacggccacagcagcaagaacgacatccacaccctgctgaaggacctgaacagctacctggaggacaaggtgtacctgaccggctacaacttcaccctggccgacatcctgctgtactacggcctgcacagattcatcatcagaaagctgagacacaccgaggtgggcaactag

SEQ ID NO: 80849 - DNA, 1314 bp, Artificial Sequence
  Description of Artificial Sequence: Synthetic coding sequence
atggccgccggcaccctgtacacctaccccgagaactggagagccttcaaggccctgatcgccgcccagtacagcggcgcccaggtgagagtgctgagcgcccccccccacttccacttcggccagaccaacagaacccccgagttcctgagaaagttccccgccggcaaggtgcccgccttcgagggcgacgacggcttctgcgtgttcgagagcaacgccatcgcctactacgtgagcaacgaggagctgagaggcagcacccccgaggccgccgcccaggtggtgcagtgggtgagcttcgccgacagcgacatcgtgccccccgccagcacctgggtgttccccaccctgggcatcatgcaccacaacaagcaggccaccgagaacgccaaggaggaggtgagaagaatcctgggcctgctggacgcctacctgaagaccagaaccttcctggtgggcgagagagtgaccctggccgacatcaccgtggtgtgcaccctgctgtggctgtacaagcaggtgctggagcccagcttcagacaggccttccccaacaccaacagatggttcctgacctgcatcaaccagccccagttcagagccgtgctgggcgaggtgaagctgtgcgagaagatggcccagttcgacgccaagaagttcgccgagacccagcccaagaaggacacccccagaaaggagaagggcagcagagaggagaagcagaagccccaggccgagagaaaggaggagaagaaggccgccgcccccgcccccgaggaggagatggacgagtgcgagcaggccctggccgccgagcccaaggccaaggaccccttcgcccacctgcccaagagcaccttcgtgctggacgagttcaagagaaagtacagcaacgaggacaccctgagcgtggccctgccctacttctgggagcacttcgacaaggacggctggagcctgtggtacagcgagtacagattccccgaggagctgacccagaccttcatgagctgcaacctgatcaccggcatgttccagagactggacaagctgagaaagaacgccttcgccagcgtgatcctgttcggcaccaacaacagcagcagcatcagcggcgtgtgggtgttcagaggccaggagctggccttccccctgagccccgactggcaggtggactacgagagctacacctggagaaagctggaccccggcagcgaggagacccagaccctggtgagagagtacttcagctgggagggcgccttccagcacgtgggcaaggccttcaaccagggcaagatcttcaagtag

SEQ ID NO: 80850 - DNA, 1464 bp, Artificial Sequence
  Description of Artificial Sequence: Synthetic coding sequence
atggccgagagatgggtggcccccgccgtgctgagaagagccagattcgccagcaccttcttcctgagcccccagatctacgcccacaaggacggcgacctgagaagcgccttcttcatcctgagcttcaagagaggcgagttcatccccttcctgaactggaccctgtacacctaccccgagaactggagagccttcaaggccctgatcgccgcccagtacagcggcgcccaggtgagagtgctgagcgcccccccccacttccacttcggccagaccaacagaacccccgagttcctgagaaagttccccgccggcaaggtgcccgccttcgagggcgacgacggcttctgcgtgttcgagagcaacgccatcgcctactacgtgagcaacgaggagctgagaggcagcacccccgaggccgccgcccaggtggtgcagtgggtgagcttcgccgacagcgacatcgtgccccccgccagcacctgggtgttccccaccctgggcatcatgcaccacaacaagcaggccaccgagaacgccaaggaggaggtgagaagaatcctgggcctgctggacgcctacctgaagaccagaaccttcctggtgggcgagagagtgaccctggccgacatcaccgtggtgtgcaccctgctgtggctgtacaagcaggtgctggagcccagcttcagacaggccttccccaacaccaacagatggttcctgacctgcatcaaccagccccagttcagagccgtgctgggcgaggtgaagctgtgcgagaagatggcccagttcgacgccaagaagttcgccgagacccagcccaagaaggacacccccagaaaggagaagggcagcagagaggagaagcagaagccccaggccgagagaaaggaggagaagaaggccgccgcccccgcccccgaggaggagatggacgagtgcgagcaggccctggccgccgagcccaaggccaaggaccccttcgcccacctgcccaagagcaccttcgtgctggacgagttcaagagaaagtacagcaacgaggacaccctgagcgtggccctgccctacttctgggagcacttcgacaaggacggctggagcctgtggtacagcgagtacagattccccgaggagctgacccagaccttcatgagctgcaacctgatcaccggcatgttccagagactggacaagctgagaaagaacgccttcgccagcgtgatcctgttcggcaccaacaacagcagcagcatcagcggcgtgtgggtgttcagaggccaggagctggccttccccctgagccccgactggcaggtggactacgagagctacacctggagaaagctggaccccggcagcgaggagacccagaccctggtgagagagtacttcagctgggagggcgccttccagcacgtgggcaaggccttcaaccagggcaagatcttcaagtag

SEQ ID NO: 80851 - DNA, 621 bp, Artificial Sequence
  Description of Artificial Sequence: Synthetic coding sequence
atgcaccacaacaagcaggccaccgagaacgccaaggaggaggtgagaagaatcctgggcctgctggacgcctacctgaagaccagaaccttcctggtgggcgagagagtgaccctggccgccgagcccaaggccaaggaccccttcgcccacctgcccaagagcaccttcgtgctggacgagttcaagagaaagtacagcaacgaggacaccctgagcgtggccctgccctacttctgggagcacttcgacaaggacggctggagcctgtggtacagcgagtacagattccccgaggagctgacccagaccttcatgagctgcaacctgatcaccggcatgttccagagactggacaagctgagaaagaacgccttcgccagcgtgatcctgttcggcaccaacaacagcagcagcatcagcggcgtgtgggtgttcagaggccaggagctggccttccccctgagccccgactggcaggtggactacgagagctacacctggagaaagctggaccccggcagcgaggagacccagaccctggtgagagagtacttcagctgggagggcgccttccagcacgtgggcaaggccttcaaccagggcaagatcttcaagtag

SEQ ID NO: 80852 - DNA, 2577 bp, Artificial Sequence
  Description of Artificial Sequence: Synthetic coding sequence
atggtgaacttcaccgtggaccagatcagagccatcatggacaagaaggccaacatcagaaacatgagcgtgatcgcccacgtggaccacggcaagagcaccctgaccgacagcctggtgtgcaaggccggcatcatcgccagcgccagagccggcgagaccagattcaccgacaccagaaaggacgagcaggagagatgcatcaccatcaagagcaccgccatcagcctgttctacgagctgagcgagaacgacctgaacttcatcaagcagagcaaggacggcgccggcttcctgatcaacctgatcgacagccccggccacgtggacttcagcagcgaggtgaccgccgccctgagagtgaccgacggcgccctggtggtggtggactgcgtgagcggcgtgtgcgtgcagaccgagaccgtgctgagacaggccatcgccgagagaatcaagcccgtgctgatgatgaacaagatggacagagccctgctggagctgcagctggagcccgaggagctgtaccagaccttccagagaatcgtggagaacgtgaacgtgatcatcagcacctacggcgagggcgagagcggccccatgggcaacatcatgatcgaccccgtgctgggcaccgtgggcttcggcagcggcctgcacggctgggccttcaccctgaagcagttcgccgagatgtacgtggccaagttcgccgccaagggcgagggccagctgggccccgccgagagagccaagaaggtggaggacatgatgaagaagctgtggggcgacagatacttcgaccccgccaacggcaagttcagcaagagcgccaccagccccgagggcaagaagctgcccagaaccttctgccagctgatcctggaccccatcttcaaggtgttcgacgccatcatgaacttcaagaaggaggagaccgccaagctgatcgagaagctggacatcaagctggacagcgaggacaaggacaaggagggcaagcccctgctgaaggccgtgatgagaagatggctgcccgccggcgacgccctgctgcagatgatcaccatccacctgcccagccccgtgaccgcccagaagtacagatgcgagctgctgtacgagggcccccccgacgacgaggccgccatgggcatcaagagctgcgaccccaagggccccctgatgatgtacatcagcaagatggtgcccaccagcgacaagggcagattctacgccttcggcagagtgttcagcggcctggtgagcaccggcctgaaggtgagaatcatgggccccaactacacccccggcaagaaggaggacctgtacctgaagcccatccagagaaccatcctgatgatgggcagatacgtggagcccatcgaggacgtgccctgcggcaacatcgtgggcctggtgggcgtggaccagttcctggtgaagaccggcaccatcaccaccttcgagcacgcccacaacatgagagtgatgaagttcagcgtgagccccgtggtgagagtggccgtggaggccaagaaccccgccgacctgcccaagctggtggagggcctgaagagactggccaagagcgaccccatggtgcagtgcatcatcgaggagagcggcgagcacatcatcgccggcgccggcgagctgcacctggagatctgcctgaaggacctggaggaggaccacgcctgcatccccatcaagaagagcgaccccgtggtgagctacagagagaccgtgagcgaggagagcaacgtgctgtgcctgagcaagagccccaacaagcacaacagactgtacatgaaggccagacccttccccgacggcctggccgaggacatcgacaagggcgaggtgagcgccagacaggagctgaagcagagagccagatacctggccgagaagtacgagtgggacgtggccgaggccagaaagatctggtgcttcggccccgacggcaccggccccaacatcctgaccgacatcaccaagggcgtgcagtacctgaacgagatcaaggacagcgtggtggccggcttccagtgggccaccaaggagggcgccctgtgcgaggagaacatgagaggcgtgagattcgacgtgcacgacgtgaccctgcacgccgacgccatccacagaggcggcggccagatcatccccaccgccagaagatgcctgtacgccagcgtgctgaccgcccagcccagactgatggagcccatctacctggtggagatccagtgccccgagcaggtggtgggcggcatctacggcgtgctgaacagaaagagaggccacgtgttcgaggagagccaggtggccggcacccccatgttcgtggtgaaggcctacctgcccgtgaacgagagcttcggcttcaccgccgacctgagaagcaacaccggcggccaggccttcccccagtgcgtgttcgaccactggcagatcctgcccggcgaccccttcgacaacagcagcagacccagccaggtggtggccgagaccagaaagagaaagggcctgaaggagggcatccccgccctggacaacttcctggacaagctgtag

SEQ ID NO: 80853 - DNA, 1752 bp, Artificial Sequence
  Description of Artificial Sequence: Synthetic coding sequence
atggtgaacttcaccgtggaccagatcagagccatcatggacaagaaggccaacatcagaaacatgagcgtgatcgcccacgtggaccacggcaagagcaccctgaccgacagcctggtgtgcaaggccggcatcatcgccagcgccagagccggcgagaccagattcaccgacaccagaaaggacgagcaggagagatgcatcaccatcaagagcaccgccatcagcctgttctacgagctgagcgagaacgacctgaacttcatcaagcagagcaaggacggcgccggcttcctgatcaacctgatcgacagccccggccacgtggacttcagcagcgaggtgaccgccgccctgagagtgaccgacggcgccctggtggtggtggactgcgtgagcggcgtgtgcgtgcagaccgagaccgtgctgagacaggccatcgccgagagaatcaagcccgtgctgatgatgaacaagatggacagagccctgctggagctgcagctggagcccgaggagctgtaccagaccttccagagaatcgtggagaacgtgaacgtgatcatcagcacctacggcgagggcgagagcggccccatgggcaacatcatgatcgaccccgtgctgggcaccgtgggcttcggcagcggcctgcacggctgggccttcaccctgaagcagttcgccgagatgtacgtggccaagttcgccgccaagggcgagggccagctgggccccgccgagagagccaagaaggtggaggacatgatgaagaagctgtggggcgacagatacttcgaccccgccaacggcaagttcagcaagagcgccaccagccccgagggcaagaagctgcccagaaccttctgccagctgatcctggaccccatcttcaaggtgttcgacgccatcatgaacttcaagaaggaggagaccgccaagctgatcgagaagctggacatcaagctggacagcgaggacaaggacaaggagggcaagcccctgctgaaggccgtgatgagaagatggctgcccgccggcgacgccctgctgcagatgatcaccatccacctgcccagccccgtgaccgcccagaagtacagatgcgagctgctgtacgagggcccccccgacgacgaggccgccatgggcatcaagagctgcgaccccaagggccccctgatgatgtacatcagcaagatggtgcccaccagcgacaagggcagattctacgccttcggcagagtgttcagcggcctggtgagcaccggcctgaaggtgagaatcatgggccccaactacacccccggcaagaaggaggacctgtacctgaagcccatccagagaaccatcctgatgatgggcagatacgtggagcccatcgaggacgtgccctgcggcaacatcgtgggcctggtgggcgtggaccagttcctggtgaagaccggcaccatcaccaccttcgagcacgcccacaacatgagagtgatgaagttcagcgtgagccccgtggtgagagtggccgtggaggccaagaaccccgccgacctgcccaagctggtggagggcctgaagagactggccaagagcgaccccatggtgcagtgcatcatcgaggagagcggcgagcacatcatcgccggcgccggcgagctgcacctggagatctgcctgaaggacctggaggaggaccacgcctgcatccccatcaagaaggagaccgtgagcaagaagaagaagaagaagaagtag

SEQ ID NO: 80854 - DNA, 351 bp, Artificial Sequence
  Description of Artificial Sequence: Synthetic coding sequence
atgcccaagaacaaggagtacgcccaggtgatcaagatgctgggcaacggcagactggaggccatgtgcttcgacggcgtgaagagactgtgccacatcagaggcaagctgagaaagaaggtgtggatcaacaccagcgacatcatcctggtgggcctgagagactaccaggacaacaaggccgacgtgatcctgaagtacaacgccgacgaggccagaagcctgaaggcctacggcgagctgcccgagcacgccaagatcaacgagaccgacaccttcggccccggcgacgacgacgagatccagttcgacgacatcggcgacgacgacgaggacatcgacgacatctag

SEQ ID NO: 80855 - DNA, 435 bp, Artificial Sequence
  Description of Artificial Sequence: Synthetic coding sequence
atgcccaagaacaagggcaagggcggcaagaacagaagaagaggcaagaacgagaacgagagcgagaagagagagctggtgttcaaggaggacggccaggagtacgcccaggtgatcaagatgctgggcaacggcagactggaggccatgtgcttcgacggcgtgaagagactgtgccacatcagaggcaagctgagaaagaaggtgtggatcaacaccagcgacatcatcctggtgggcctgagagactaccaggacaacaaggccgacgtgatcctgaagtacaacgccgacgaggccagaagcctgaaggcctacggcgagctgcccgagcacgccaagatcaacgagaccgacaccttcggccccggcgacgacgacgagatccagttcgacgacatcggcgacgacgacgaggacatcgacgacatctag

SEQ ID NO: 80856 - DNA, 435 bp, Artificial Sequence
  Description of Artificial Sequence: Synthetic coding sequence
atgcccaagaacaagggcaagggcggcaagaacagaagaagaggcaagaacgagaacgagagcgagaagagagagctggtgttcaaggaggacggccaggagtacgcccaggtgatcaagatgctgggcaacggcagactggaggccctgtgcttcgacggcgtgaagagactgtgccacatcagaggcaagctgagaaagaaggtgtggatcaacaccagcgacatcatcctggtgggcctgagagactaccaggacaacaaggccgacgtgatcctgaagtacaacgccgacgaggccagaagcctgaaggcctacggcgagctgcccgagcacgccaagatcaacgagaccgacaccttcggccccggcgacgacgacgagatccagttcgacgacatcggcgacgacgacgaggacatcgacgacatctag

SEQ ID NO: 80857 - DNA, 384 bp, Artificial Sequence
  Description of Artificial Sequence: Synthetic coding sequence
atgcccaagaacaagggcaagggcggcaagaacagaagaagaggcaagaacgagaacgagagcgagaagagagagctggtgttcaaggaggacggccaggagtacgcccaggtgatcaagatgctgggcaacggcagactggaggccctgtgcttcgacggcgtgaagagactgtgccacatcagaggcaagctgagaaagaaggacaacaaggccgacgtgatcctgaagtacaacgccgacgaggccagaagcctgaaggcctacggcgagctgcccgagcacgccaagatcaacgagaccgacaccttcggccccggcgacgacgacgagatccagttcgacgacatcggcgacgacgacgaggacatcgacgacatctag

SEQ ID NO: 80858 - DNA, 1419 bp, Artificial Sequence
  Description of Artificial Sequence: Synthetic coding sequence
atggccggcggcgaggccggcgtgaccctgggccagccccacctgagcagacaggacctgaccaccctggacgtgaccaagctgacccccctgagccacgaggtgatcagcagacaggccaccatcaacatcggcaccatcggccacgtggcccacggcaagagcaccgtggtgaaggccatcagcggcgtgcacaccgtgagattcaagaacgagctggagagaaacatcaccatcaagctgggctacgccaacgccaagatctacaagctggacgaccccagctgccccagacccgagtgctacagaagctgcggcagcagcacccccgacgagttccccaccgacatccccggcaccaagggcaacttcaagctggtgagacacgtgagcttcgtggactgccccggccacgacatcctgatggccaccatgctgaacggcgccgccgtgatggacgccgccctgctgctgatcgccggcaacgagagctgcccccagccccagaccagcgagcacctggccgccatcgagatcatgaagctgaagcacatcctgatcctgcagaacaagatcgacctggtgaaggagagccaggccaaggagcagtacgagcagatcctggccttcgtgcagggcaccgtggccgagggcgcccccatcatccccatcagcgcccagctgaagtacaacatcgaggtggtgtgcgagtacatcgtgaagaagatccccgtgccccccagagacttcaccagcgagcccagactgatcgtgatcagaagcttcgacgtgaacaagcccggctgcgaggtggacgacctgaagggcggcgtggccggcggcagcatcctgaagggcgtgctgaaggtgggccaggagatcgaggtgagacccggcatcgtgagcaaggacagcgagggcaagctgatgtgcaagcccatcttcagcaagatcgtgagcctgttcgccgagcacaacgacctgcagtacgccgcccccggcggcctgatcggcgtgggcaccaagatcgaccccaccctgtgcagagccgacagaatggtgggccaggtgctgggcgccgtgggcgccctgcccgagatcttcaccgagctggagatcagctacttcctgctgagaagactgctgggcgtgagaaccgagggcgacaagaaggccgccaaggtgcagaagctgagcaagaacgaggtgctgatggtgaacatcggcagcctgagcaccggcggcagagtgagcgccgtgaaggccgacctgggcaagatcgtgctgaccaaccccgtgtgcaccgaggtgggcgagaagatcgccctgagcagaagagtggagaagcactggagactgatcggctggggccagatcagaagaggcgtgaccatcaagcccaccgtggacgacgactag

SEQ ID NO: 80859 - DNA, 552 bp, Artificial Sequence
  Description of Artificial Sequence: Synthetic coding sequence
tgagccggcggcgaggccggcgtgaccctgggccagccccacctgagcagacaggacctgaccaccctggacgtgaccaagctgacccccctgagccacgaggtgatcagcagacaggccaccatcaacatcggcaccatcggccacgtggcccacggcaagagcaccgtggtgaaggccatcagcggcgtgcacaccgtgagattcaagaacgagctggagagaaacatcaccatcaagctgggctacgccaacgccaagatctacaagctggacgaccccagctgccccagacccgagtgctacagaagctgcggcagcagcacccccgacgagttccccaccgacatccccggcaccaagggcaacttcaagctggtgagacacgtgagcttcgtggactgccccggccacgacatcctgatggccaccatgctgaacggcgccgccgtgatggacgccgccctgctgctgatcggcaagtacctgaccatcggcctggacaagagcatgtggaacaagagcaagatgaagtacctgaagggcaactag

SEQ ID NO: 80860 - DNA, 1116 bp, Artificial Sequence
  Description of Artificial Sequence: Synthetic coding sequence
atgttccaggaggtgaaggccgacaaggtgaccatgctgtggaacaagaaggccaccgccgtgctggtgatcgccagcaccgacgtggacaagaccggcgccagctactacggcgagcagaccctgcactacatcgccaccaacggcgagagcgccgtggtgcagctgcccaagaacggccccatctacgacgtggtgtggaacagcagcagcaccgagttctgcgccgtgtacggcttcatgcccgccaaggccaccatcttcaacctgaagtgcgaccccgtgttcgacttcggcaccggccccagaaacgccgcctactacagcccccacggccacatcctggtgctggccggcttcggcaacctgagaggccagatggaggtgtgggacgtgaagaactacaagctgatcagcaagcccgtggccagcgacagcacctacttcgcctggtgccccgacggcgagcacatcctgaccgccacctgcgcccccagactgagagtgaacaacggctacaagatctggcactacaccggcagcatcctgcacaagtacgacgtgcccagcaacgccgagctgtggcaggtgagctggcagcccttcctggacggcatcttccccgccaagaccatcacctaccaggccgtgcccagcgaggtgcccaacgaggagcccaaggtggccaccgcctacagaccccccgccctgagaaacaagcccatcaccaacagcaagctgcacgaggaggagcccccccagaacatgaagccccagagcggcaacgacaagcccctgagcaagaccgccctgaagaaccagagaaagcacgaggccaagaaggccgccaagcaggaggccagaagcgacaagagccccgacctggcccccacccccgccccccagagcacccccagaaacaccgtgagccagagcatcagcggcgaccccgagatcgacaagaagatcaagaacctgaagaagaagctgaaggccatcgagcagctgaaggagcaggccgccaccggcaagcagctggagaagaaccagctggagaagatccagaaggagaccgccctgctgcaggagctggaggacctggagctgggcatctag

SEQ ID NO: 80861 - DNA, 1758 bp, Artificial Sequence
  Description of Artificial Sequence: Synthetic coding sequence
atggcccccagcacccccctgctgaccgtgagaggcagcgagggcctgtacatggtgaacggccccccccacttcaccgagagcaccgtgttccccagagagagcggcaagaactgcaaggtgtgcatcttcagcaaggacggcaccctgttcgcctggggcaacggcgagaaggtgaacatcatcagcgtgaccaacaagggcctgctgcacagcttcgacctgctgaaggccgtgtgcctggagttcagccccaagaacaccgtgctggccacctggcagccctacaccaccagcaaggacggcaccgccggcatccccaacctgcagctgtacgacgtgaagaccggcacctgcctgaagagcttcatccagaagaagatgcagaactggtgccccagctggagcgaggacgagaccctgtgcgccagaaacgtgaacaacgaggtgcacttcttcgagaacaacaacttcaacaccatcgccaacaagctgcacctgcagaagatcaacgacttcgtgctgagccccggcccccagccctacaaggtggccgtgtacgtgcccggcagcaagggcgcccccagcttcgtgagactgtaccagtaccccaacttcgccggcccccacgccgccctggccaacaagagcttcttcaaggccgacaaggtgaccatgctgtggaacaagaaggccaccgccgtgctggtgatcgccagcaccgacgtggacaagaccggcgccagctactacggcgagcagaccctgcactacatcgccaccaacggcgagagcgccgtggtgcagctgcccaagaacggccccatctacgacgtggtgtggaacagcagcagcaccgagttctgcgccgtgtacggcttcatgcccgccaaggccaccatcttcaacctgaagtgcgaccccgtgttcgacttcggcaccggccccagaaacgccgcctactacagcccccacggccacatcctggtgctggccggcttcggcaacctgagaggccagatggaggtgtgggacgtgaagaactacaagctgatcagcaagcccgtggccagcgacagcacctacttcgcctggtgccccgacggcgagcacatcctgaccgccacctgcgcccccagactgagagtgaacaacggctacaagatctggcactacaccggcagcatcctgcacaagtacgacgtgcccagcaacgccgagctgtggcaggtgagctggcagcccttcctggacggcatcttccccgccaagaccatcacctaccaggccgtgcccagcgaggtgcccaacgaggagcccaaggtggccaccgcctacagaccccccgccctgagaaacaagcccatcaccaacagcaagctgcacgaggaggagcccccccagaacatgaagccccagagcggcaacgacaagcccctgagcaagaccgccctgaagaaccagagaaagcacgaggccaagaaggccgccaagcaggaggccagaagcgacaagagccccgacctggcccccacccccgccccccagagcacccccagaaacaccgtgagccagagcatcagcggcgaccccgagatcgacaagaagatcaagaacctgaagaagaagctgaaggccatcgagcagctgaaggagcaggccgccaccggcaagcagctggagaagaaccagctggagaagatccagaaggagaccgccctgctgcaggagctggaggacctggagctgggcatctag

SEQ ID NO: 80862 - DNA, 1893 bp, Artificial Sequence
  Description of Artificial Sequence: Synthetic coding sequence
atgcagggcggcaacagcggcgtgagaaagagagaggaggagggcgacggcgccggcgccgtggccgccccccccgccatcgacttccccgccgagggccccgaccccgagtacgacgagagcgacgtgcccgccgagatccaggtgctgaaggagcccctgcagcagcccaccttccccttcgccgtggccaaccagctgctgctggtgagcctgctggagcacctgagccacgtgcacgagcccaaccccctgagaagcagacaggtgttcaagctgctgtgccagaccttcatcaagatgggcctgctgagcagcttcacctgcagcgacgagttcagcagcctgagactgcaccacaacagagccatcacccacctgatgagaagcgccaaggagagagtgagacaggacccctgcgaggacatcagcagaatccagaagatcagaagcagagaggtggccctggaggcccagaccagcagatacctgaacgagttcgaggagctggccatcctgggcaagggcggctacggcagagtgtacaaggtgagaaacaagctggacggccagtactacgccatcaagaagatcctgatcaagggcgccaccaagaccgtgtgcatgaaggtgctgagagaggtgaaggtgctggccggcctgcagcaccccaacatcgtgggctaccacaccgcctggatcgagcacgtgcacgtgatccagcccagagccgacagagccgccatcgagctgcccagcctggaggtgctgagcgaccaggaggaggacagagagcagtgcggcgtgaagaacgacgagagcagcagcagcagcatcatcttcgccgagcccacccccgagaaggagaagagattcggcgagagcgacaccgagaaccagaacaacaagagcgtgaagtacaccaccaacctggtgatcagagagagcggcgagctggagagcaccctggagctgcaggagaacggcctggccggcctgagcgccagcagcatcgtggagcagcagctgcccctgagaagaaacagccacctggaggagagcttcaccagcaccgaggagagcagcgaggagaacgtgaacttcctgggccagaccgaggcccagtaccacctgatgctgcacatccagatgcagctgtgcgagctgagcctgtgggactggatcgtggagagaaacaagagaggcagagagtacgtggacgagagcgcctgcccctacgtgatggccaacgtggccaccaagatcttccaggagctggtggagggcgtgttctacatccacaacatgggcatcgtgcacagagacctgaagcccagaaacatcttcctgcacggccccgaccagcaggtgaagatcggcgacttcggcctggcctgcaccgacatcctgcagaagaacaccgactggaccaacagaaacggcaagagaacccccacccacaccagcagagtgggcacctgcctgtacgccagccccgagcagctggagggcagcgagtacgacgccaagagcgacatgtacagcctgggcgtggtgctgctggagctgttccagcccttcggcaccgagatggagagagccgaggtgctgaccggcctgagaaccggccagctgcccgagagcctgagaaagagatgccccgtgcaggccaagtacatccagcacctgaccagaagaaacagcagccagagacccagcgccatccagctgctgcagagcgagctgttccagaacagcggcaacgtgaacctgaccctgcagatgaagatcatcgagcaggagaaggagatcgccgagctgaagaagcagctgaacctgctgagccaggacaagggcgtgagagacgacggcaaggacggcggcgtgggctag

SEQ ID NO: 80863 - DNA, 1734 bp, Artificial Sequence
  Description of Artificial Sequence: Synthetic coding sequence
atgaaccagacccacttcgtgcaggacagatgcctgagcgacccctgcgaggacatcagcagaatccagaagatcagaagcagagaggtggccctggaggcccagaccagcagatacctgaacgagttcgaggagctggccatcctgggcaagggcggctacggcagagtgtacaaggtgagaaacaagctggacggccagtactacgccatcaagaagatcctgatcaagggcgccaccaagaccgtgtgcatgaaggtgctgagagaggtgaaggtgctggccggcctgcagcaccccaacatcgtgggctaccacaccgcctggatcgagcacgtgcacgtgatccagcccagagccgacagagccgccatcgagctgcccagcctggaggtgctgagcgaccaggaggaggacagagagcagtgcggcgtgaagaacgacgagagcagcagcagcagcatcatcttcgccgagcccacccccgagaaggagaagagattcggcgagagcgacaccgagaaccagaacaacaagagcgtgaagtacaccaccaacctggtgatcagagagagcggcgagctggagagcaccctggagctgcaggagaacggcctggccggcctgagcgccagcagcatcgtggagcagcagctgcccctgagaagaaacagccacctggaggagagcttcaccagcaccgaggagagcagcgaggagaacgtgaacttcctgggccagaccgaggcccagtaccacctgatgctgcacatccagatgcagctgtgcgagctgagcctgtgggactggatcgtggagagaaacaagagaggcagagagtacgtggacgagagcgcctgcccctacgtgatggccaacgtggccaccaagatcttccaggagctggtggagggcgtgttctacatccacaacatgggcatcgtgcacagagacctgaagcccagaaacatcttcctgcacggccccgaccagcaggtgaagatcggcgacttcggcctggcctgcaccgacatcctgcagaagaacaccgactggaccaacagaaacggcaagagaacccccacccacaccagcagagtgggcacctgcctgtacgccagccccgagcagctggagggcagcgagtacgacgccaagagcgacatgtacagcctgggcgtggtgctgctggagctgttccagcccttcggcaccgagatggagagagccgaggtgctgaccggcctgagaaccggccagctgcccgagagcctgagaaagagatgccccgtgcaggccaagtacatccagcacctgaccagaagaaacagcagccagagacccagcgccatccagctgctgcagagcgagctgttccagaacagcggcaacgtgaacctgaccctgcagatgaagatcatcgagcaggagaaggagatcgccgagctgaagaagcagctgaacctgctgagccaggacaagggcttcagcgtgatccccaagccccacccctgcaaggccctgtacagcgccccccagatgatcagcagacagctgagaagcctgagctgcctgtgccccgccctgttccccggcaccagcagcttcatcgtggccctgagcagccccgccaacctgtacatcccccagagacagagaagcgacgagctggtgttcgagagccagaagggcagcgccatggagctggccgtgatcaccgtggacggcgtgtag

SEQ ID NO: 80864 - DNA, 3351 bp, Artificial Sequence
  Description of Artificial Sequence: Synthetic coding sequence
atggagagagccatcagccccggcctgctggtgagagccctgctgctgctgctgctgctgctgggcctggccgccagaaccgtggccgccggcagagccagaggcctgcccgcccccaccgccgaggccgccttcggcctgggcgccgccgccgcccccaccagcgccaccagagtgcccgccgccggcgccgtggccgccgccgaggtgaccgtggaggacgccgaggccctgcccgccgccgccggcgagcaggagcccagaggccccgagcccgacgacgagaccgagctgagacccagaggcagaagcctggtgatcatcagcaccctggacggcagaatcgccgccctggaccccgagaaccacggcaagaagcagtgggacctggacgtgggcagcggcagcctggtgagcagcagcctgagcaagcccgaggtgttcggcaacaagatgatcatccccagcctggacggcgccctgttccagtgggaccaggacagagagagcatggagaccgtgcccttcaccgtggagagcctgctggagagcagctacaagttcggcgacgacgtggtgctggtgggcggcaagagcctgaccacctacggcctgagcgcctacagcggcaaggtgagatacatctgcagcgccctgggctgcagacagtgggacagcgacgagatggagcaggaggaggacatcctgctgctgcagagaacccagaagaccgtgagagccgtgggccccagaagcggcaacgagaagtggaacttcagcgtgggccacttcgagctgagatacatccccgacatggagaccagagccggcttcatcgagagcaccttcaagcccaacgagaacaccgaggagagcaagatcatcagcgacgtggaggagcaggaggccgccatcatggacatcgtgatcaaggtgagcgtggccgactggaaggtgatggccttcagcaagaagggcggccacctggagtgggagtaccagttctgcacccccatcgccagcgcctggctgctgaaggacggcaaggtgatccccatcagcctgttcgacgacaccagctacaccagcaacgacgacgtgctggaggacgaggaggacatcgtggaggccgccagaggcgccaccgagaacagcgtgtacctgggcatgtacagaggccagctgtacctgcagagcagcgtgagaatcagcgagaagttccccagcagccccaaggccctggagagcgtgaccaacgagaacgccatcatccccctgcccaccatcaagtggaagcccctgatccacagccccagcagaacccccgtgctggtgggcagcgacgagttcgacaagtgcctgagcaacgacaagttcagccacgaggagtacagcaacggcgccctgagcatcctgcagtacccctacgacaacggctactacctgccctactacaagagagagagaaacaagagaagcacccagatcaccgtgagattcctggacaacccccactacaacaagaacatcagaaagaaggaccccgtgctgctgctgcactggtggaaggagatcgtggccaccatcctgttctgcatcatcgccaccaccttcatcgtgagaagactgttccacccccacccccacagacagagaaaggagagcgagacccagtgccagaccgagaacaagtacgacagcgtgagcggcgaggccaacgacagcagctggaacgacatcaagaacagcggctacatcagcagatacctgaccgacttcgagcccatccagtgcctgggcagaggcggcttcggcgtggtgttcgaggccaagaacaaggtggacgactgcaactacgccatcaagagaatcagactgcccaacagagagctggccagagagaaggtgatgagagaggtgaaggccctggccaagctggagcaccccggcatcgtgagatacttcaacgcctggctggaggccccccccgagaagtggcaggagaagatggacgagatctggctgaaggacgagagcaccgactggcccctgagcagccccagccccatggacgcccccagcgtgaagatcagaagaatggaccccttcgccaccaaggagcacatcgagatcatcgcccccagcccccagagaagcagaagcttcagcgtgggcatcagctgcgaccagaccagcagcagcgagagccagttcagccccctggagttcagcggcatggaccacgaggacatcagcgagagcgtggacgccgcctacaacctgcaggacagctgcctgaccgactgcgacgtggaggacggcaccatggacggcaacgacgagggccacagcttcgagctgtgccccagcgaggccagcccctacgtgagaagcagagagagaaccagcagcagcatcgtgttcgaggacagcggctgcgacaacgccagcagcaaggaggagcccaagaccaacagactgcacatcggcaaccactgcgccaacaagctgaccgccttcaagcccaccagcagcaagagcagcagcgaggccaccctgagcatcagcccccccagacccaccaccctgagcctggacctgaccaagaacaccaccgagaagctgcagcccagcagccccaaggtgtacctgtacatccagatgcagctgtgcagaaaggagaacctgaaggactggatgaacggcagatgcaccatcgaggagagagagagaagcgtgtgcctgcacatcttcctgcagatcgccgaggccgtggagttcctgcacagcaagggcctgatgcacagagacctgaagcccagcaacatcttcttcaccatggacgacgtggtgaaggtgggcgacttcggcctggtgaccgccatggaccaggacgaggaggagcagaccgtgctgacccccatgcccgcctacgccagacacaccggccaggtgggcaccaagctgtacatgagccccgagcagatccacggcaacagctacagccacaaggtggacatcttcagcctgggcctgatcctgttcgagctgctgtaccccttcagcacccagatggagagagtgagaaccctgaccgacgtgagaaacctgaagttcccccccctgttcacccagaagtacccctgcgagtacgtgatggtgcaggacatgctgagccccagccccatggagagacccgaggccatcaacatcatcgagaacgccgtgttcgaggacctggacttccccggcaagaccgtgctgagacagagaagcagaagcctgagcagcagcggcaccaagcacagcagacagagcaacaacagccacagccccctgcccagcaactag

SEQ ID NO: 80865 - DNA, 2898 bp, Artificial Sequence
  Description of Artificial Sequence: Synthetic coding sequence
atgatcatccccagcctggacggcgccctgttccagtgggaccaggacagagagagcatggagaccgtgcccttcaccgtggagagcctgctggagagcagctacaagttcggcgacgacgtggtgctggtgggcggcaagagcctgaccacctacggcctgagcgcctacagcggcaaggtgagatacatctgcagcgccctgggctgcagacagtgggacagcgacgagatggagcaggaggaggacatcctgctgctgcagagaacccagaagaccgtgagagccgtgggccccagaagcggcaacgagaagtggaacttcagcgtgggccacttcgagctgagatacatccccgacatggagaccagagccggcttcatcgagagcaccttcaagcccaacgagaacaccgaggagagcaagatcatcagcgacgtggaggagcaggaggccgccatcatggacatcgtgatcaaggtgagcgtggccgactggaaggtgatggccttcagcaagaagggcggccacctggagtgggagtaccagttctgcacccccatcgccagcgcctggctgctgaaggacggcaaggtgatccccatcagcctgttcgacgacaccagctacaccagcaacgacgacgtgctggaggacgaggaggacatcgtggaggccgccagaggcgccaccgagaacagcgtgtacctgggcatgtacagaggccagctgtacctgcagagcagcgtgagaatcagcgagaagttccccagcagccccaaggccctggagagcgtgaccaacgagaacgccatcatccccctgcccaccatcaagtggaagcccctgatccacagccccagcagaacccccgtgctggtgggcagcgacgagttcgacaagtgcctgagcaacgacaagttcagccacgaggagtacagcaacggcgccctgagcatcctgcagtacccctacgacaacggctactacctgccctactacaagagagagagaaacaagagaagcacccagatcaccgtgagattcctggacaacccccactacaacaagaacatcagaaagaaggaccccgtgctgctgctgcactggtggaaggagatcgtggccaccatcctgttctgcatcatcgccaccaccttcatcgtgagaagactgttccacccccacccccacagacagagaaaggagagcgagacccagtgccagaccgagaacaagtacgacagcgtgagcggcgaggccaacgacagcagctggaacgacatcaagaacagcggctacatcagcagatacctgaccgacttcgagcccatccagtgcctgggcagaggcggcttcggcgtggtgttcgaggccaagaacaaggtggacgactgcaactacgccatcaagagaatcagactgcccaacagagagctggccagagagaaggtgatgagagaggtgaaggccctggccaagctggagcaccccggcatcgtgagatacttcaacgcctggctggaggccccccccgagaagtggcaggagaagatggacgagatctggctgaaggacgagagcaccgactggcccctgagcagccccagccccatggacgcccccagcgtgaagatcagaagaatggaccccttcgccaccaaggagcacatcgagatcatcgcccccagcccccagagaagcagaagcttcagcgtgggcatcagctgcgaccagaccagcagcagcgagagccagttcagccccctggagttcagcggcatggaccacgaggacatcagcgagagcgtggacgccgcctacaacctgcaggacagctgcctgaccgactgcgacgtggaggacggcaccatggacggcaacgacgagggccacagcttcgagctgtgccccagcgaggccagcccctacgtgagaagcagagagagaaccagcagcagcatcgtgttcgaggacagcggctgcgacaacgccagcagcaaggaggagcccaagaccaacagactgcacatcggcaaccactgcgccaacaagctgaccgccttcaagcccaccagcagcaagagcagcagcgaggccaccctgagcatcagcccccccagacccaccaccctgagcctggacctgaccaagaacaccaccgagaagctgcagcccagcagccccaaggtgtacctgtacatccagatgcagctgtgcagaaaggagaacctgaaggactggatgaacggcagatgcaccatcgaggagagagagagaagcgtgtgcctgcacatcttcctgcagatcgccgaggccgtggagttcctgcacagcaagggcctgatgcacagagacctgaagcccagcaacatcttcttcaccatggacgacgtggtgaaggtgggcgacttcggcctggtgaccgccatggaccaggacgaggaggagcagaccgtgctgacccccatgcccgcctacgccagacacaccggccaggtgggcaccaagctgtacatgagccccgagcagatccacggcaacagctacagccacaaggtggacatcttcagcctgggcctgatcctgttcgagctgctgtaccccttcagcacccagatggagagagtgagaaccctgaccgacgtgagaaacctgaagttcccccccctgttcacccagaagtacccctgcgagtacgtgatggtgcaggacatgctgagccccagccccatggagagacccgaggccatcaacatcatcgagaacgccgtgttcgaggacctggacttccccggcaagaccgtgctgagacagagaagcagaagcctgagcagcagcggcaccaagcacagcagacagagcaacaacagccacagccccctgcccagcaactag

SEQ ID NO: 80866 - DNA, 1569 bp, Artificial Sequence
  Description of Artificial Sequence: Synthetic coding sequence
atggccgccgtggccgtggccgtgagagaggacagcggcagcggcatgaaggccgagctgccccccggccccggcgccgtgggcagagagatgaccaaggaggagaagctgcagctgagaaaggagaagaagcagcagaagaagaagagaaaggaggagaagggcgccgagcccgagaccggcagcgccgtgagcgccgcccagtgccagggccccaccagagagctgcccgagagcggcatccagctgggcacccccagagagaaggtgcccgccggcagaagcaaggccgagctgagagccgagagaagagccaagcaggaggccgagagagccctgaagcaggccagaaagggcgagcagggcggccccccccccaaggccagccccagcaccgccggcgagacccccagcggcgtgaagagactgcccgagtacccccaggtggacgacctgctgctgagaagactggtgaagaagcccgagagacagcaggtgcccaccagaaaggactacggcagcaaggtgagcctgttcagccacctgccccagtacagcagacagaacagcctgacccagttcatgagcatccccagcagcgtgatccaccccgccatggtgagactgggcctgcagtacagccagggcctggtgagcggcagcaacgccagatgcatcgccctgctgagagccctgcagcaggtgatccaggactacaccaccccccccaacgaggagctgagcagagacctggtgaacaagctgaagccctacatgagcttcctgacccagtgcagacccctgagcgccagcatgcacaacgccatcaagttcctgaacaaggagatcaccagcgtgggcagcagcaagagagaggaggaggccaagagcgagctgagagccgccatcgacagatacgtgcaggagaagatcgtgctggccgcccaggccatcagcagattcgcctaccagaagatcagcaacggcgacgtgatcctggtgtacggctgcagcagcctggtgagcagaatcctgcaggaggcctggaccgagggcagaagattcagagtggtggtggtggacagcagaccctggctggagggcagacacaccctgagaagcctggtgcacgccggcgtgcccgccagctacctgctgatccccgccgccagctacgtgctgcccgaggtgagcaaggtgctgctgggcgcccacgccctgctggccaacggcagcgtgatgagcagagtgggcaccgcccagctggccctggtggccagagcccacaacgtgcccgtgctggtgtgctgcgagacctacaagttctgcgagagagtgcagaccgacgccttcgtgagcaacgagctggacgaccccgacgacctgcagtgcaagagaggcgagcacgtggccctggccaactggcagaaccacgccagcctgagactgctgaacctggtgtacgacgtgaccccccccgagctggtggacctggtgatcaccgagctgggcatgatcccctgcagcagcgtgcccgtggtgctgagagtgaagagcagcgaccagtag

SEQ ID NO: 80867 - DNA, 1632 bp, Artificial Sequence
  Description of Artificial Sequence: Synthetic coding sequence
atgcccacccagcagcccgccgcccccagcaccagagcccccaagcccagcagaagcctgagcggcagcctgtgcgccctgttcagcgacgccgacagcggcagcggcatgaaggccgagctgccccccggccccggcgccgtgggcagagagatgaccaaggaggagaagctgcagctgagaaaggagaagaagcagcagaagaagaagagaaaggaggagaagggcgccgagcccgagaccggcagcgccgtgagcgccgcccagtgccagggccccaccagagagctgcccgagagcggcatccagctgggcacccccagagagaaggtgcccgccggcagaagcaaggccgagctgagagccgagagaagagccaagcaggaggccgagagagccctgaagcaggccagaaagggcgagcagggcggccccccccccaaggccagccccagcaccgccggcgagacccccagcggcgtgaagagactgcccgagtacccccaggtggacgacctgctgctgagaagactggtgaagaagcccgagagacagcaggtgcccaccagaaaggactacggcagcaaggtgagcctgttcagccacctgccccagtacagcagacagaacagcctgacccagttcatgagcatccccagcagcgtgatccaccccgccatggtgagactgggcctgcagtacagccagggcctggtgagcggcagcaacgccagatgcatcgccctgctgagagccctgcagcaggtgatccaggactacaccaccccccccaacgaggagctgagcagagacctggtgaacaagctgaagccctacatgagcttcctgacccagtgcagacccctgagcgccagcatgcacaacgccatcaagttcctgaacaaggagatcaccagcgtgggcagcagcaagagagaggaggaggccaagagcgagctgagagccgccatcgacagatacgtgcaggagaagatcgtgctggccgcccaggccatcagcagattcgcctaccagaagatcagcaacggcgacgtgatcctggtgtacggctgcagcagcctggtgagcagaatcctgcaggaggcctggaccgagggcagaagattcagagtggtggtggtggacagcagaccctggctggagggcagacacaccctgagaagcctggtgcacgccggcgtgcccgccagctacctgctgatccccgccgccagctacgtgctgcccgaggtgagcaaggtgctgctgggcgcccacgccctgctggccaacggcagcgtgatgagcagagtgggcaccgcccagctggccctggtggccagagcccacaacgtgcccgtgctggtgtgctgcgagacctacaagttctgcgagagagtgcagaccgacgccttcgtgagcaacgagctggacgaccccgacgacctgcagtgcaagagaggcgagcacgtggccctggccaactggcagaaccacgccagcctgagactgctgaacctggtgtacgacgtgaccccccccgagctggtggacctggtgatcaccgagctgggcatgatcccctgcagcagcgtgcccgtggtgctgagagtgaagagcagcgaccagtag

SEQ ID NO: 80868 - DNA, 918 bp, Artificial Sequence
  Description of Artificial Sequence: Synthetic coding sequence
atggacgacaaggagctgatcgagtacttcaagagccagatgaaggaggaccccgacatggccagcgccgtggccgccatcagaaccctgctggagttcctgaagagagacaagggcgagaccatccagggcctgagagccaacctgaccagcgccatcgagaccctgtgcggcgtggacagcagcgtggccgtgagcagcggcggcgagctgttcctgagattcatcagcctggccagcctggagtacagcgactacagcaagtgcaagaagatcatgatcgagagaggcgagctgttcctgagaagaatcagcctgagcagaaacaagatcgccgacctgtgccacaccttcatcaaggacggcgccaccatcctgacccacgcctacagcagagtggtgctgagagtgctggaggccgccgtggccgccaagaagagattcagcgtgtacgtgaccgagagccagcccgacctgagcggcaagaagatggccaaggccctgtgccacctgaacgtgcccgtgaccgtggtgctggacgccgccgtgggctacatcatggagaaggccgacctggtgatcgtgggcgccgagggcgtggtggagaacggcggcatcatcaacaagatcggcaccaaccagatggccgtgtgcgccaaggcccagaacaagcccttctacgtggtggccgagagcttcaagttcgtgagactgttccccctgaaccagcaggacgtgcccgacaagttcaagtacaaggccgacaccctgaaggtggcccagaccggccaggacctgaaggaggagcacccctgggtggactacaccgcccccagcctgatcaccctgctgttcaccgacctgggcgtgctgacccccagcgccgtgagcgacgagctgatcaagctgtacctgtag

SEQ ID NO: 80869 - DNA, 1056 bp, Artificial Sequence
  Description of Artificial Sequence: Synthetic coding sequence
atgcccggcagcgccgccaagggcagcgagctgagcgagagaatcgagagcttcgtggagaccctgaagagaggcggcggccccagaagcagcgaggagatggccagagagaccctgggcctgctgagacagatcatcaccgaccacagatggagcaacgccggcgagctgatggagctgatcagaagagagggcagaagaatgaccgccgcccagcccagcgagaccaccgtgggcaacatggtgagaagagtgctgaagatcatcagagaggagtacggcagactgcacggcagaagcgacgagagcgaccagcaggagagcctgcacaagctgctgaccagcggcggcctgaacgaggacttcagcttccactacgcccagctgcagagcaacatcatcgaggccatcaacgagctgctggtggagctggagggcaccatggagaacatcgccgcccaggccctggagcacatccacagcaacgaggtgatcatgaccatcggcttcagcagaaccgtggaggccttcctgaaggaggccgccagaaagagaaagttccacgtgatcgtggccgagtgcgcccccttctgccagggccacgagatggccgtgaacctgagcaaggccggcatcgagaccaccgtgatgaccgacgccgccatcttcgccgtgatgagcagagtgaacaaggtgatcatcggcaccaagaccatcctggccaacggcgccctgagagccgtgaccggcacccacaccctggccctggccgccaagcaccacagcacccccctgatcgtgtgcgcccccatgttcaagctgagcccccagttccccaacgaggaggacagcttccacaagttcgtggcccccgaggaggtgctgcccttcaccgagggcgacatcctggagaaggtgagcgtgcactgccccgtgttcgactacgtgccccccgagctgatcaccctgttcatcagcaacatcggcggcaacgcccccagctacatctacagactgatgagcgagctgtaccaccccgacgaccacgtgctgtag

SEQ ID NO: 80870 - DNA, 1359 bp, Artificial Sequence
  Description of Artificial Sequence: Synthetic coding sequence
atggagttccaggccgtggtgatggccgtgggcggcggcagcagaatgaccgacctgaccagcagcatccccaagcccctgctgcccgtgggcaacaagcccctgatctggtaccccctgaacctgctggagagagtgggcttcgaggaggtgatcgtggtgaccaccagagacgtgcagaaggccctgtgcgccgagttcaagatgaagatgaagcccgacatcgtgtgcatccccgacgacgccgacatgggcaccgccgacagcctgagatacatctaccccaagctgaagaccgacgtgctggtgctgagctgcgacctgatcaccgacgtggccctgcacgaggtggtggacctgttcagagcctacgacgccagcctggccatgctgatgagaaagggccaggacagcatcgagcccgtgcccggccagaagggcaagaagaaggccgtggagcagagagacttcatcggcgtggacagcaccggcaagagactgctgttcatggccaacgaggccgacctggacgaggagctggtgatcaagggcagcatcctgcagaagcaccccagaatcagattccacaccggcctggtggacgcccacctgtactgcctgaagaagtacatcgtggacttcctgatggagaacggcagcatcaccagcatcagaagcgagctgatcccctacctggtgagaaagcagttcagcagcgccagcagccagcagggccaggaggagaaggaggaggacctgaagaagaaggagctgaagagcctggacatctacagcttcatcaaggaggccaacaccctgaacctggccccctacgacgcctgctggaacgcctgcagaggcgacagatgggaggacctgagcagaagccaggtgagatgctacgtgcacatcatgaaggagggcctgtgcagcagagtgagcaccctgggcctgtacatggaggccaacagacaggtgcccaagctgctgagcgccctgtgccccgaggagccccccgtgcacagcagcgcccagatcgtgagcaagcacctggtgggcgtggacagcctgatcggccccgagacccagatcggcgagaagagcagcatcaagagaagcgtgatcggcagcagctgcctgatcaaggacagagtgaccatcaccaactgcctgctgatgaacagcgtgaccgtggaggagggcagcaacatccagggcagcgtgatctgcaacaacgccgtgatcgagaagggcgccgacatcaaggactgcctgatcggcagcggccagagaatcgaggccaaggccaagagagtgaacgaggtgatcgtgggcaacgaccagctgatggagatctag

SEQ ID NO: 80871 - DNA, 594 bp, Artificial Sequence
  Description of Artificial Sequence: Synthetic coding sequence
atggagttccaggccgtggtgatggccgtgggcggcggcagcagaatgaccgacctgaccagcagcatccccaagcccctgctgcccgtgggcaacaagcccctgatctggtaccccctgaacctgctggagagagtgggcttcgaggaggtgatcgtggtgaccaccagagacgtgcagaaggccctgtgcgccgagttcaagatgaagatgaagcccgacatcgtgtgcatccccgacgacgccgacatgggcaccgccgacagcctgagatacatctaccccaagctgaagaccgacgtgctggtgctgagctgcgacctgatcaccgacgtggccctgcacgaggtggtggacctgttcagagcctacgacgccagcctggccatgctgatgagaaagggccaggacagcatcgagcccgtgcccggccagaagggcaagaagaaggccgacggcgacagcctgtgctgccaggccggcgtgcagtggcaccacctgggcagcctgcagagccccccccccggcttcaagcacttcacctgcctgagcctgcccagcagctgggactacatgcacatgcccccccactag

SEQ ID NO: 80872 - DNA, 1239 bp, Artificial Sequence
  Description of Artificial Sequence: Synthetic coding sequence
atggagttccaggccgtggtgatggccgtgggcggcggcagcagaatgaccgacctgaccagcagcatccccaagcccctgctgcccgtgggcaacaagcccctgatctggtaccccctgaacctgctggagagagtgggcttcgaggaggtgatcgtggtgaccaccagagacgtgcagaaggccctgtgcgccgagttcaagatgaagatgaagcccgacatcgtgtgcatccccgacgacgccgacatgggcaccgccgacagcctgagatacatctaccccaagctgaagaccgacgtgctggtgctgagctgcgacctgatcaccgacgtggccctgcacgaggtggtggacctgttcagagcctacgacgccagcctggccatgctgatgagaaagggccaggacagcatcgagcccgtgcccggccagaagggcaagaagaaggccgtggagcagagagacttcatcggcgtggacagcaccggcaagagactgctgttcatggccaacgaggccgacctggacgaggagctggtgatcaagggcagcatcctgcagaagcaccccagaatcagattccacaccggcctggtggacgcccacctgtactgcctgaagaagtacatcgtggacttcctgatggagaacggcagcatcaccagcatcagaagcgagctgatcccctacctggtgagaaagcagttcagcagcgccagcagccagcagggccaggaggagaaggaggaggacctgaagaagaaggagctgaagagcctggacatctacagcttcatcaaggaggccaacaccctgaacctggccccctacgacgcctgctggaacgcctgcagaggcgacagatgggaggacctgagcagaagccaggtgagatgctacgtgcacatcatgaaggagggcctgtgcagcagagtgagcaccctgggcctgtacatggaggccaacagacaggtgcccaagctgctgagcgccctgtgccccgaggagccccccgtgcacagcagcgcccagatcgtgagcaagcacctggtgggcgtggacagcctgatcggccccgagacccagatcggcgagaagagcagcatcaagagaagcgtgatcggcagcagctgcctgatcaaggacagagtgaccatcaccaactgcctgctgatgaacagcgtgaccgtggaggagggctacgtgagcccctgcacccacctgagacagagatag

SEQ ID NO: 80873 - DNA, 669 bp, Artificial Sequence
  Description of Artificial Sequence: Synthetic coding sequence
tgagtgatcaagggcagcatcctgcagaagcaccccagaatcagattccacaccggcctggtggacgcccacctgtactgcctgaagaagtacatcgtggacttcctgatggagaacggcagcatcaccagcatcagaagcgagctgatcccctacctggtgagaaagcagttcagcagcgccagcagccagcagggccaggaggagaaggaggaggacctgaagaagaaggagctgaagagcctggacatctacagcttcatcaaggaggccaacaccctgaacctggccccctacgacgcctgctggaacgcctgcagaggcgacagatgggaggacctgagcagaagccaggtgagatgctacgtgcacatcatgaaggagggcctgtgcagcagagtgagcaccctgggcctgtacatggaggccaacagacaggtgcccaagctgctgagcgccctgtgccccgaggagccccccgtgcacagcagcgcccagatcgtgagcaagcacctggtgggcgtggacagcctgatcggccccgagacccagatcggcgagaagagcagcatcaagagaagcgtgatcggcagcagctgcctgatcaaggacagagtgaccatcaccaactgcctgctgatgaacagcgtgaccgtggaggagggctag

SEQ ID NO: 80874 - DNA, 1572 bp, Artificial Sequence
  Description of Artificial Sequence: Synthetic coding sequence
atggccgccgtggccgtggccgtgagagaggacagcggcagcggcatgaaggccgagctgccccccggccccggcgccgtgggcagagagatgaccaaggaggagaagctgcagctgagaaaggagaagaagcagcagaagaagaagagaaaggaggagaagggcgccgagcccgagaccggcagcgccgtgagcgccgcccagtgccaggtgggccccaccagagagctgcccgagagcggcatccagctgggcacccccagagagaaggtgcccgccggcagaagcaaggccgagctgagagccgagagaagagccaagcaggaggccgagagagccctgaagcaggccagaaagggcgagcagggcggccccccccccaaggccagccccagcaccgccggcgagacccccagcggcgtgaagagactgcccgagtacccccaggtggacgacctgctgctgagaagactggtgaagaagcccgagagacagcaggtgcccaccagaaaggactacggcagcaaggtgagcctgttcagccacctgccccagtacagcagacagaacagcctgacccagttcatgagcatccccagcagcgtgatccaccccgccatggtgagactgggcctgcagtacagccagggcctggtgagcggcagcaacgccagatgcatcgccctgctgagagccctgcagcaggtgatccaggactacaccaccccccccaacgaggagctgagcagagacctggtgaacaagctgaagccctacatgagcttcctgacccagtgcagacccctgagcgccagcatgcacaacgccatcaagttcctgaacaaggagatcaccagcgtgggcagcagcaagagagaggaggaggccaagagcgagctgagagccgccatcgacagatacgtgcaggagaagatcgtgctggccgcccaggccatcagcagattcgcctaccagaagatcagcaacggcgacgtgatcctggtgtacggctgcagcagcctggtgagcagaatcctgcaggaggcctggaccgagggcagaagattcagagtggtggtggtggacagcagaccctggctggagggcagacacaccctgagaagcctggtgcacgccggcgtgcccgccagctacctgctgatccccgccgccagctacgtgctgcccgaggtgagcaaggtgctgctgggcgcccacgccctgctggccaacggcagcgtgatgagcagagtgggcaccgcccagctggccctggtggccagagcccacaacgtgcccgtgctggtgtgctgcgagacctacaagttctgcgagagagtgcagaccgacgccttcgtgagcaacgagctggacgaccccgacgacctgcagtgcaagagaggcgagcacgtggccctggccaactggcagaaccacgccagcctgagactgctgaacctggtgtacgacgtgaccccccccgagctggtggacctggtgatcaccgagctgggcatgatcccctgcagcagcgtgcccgtggtgctgagagtgaagagcagcgaccagtag

SEQ ID NO: 80875 - DNA, 1563 bp, Artificial Sequence
  Description of Artificial Sequence: Synthetic coding sequence
atggccgccgtggccgtggccgtgagagaggacagcggcagcggcatgaaggccgagagcccctgggcctgggtgggcagagagatgaccaaggaggagaagctgcagctgagaaaggagaagaagcagcagaagaagaagagaaaggaggagaagggcgccgagcccgagaccggcagcgccgtgagcgccgcccagtgccagggccccaccagagagctgcccgagagcggcatccagctgggcacccccagagagaaggtgcccgccggcagaagcaaggccgagctgagagccgagagaagagccaagcaggaggccgagagagccctgaagcaggccagaaagggcgagcagggcggccccccccccaaggccagccccagcaccgccggcgagacccccagcggcgtgaagagactgcccgagtacccccaggtggacgacctgctgctgagaagactggtgaagaagcccgagagacagcaggtgcccaccagaaaggactacggcagcaaggtgagcctgttcagccacctgccccagtacagcagacagaacagcctgacccagttcatgagcatccccagcagcgtgatccaccccgccatggtgagactgggcctgcagtacagccagggcctggtgagcggcagcaacgccagatgcatcgccctgctgagagccctgcagcaggtgatccaggactacaccaccccccccaacgaggagctgagcagagacctggtgaacaagctgaagccctacatgagcttcctgacccagtgcagacccctgagcgccagcatgcacaacgccatcaagttcctgaacaaggagatcaccagcgtgggcagcagcaagagagaggaggaggccaagagcgagctgagagccgccatcgacagatacgtgcaggagaagatcgtgctggccgcccaggccatcagcagattcgcctaccagaagatcagcaacggcgacgtgatcctggtgtacggctgcagcagcctggtgagcagaatcctgcaggaggcctggaccgagggcagaagattcagagtggtggtggtggacagcagaccctggctggagggcagacacaccctgagaagcctggtgcacgccggcgtgcccgccagctacctgctgatccccgccgccagctacgtgctgcccgaggtgagcaaggtgctgctgggcgcccacgccctgctggccaacggcagcgtgatgagcagagtgggcaccgcccagctggccctggtggccagagcccacaacgtgcccgtgctggtgtgctgcgagacctacaagttctgcgagagagtgcagaccgacgccttcgtgagcaacgagctggacgaccccgacgacctgcagtgcaagagaggcgagcacgtggccctggccaactggcagaaccacgccagcctgagactgctgaacctggtgtacgacgtgaccccccccgagctggtggacctggtgatcaccgagctgggcatgatcccctgcagcagcgtgcccgtggtgctgagagtgaagagcagcgaccagtag

SEQ ID NO: 80876 - DNA, 2166 bp, Artificial Sequence
  Description of Artificial Sequence: Synthetic coding sequence
atggccgcccccgtggtggccccccccggcgtggtggtgagcagagccaacaagagaagcggcgccggccccggcggcagcggcggcggcggcgccagaggcgccgaggaggagccccccccccccctgcaggccgtgctggtggccgacagcttcgacagaagattcttccccatcagcaaggaccagcccagagtgctgctgcccctggccaacgtggccctgatcgactacaccctggagttcctgaccgccaccggcgtgcaggagaccttcgtgttctgctgctggaaggccgcccagatcaaggagcacctgctgaagagcaagtggtgcagacccaccagcctgaacgtggtgagaatcatcaccagcgagctgtacagaagcctgggcgacgtgctgagagacgtggacgccaaggccctggtgagaagcgacttcctgctggtgtacggcgacgtgatcagcaacatcaacatcaccagagccctggaggagcacagactgagaagaaagctggagaagaacgtgagcgtgatgaccatgatcttcaaggagagcagccccagccaccccaccagatgccacgaggacaacgtggtggtggccgtggacagcaccaccaacagagtgctgcacttccagaagacccagggcctgagaagattcgccttccccctgagcctgttccagggcagcagcgacggcgtggaggtgagatacgacctgctggactgccacatcagcatctgcagcccccaggtggcccagctgttcaccgacaacttcgactaccagaccagagacgacttcgtgagaggcctgctggtgaacgaggagatcctgggcaaccagatccacatgcacgtgaccgccaaggagtacggcgccagagtgagcaacctgcacatgtacagcgccgtgtgcgccgacgtgatcagaagatgggtgtaccccctgacccccgaggccaacttcaccgacagcaccacccagagctgcacccacagcagacacaacatctacagaggccccgaggtgagcctgggccacggcagcatcctggaggagaacgtgctgctgggcagcggcaccgtgatcggcagcaactgcttcatcaccaacagcgtgatcggccccggctgccacatcggcgacaacgtggtgctggaccagacctacctgtggcagggcgtgagagtggccgccggcgcccagatccaccagagcctgctgtgcgacaacgccgaggtgaaggagagagtgaccctgaagcccagaagcgtgctgaccagccaggtggtggtgggccccaacatcaccctgcccgagggcagcgtgatcagcctgcacccccccgacgccgaggaggacgaggacgacggcgagttcagcgacgacagcggcgccgaccaggagaaggacaaggtgaagatgaagggctacaaccccgccgaggtgggcgccgccggcaagggctacctgtggaaggccgccggcatgaacatggaggaggaggaggagctgcagcagaacctgtggggcctgaagatcaacatggaggaggagagcgagagcgagagcgagcagagcatggacagcgaggagcccgacagcagaggcggcagcccccagatggacgacatcaaggtgttccagaacgaggtgctgggcaccctgcagagaggcaaggaggagaacatcagctgcgacaacctggtgctggagatcaacagcctgaagtacgcctacaacatcagcctgaaggaggtgatgcaggtgctgagccacgtggtgctggagttccccctgcagcagatggacagccccctggacagcagcagatactgcgccctgctgctgcccctgctgaaggcctggagccccgtgttcagaaactacatcaagagagccgccgaccacctggaggccctggccgccatcgaggacttcttcctggagcacgaggccctgggcatcagcatggccaaggtgctgatggccttctaccagctggagatcctggccgaggagaccatcctgagctggttcagccagagagacaccaccgacaagggccagcagctgagaaagaaccagcagctgcagagattcatccagtggctgaaggaggccgaggaggagagcagcgaggacgactag

SEQ ID NO: 80877 - DNA, 1014 bp, Artificial Sequence
  Description of Artificial Sequence: Synthetic coding sequence
cccccccagcccagcaagatgctgggcctgcaggtggcccagctgttcaccgacaacttcgactaccagaccagagacgacttcgtgagaggcctgctggtgaacgaggagatcctgggcaaccagatccacatgcacgtgaccgccaaggagtacggcgccagagtgagcaacctgcacatgtacagcgccgtgtgcgccgacgtgatcagaagatgggtgtaccccctgacccccgaggccaacttcaccgacagcaccacccagagctgcacccacagcagacacaacatctacagaggccccgaggtgagcctgggccacggcagcatcctggaggagaacgtgctgctgggcagcggcaccgtgatcggcagcaactgcttcatcaccaacagcgtgatcggccccggctgccacatcggcgacaacgtggtgctggaccagacctacctgtggcagggcgtgagagtggccgccggcgcccagatccaccagagcctgctgtgcgacaacgccgaggtgaaggagagagtgaccctgaagcccagaagcgtgctgaccagccaggtggtggtgggccccaacatcaccctgcccgagggcagcgtgatcagcctgcacccccccgacgccgaggaggacgaggacgacggcgagttcagcgacgacagcggcgccgaccaggagaaggacaaggtgaagatgaagggctacaaccccgccgaggtgggcgccgccggcaagggctacctgtggaaggccgccggcatgaacatggaggaggaggaggagctgcagcagaacctgtggggcctgaagatcaacatggaggaggagagcgagagcgagagcgagcagagcatggacagcgaggagcccgacagcagaggcggcagcccccagatggacgacatcaaggtgttccagaacgaggtgctgggcaccctgcagagaggcaaggaggagaacatcagctgcgacaacctggtgctggagatcaacagcctgtag

SEQ ID NO: 80878 - DNA, 2574 bp, Artificial Sequence
  Description of Artificial Sequence: Synthetic coding sequence
atggaggccggccccagcggcgccgccgccggcgcctacctgccccccctgcagcaggtgttccaggcccccagaagacccggcatcggcaccgtgggcaagcccatcaagctgctggccaactacttcgaggtggacatccccaagatcgacgtgtaccactacgaggtggacatcaagcccgacaagtgccccagaagagtgaacagagaggtggtggagtacatggtgcagcacttcaagccccagatcttcggcgacagaaagcccgtgtacgacggcaagaagaacatctacaccgtgaccgccctgcccatcggcaacgagagagtggacttcgaggtgaccatccccggcgagggcaaggacagaatcttcaaggtgagcatcaagtggctggccatcgtgagctggagaatgctgcacgaggccctggtgagcggccagatccccgtgcccctggagagcgtgcaggccctggacgtggccatgagacacctggccagcatgagatacacccccgtgggcagaagcttcttcagcccccccgagggctactaccaccccctgggcggcggcagagaggtgtggttcggcttccaccagagcgtgagacccgccatgtggaagatgatgctgaacatcgacgtgagcgccaccgccttctacaaggcccagcccgtgatcgagttcatgtgcgaggtgctggacatcagaaacatcgacgagcagcccaagcccctgaccgacagccagagagtgagattcaccaaggagatcaagggcctgaaggtggaggtgacccactgcggccagatgaagagaaagtacagagtgtgcaacgtgaccagaagacccgccagccaccagaccttccccctgcagctggagagcggccagaccgtggagtgcaccgtggcccagtacttcaagcagaagtacaacctgcagctgaagtacccccacctgccctgcctgcaggtgggccaggagcagaagcacacctacctgcccctggaggtgtgcaacatcgtggccggccagagatgcatcaagaagctgaccgacaaccagaccagcaccatgatcaaggccaccgccagaagcgcccccgacagacaggaggagatcagcagactgatgaagaacgccagctacaacctggacccctacatccaggagttcggcatcaaggtgaaggacgacatgaccgaggtgaccggcagagtgctgcccgcccccatcctgcagtacggcggcagaaacagagccatcgccacccccaaccagggcgtgtgggacatgagaggcaagcagttctacaacggcatcgagatcaaggtgtgggccatcgcctgcttcgccccccagaagcagtgcagagaggaggtgctgaagaacttcaccgaccagctgagaaagatcagcaaggacgccggcatgcccatccagggccagccctgcttctgcaagtacgcccagggcgccgacagcgtggagcccatgttcagacacctgaagaacacctacagcggcctgcagctgatcatcgtgatcctgcccggcaagacccccgtgtacgccgaggtgaagagagtgggcgacaccctgctgggcatggccacccagtgcgtgcaggtgaagaacgtggtgaagaccagcccccagaccctgagcaacctgtgcctgaagatcaacgtgaagctgggcggcatcaacaacatcctggtgccccaccagagaagcgccgtgttccagcagcccgtgatcttcctgggcgccgacgtgacccacccccccgccggcgacggcaagaagcccagcatcaccgccgtggtgggcagcatggacgcccaccccagcagatactgcgccaccgtgagagtgcagagacccagacaggagatcatcgaggacctgagctacatggtgagagagctgctgatccagttctacaagagcaccagattcaagcccaccagaatcatcttctacagagacggcgtgcccgagggccagctgccccagatcctgcactacgagctgctggccatcagagacgcctgcatcaagctggagaaggactaccagcccggcatcacctacatcgtggtgcagaagagacaccacaccagactgttctgcgccgacaagaacgagagaatcggcaagagcggcaacatccccgccggcaccaccgtggacaccaacatcacccaccccttcgagttcgacttctacctgtgcagccacgccggcatccagggcaccagcagacccagccactactacgtgctgtgggacgacaacagattcaccgccgacgagctgcagatcctgacctaccagctgtgccacacctacgtgagatgcaccagaagcgtgagcatccccgcccccgcctactacgccagactggtggccttcagagccagataccacctggtggacaaggagcacgacagcggcgagggcagccacatcagcggccagagcaacggcagagacccccaggccctggccaaggccgtgcaggtgcaccaggacaccctgagaaccatgtacttcgcctag

SEQ ID NO: 80879 - DNA, 2349 bp, Artificial Sequence
  Description of Artificial Sequence: Synthetic coding sequence
atggtgcagcacttcaagccccagatcttcggcgacagaaagcccgtgtacgacggcaagaagaacatctacaccgtgaccgccctgcccatcggcaacgagagagtggacttcgaggtgaccatccccggcgagggcaaggacagaatcttcaaggtgagcatcaagtggctggccatcgtgagctggagaatgctgcacgaggccctggtgagcggccagatccccgtgcccctggagagcgtgcaggccctggacgtggccatgagacacctggccagcatgagatacacccccgtgggcagaagcttcttcagcccccccgagggctactaccaccccctgggcggcggcagagaggtgtggttcggcttccaccagagcgtgagacccgccatgtggaagatgatgctgaacatcgacgtgagcgccaccgccttctacaaggcccagcccgtgatcgagttcatgtgcgaggtgctggacatcagaaacatcgacgagcagcccaagcccctgaccgacagccagagagtgagattcaccaaggagatcaagggcctgaaggtggaggtgacccactgcggccagatgaagagaaagtacagagtgtgcaacgtgaccagaagacccgccagccaccagaccttccccctgcagctggagagcggccagaccgtggagtgcaccgtggcccagtacttcaagcagaagtacaacctgcagctgaagtacccccacctgccctgcctgcaggtgggccaggagcagaagcacacctacctgcccctggaggtgtgcaacatcgtggccggccagagatgcatcaagaagctgaccgacaaccagaccagcaccatgatcaaggccaccgccagaagcgcccccgacagacaggaggagatcagcagactgatgaagaacgccagctacaacctggacccctacatccaggagttcggcatcaaggtgaaggacgacatgaccgaggtgaccggcagagtgctgcccgcccccatcctgcagtacggcggcagaaacagagccatcgccacccccaaccagggcgtgtgggacatgagaggcaagcagttctacaacggcatcgagatcaaggtgtgggccatcgcctgcttcgccccccagaagcagtgcagagaggaggtgctgaagaacttcaccgaccagctgagaaagatcagcaaggacgccggcatgcccatccagggccagccctgcttctgcaagtacgcccagggcgccgacagcgtggagcccatgttcagacacctgaagaacacctacagcggcctgcagctgatcatcgtgatcctgcccggcaagacccccgtgtacgccgaggtgaagagagtgggcgacaccctgctgggcatggccacccagtgcgtgcaggtgaagaacgtggtgaagaccagcccccagaccctgagcaacctgtgcctgaagatcaacgtgaagctgggcggcatcaacaacatcctggtgccccaccagagaagcgccgtgttccagcagcccgtgatcttcctgggcgccgacgtgacccacccccccgccggcgacggcaagaagcccagcatcaccgccgtggtgggcagcatggacgcccaccccagcagatactgcgccaccgtgagagtgcagagacccagacaggagatcatcgaggacctgagctacatggtgagagagctgctgatccagttctacaagagcaccagattcaagcccaccagaatcatcttctacagagacggcgtgcccgagggccagctgccccagatcctgcactacgagctgctggccatcagagacgcctgcatcaagctggagaaggactaccagcccggcatcacctacatcgtggtgcagaagagacaccacaccagactgttctgcgccgacaagaacgagagaatcggcaagagcggcaacatccccgccggcaccaccgtggacaccaacatcacccaccccttcgagttcgacttctacctgtgcagccacgccggcatccagggcaccagcagacccagccactactacgtgctgtgggacgacaacagattcaccgccgacgagctgcagatcctgacctaccagctgtgccacacctacgtgagatgcaccagaagcgtgagcatccccgcccccgcctactacgccagactggtggccttcagagccagataccacctggtggacaaggagcacgacagcggcgagggcagccacatcagcggccagagcaacggcagagacccccaggccctggccaaggccgtgcaggtgcaccaggacaccctgagaaccatgtacttcgcctag

SEQ ID NO: 80880 - DNA, 1254 bp, Artificial Sequence
  Description of Artificial Sequence: Synthetic coding sequence
atggagttcgtgaagtgcctgggccaccccgaggagttctacaacctggtgagattcagaatcggcggcaagagaaaggtgatgcccaagatggaccaggacagcctgagcagcagcctgaagacctgctacaagtacctgaaccagaccagcagaagcttcgccgccgtgatccaggccctggacggcgagatgagaaacgccgtgtgcatcttctacctggtgctgagagccctggacaccctggaggacgacatgaccatcagcgtggagaagaaggtgcccctgctgcacaacttccacagcttcctgtaccagcccgactggagattcatggagagcaaggagaaggacagacaggtgctggaggacttccccaccatcagcctggagttcagaaacctggccgagaagtaccagaccgtgatcgccgacatctgcagaagaatgggcatcggcatggccgagttcctggacaagcacgtgaccagcgagcaggagtgggacaagtactgccactacgtggccggcctggtgggcatcggcctgagcagactgttcagcgccagcgagttcgaggaccccctggtgggcgaggacaccgagagagccaacagcatgggcctgttcctgcagaagaccaacatcatcagagactacctggaggaccagcagggcggcagagagttctggccccaggaggtgtggagcagatacgtgaagaagctgggcgacttcgccaagcccgagaacatcgacctggccgtgcagtgcctgaacgagctgatcaccaacgccctgcaccacatccccgacgtgatcacctacctgagcagactgagaaaccagagcgtgttcaacttctgcgccatcccccaggtgatggccatcgccaccctggccgcctgctacaacaaccagcaggtgttcaagggcgccgtgaagatcagaaagggccaggccgtgaccctgatgatggacgccaccaacatgcccgccgtgaaggccatcatctaccagtacatggaggagatctaccacagaatccccgacagcgaccccagcagcagcaagaccagacagatcatcagcaccatcagaacccagaacctgcccaactgccagctgatcagcagaagccactacagccccatctacctgagcttcgtgatgctgctggccgccctgagctggcagtacctgaccaccctgagccaggtgaccgaggactacgtgcagaccggcgagcactag

SEQ ID NO: 80881 - DNA, 2478 bp, Artificial Sequence
  Description of Artificial Sequence: Synthetic coding sequence
atgtacagcggcgccggccccgccctggccccccccgccccccccccccccatccagggctacgccttcaagcccccccccagacccgacttcggcaccagcggcagaaccatcaagctgcaggccaacttcttcgagatggacatccccaagatcgacatctaccactacgagctggacatcaagcccgagaagtgccccagaagagtgaacagagagatcgtggagcacatggtgcagcacttcaagacccagatcttcggcgacagaaagcccgtgttcgacggcagaaagaacctgtacaccgccatgcccctgcccatcggcagagacaaggtggagctggaggtgaccctgcccggcgagggcaaggacagaatcttcaaggtgagcatcaagtgggtgagctgcgtgagcctgcaggccctgcacgacgccctgagcggcagactgcccagcgtgcccttcgagaccatccaggccctggacgtggtgatgagacacctgcccagcatgagatacacccccgtgggcagaagcttcttcaccgccagcgagggctgcagcaaccccctgggcggcggcagagaggtgtggttcggcttccaccagagcgtgagacccagcctgtggaagatgatgctgaacatcgacgtgagcgccaccgccttctacaaggcccagcccgtgatcgagttcgtgtgcgaggtgctggacttcaagagcatcgaggagcagcagaagcccctgaccgacagccagagagtgaagttcaccaaggagatcaagggcctgaaggtggagatcacccactgcggccagatgaagagaaagtacagagtgtgcaacgtgaccagaagacccgccagccaccagaccttccccctgcagcaggagagcggccagaccgtggagtgcaccgtggcccagtacttcaaggacagacacaagctggtgctgagatacccccacctgccctgcctgcaggtgggccaggagcagaagcacacctacctgcccctggaggtgtgcaacatcgtggccggccagagatgcatcaagaagctgaccgacaaccagaccagcaccatgatcagagccaccgccagaagcgcccccgacagacaggaggagatcagcaagctgatgagaagcgccagcttcaacaccgacccctacgtgagagagttcggcatcatggtgaaggacgagatgaccgacgtgaccggcagagtgctgcagccccccagcatcctgtacggcggcagaaacaaggccatcgccacccccgtgcagggcgtgtgggacatgagaaacaagcagttccacaccggcatcgagatcaaggtgtgggccatcgcctgcttcgccccccagagacagtgcaccgaggtgcacctgaagagcttcaccgagcagctgagaaagatcagcagagacgccggcatgcccatccagggccagccctgcttctgcaagtacgcccagggcgccgacagcgtggagcccatgttcagacacctgaagaacacctacgccggcctgcagctggtggtggtgatcctgcccggcaagacccccgtgtacgccgaggtgaagagagtgggcgacaccgtgctgggcatggccacccagtgcgtgcagatgaagaacgtgcagagaaccaccccccagaccctgagcaacctgtgcctgaagatcaacgtgaagctgggcggcgtgaacaacatcctgctgccccagggcagaccccccgtgttccagcagcccgtgatcttcctgggcgccgacgtgacccacccccccgccggcgacggcaagaagcccagcatcgccgccgtggtgggcagcatggacgcccaccccaacagatactgcgccaccgtgagagtgcagcagcacagacaggagatcatccaggacctggccgccatggtgagagagctgctgatccagttctacaagagcaccagattcaagcccaccagaatcatcttctacagagacggcgtgagcgagggccagttccagcaggtgctgcaccacgagctgctggccatcagagaggcctgcatcaagctggagaaggactaccagcccggcatcaccttcatcgtggtgcagaagagacaccacaccagactgttctgcaccgacaagaacgagagaggcaccagcagacccagccactaccacgtgctgtgggacgacaacagattcagcagcgacgagctgcagatcctgacctaccagctgtgccacacctacgtgagatgcaccagaagcgtgagcatccccgcccccgcctactacgcccacctggtggccttcagagccagataccacctggtggacaaggagcacgacagcgccgagggcagccacaccagcggccagagcaacggcagagaccaccaggccctggccaaggccgtgcaggtgcaccaggacaccctgagaaccatgtacttcgcctag

SEQ ID NO: 80882 - DNA, 1881 bp, Artificial Sequence
  Description of Artificial Sequence: Synthetic coding sequence
atgtgcgaggtgctggacatccacaacatcgacgagcagcccagacccctgaccgacagccacagagtgaagttcaccaaggagatcaagggcctgaaggtggaggtgacccactgcggcaccatgagaagaaagtacagagtgtgcaacgtgaccagaagacccgccagccaccagaccttccccctgcagctggagaacggccagaccgtggagagaaccgtggcccagtacttcagagagaagtacaccctgcagctgaagtacccccacctgccctgcctgcaggtgggccaggagcagaagcacacctacctgcccctggaggtgtgcaacatcgtggccggccagagatgcatcaagaagctgaccgacaaccagaccagcaccatgatcaaggccaccgccagaagcgcccccgacagacaggaggagatcagcagactggtgagaagcgccaactacgagaccgaccccttcgtgcaggagttccagttcaaggtgagagacgagatggcccacgtgaccggcagagtgctgcccgcccccatgctgcagtacggcggcagaaacagaaccgtggccacccccagccacggcgtgtgggacatgagaggcaagcagttccacaccggcgtggagatcaagatgtgggccatcgcctgcttcgccacccagagacagtgcagagaggagatcctgaagggcttcaccgaccagctgagaaagatcagcaaggacgccggcatgcccatccagggccagccctgcttctgcaagtacgcccagggcgccgacagcgtggagcccatgttcagacacctgaagaacacctacagcggcctgcagctgatcatcgtgatcctgcccggcaagacccccgtgtacgccgaggtgaagagagtgggcgacaccctgctgggcatggccacccagtgcgtgcaggtgaagaacgtgatcaagaccagcccccagaccctgagcaacctgtgcctgaagatcaacgtgaagctgggcggcatcaacaacatcctggtgccccaccagagacccagcgtgttccagcagcccgtgatcttcctgggcgccgacgtgacccacccccccgccggcgacggcaagaagcccagcatcgccgccgtggtgggcagcatggacgcccaccccagcagatactgcgccaccgtgagagtgcagagacccagacaggagatcatccaggacctggccagcatggtgagagagctgctgatccagttctacaagagcaccagattcaagcccaccagaatcatcttctacagagacggcgtgagcgagggccagttcagacaggtgctgtactacgagctgctggccatcagagaggcctgcatcagcctggagaaggactaccagcccggcatcacctacatcgtggtgcagaagagacaccacaccagactgttctgcgccgacagaaccgagagagtgggcagaagcggcaacatccccgccggcaccaccgtggacaccgacatcacccacccctacgagttcgacttctacctgtgcagccacgccggcatccagggcaccagcagacccagccactaccacgtgctgtgggacgacaactgcttcaccgccgacgagctgcagctgctgacctaccagctgtgccacacctacgtgagatgcaccagaagcgtgagcatccccgcccccgcctactacgcccacctggtggccttcagagccagataccacctggtggacaaggagcacgacagcgccgagggcagccacgtgagcggccagagcaacggcagagacccccaggccctggccaaggccgtgcagatccaccaggacaccctgagaaccatgtacttcgcctag

SEQ ID NO: 80883 - DNA, 690 bp, Artificial Sequence
  Description of Artificial Sequence: Synthetic coding sequence
atggagatcggcagcgccggccccgccggcgcccagcccctgctgatggtgcccagaagacccggctacggcaccatgggcaagcccatcaagctgctggccaactgcttccaggtggagatccccaagatcgacgtgtacctgtacgaggtggacatcaagcccgacaagtgccccagaagagtgaacagagaggtggtggacagcatggtgcagcacttcaaggtgaccatcttcggcgacagaagacccgtgtacgacggcaagagaagcctgtacaccgccaaccccctgcccgtggccaccaccggcgtggacctggacgtgaccctgcccggcgagggcggcaaggacagacccttcaaggtgagcatcaagttcgtgagcagagtgagctggcacctgctgcacgaggtgctgaccggcagaaccctgcccgagcccctggagctggacaagcccatcagcaccaaccccgtgcacgccgtggacgtggtgctgagacacctgcccagcatgaagtacacccccgtgggcagaagcttcttcagcgcccccgagggctacgaccaccccctgggcggcggcagagaggtgtggttcggcttccaccagagcgtgagacccgccatgtggaagatgatgctgaacatcgacgagagagacctgtggcagcagtgcggcgagtag

SEQ ID NO: 80884 - DNA, 2583 bp, Artificial Sequence
  Description of Artificial Sequence: Synthetic coding sequence
atggagatcggcagcgccggccccgccggcgcccagcccctgctgatggtgcccagaagacccggctacggcaccatgggcaagcccatcaagctgctggccaactgcttccaggtggagatccccaagatcgacgtgtacctgtacgaggtggacatcaagcccgacaagtgccccagaagagtgaacagagaggtggtggacagcatggtgcagcacttcaaggtgaccatcttcggcgacagaagacccgtgtacgacggcaagagaagcctgtacaccgccaaccccctgcccgtggccaccaccggcgtggacctggacgtgaccctgcccggcgagggcggcaaggacagacccttcaaggtgagcatcaagttcgtgagcagagtgagctggcacctgctgcacgaggtgctgaccggcagaaccctgcccgagcccctggagctggacaagcccatcagcaccaaccccgtgcacgccgtggacgtggtgctgagacacctgcccagcatgaagtacacccccgtgggcagaagcttcttcagcgcccccgagggctacgaccaccccctgggcggcggcagagaggtgtggttcggcttccaccagagcgtgagacccgccatgtggaagatgatgctgaacatcgacgtgagcgccaccgccttctacaaggcccagcccgtgatccagttcatgtgcgaggtgctggacatccacaacatcgacgagcagcccagacccctgaccgacagccacagagtgaagttcaccaaggagatcaagggcctgaaggtggaggtgacccactgcggcaccatgagaagaaagtacagagtgtgcaacgtgaccagaagacccgccagccaccagaccttccccctgcagctggagaacggccagaccgtggagagaaccgtggcccagtacttcagagagaagtacaccctgcagctgaagtacccccacctgccctgcctgcaggtgggccaggagcagaagcacacctacctgcccctggaggtgtgcaacatcgtggccggccagagatgcatcaagaagctgaccgacaaccagaccagcaccatgatcaaggccaccgccagaagcgcccccgacagacaggaggagatcagcagactggtgagaagcgccaactacgagaccgaccccttcgtgcaggagttccagttcaaggtgagagacgagatggcccacgtgaccggcagagtgctgcccgcccccatgctgcagtacggcggcagaaacagaaccgtggccacccccagccacggcgtgtgggacatgagaggcaagcagttccacaccggcgtggagatcaagatgtgggccatcgcctgcttcgccacccagagacagtgcagagaggagatcctgaagggcttcaccgaccagctgagaaagatcagcaaggacgccggcatgcccatccagggccagccctgcttctgcaagtacgcccagggcgccgacagcgtggagcccatgttcagacacctgaagaacacctacagcggcctgcagctgatcatcgtgatcctgcccggcaagacccccgtgtacgccgaggtgaagagagtgggcgacaccctgctgggcatggccacccagtgcgtgcaggtgaagaacgtgatcaagaccagcccccagaccctgagcaacctgtgcctgaagatcaacgtgaagctgggcggcatcaacaacatcctggtgccccaccagagacccagcgtgttccagcagcccgtgatcttcctgggcgccgacgtgacccacccccccgccggcgacggcaagaagcccagcatcgccgccgtggtgggcagcatggacgcccaccccagcagatactgcgccaccgtgagagtgcagagacccagacaggagatcatccaggacctggccagcatggtgagagagctgctgatccagttctacaagagcaccagattcaagcccaccagaatcatcttctacagagacggcgtgagcgagggccagttcagacaggtgctgtactacgagctgctggccatcagagaggcctgcatcagcctggagaaggactaccagcccggcatcacctacatcgtggtgcagaagagacaccacaccagactgttctgcgccgacagaaccgagagagtgggcagaagcggcaacatccccgccggcaccaccgtggacaccgacatcacccacccctacgagttcgacttctacctgtgcagccacgccggcatccagggcaccagcagacccagccactaccacgtgctgtgggacgacaactgcttcaccgccgacgagctgcagctgctgacctaccagctgtgccacacctacgtgagatgcaccagaagcgtgagcatccccgcccccgcctactacgcccacctggtggccttcagagccagataccacctggtggacaaggagcacgacagcgccgagggcagccacgtgagcggccagagcaacggcagagacccccaggccctggccaaggccgtgcagatccaccaggacaccctgagaaccatgtacttcgcctag

SEQ ID NO: 80885 - DNA, 690 bp, Artificial Sequence; identical to SEQ ID NO: 80883
  Description of Artificial Sequence: Synthetic coding sequence

SEQ ID NO: 80886 - DNA, 2586 bp, Artificial Sequence
  Description of Artificial Sequence: Synthetic coding sequence
atggaggccctgggccccggcccccccgccagcctgttccagccccccagaagacccggcctgggcaccgtgggcaagcccatcagactgctggccaaccacttccaggtgcagatccccaagatcgacgtgtaccactacgacgtggacatcaagcccgagaagagacccagaagagtgaacagagaggtggtggacaccatggtgagacacttcaagatgcagatcttcggcgacagacagcccggctacgacggcaagagaaacatgtacaccgcccaccccctgcccatcggcagagacagagtggacatggaggtgaccctgcccggcgagggcaaggaccagaccttcaaggtgagcgtgcagtgggtgagcgtggtgagcctgcagctgctgctggaggccctggccggccacctgaacgaggtgcccgacgacagcgtgcaggccctggacgtgatcaccagacacctgcccagcatgagatacacccccgtgggcagaagcttcttcagcccccccgagggctactaccaccccctgggcggcggcagagaggtgtggttcggcttccaccagagcgtgagacccgccatgtggaacatgatgctgaacatcgacgtgagcgccaccgccttctacagagcccagcccatcatcgagttcatgtgcgaggtgctggacatccagaacatcaacgagcagaccaagcccctgaccgacagccagagagtgaagttcaccaaggagatcagaggcctgaaggtggaggtgacccactgcggccagatgaagagaaagtacagagtgtgcaacgtgaccagaagacccgccagccaccagaccttccccctgcagctggagaacggccaggccatggagtgcaccgtggcccagtacttcaagcagaagtacagcctgcagctgaagtacccccacctgccctgcctgcaggtgggccaggagcagaagcacacctacctgcccctggaggtgtgcaacatcgtggccggccagagatgcatcaagaagctgaccgacaaccagaccagcaccatgatcaaggccaccgccagaagcgcccccgacagacaggaggagatcagcagactggtgaagagcaacagcatggtgggcggccccgacccctacctgaaggagttcggcatcgtggtgcacaacgagatgaccgagctgaccggcagagtgctgcccgcccccatgctgcagtacggcggcagaaacaagaccgtggccacccccaaccagggcgtgtgggacatgagaggcaagcagttctacgccggcatcgagatcaaggtgtgggccgtggcctgcttcgccccccagaagcagtgcagagaggacctgctgaagagcttcaccgaccagctgagaaagatcagcaaggacgccggcatgcccatccagggccagccctgcttctgcaagtacgcccagggcgccgacagcgtggagcccatgttcaagcacctgaagatgacctacgtgggcctgcagctgatcgtggtgatcctgcccggcaagacccccgtgtacgccgaggtgaagagagtgggcgacaccctgctgggcatggccacccagtgcgtgcaggtgaagaacgtggtgaagaccagcccccagaccctgagcaacctgtgcctgaagatcaacgccaagctgggcggcatcaacaacgtgctggtgccccaccagagacccagcgtgttccagcagcccgtgatcttcctgggcgccgacgtgacccacccccccgccggcgacggcaagaagcccagcatcgccgccgtggtgggcagcatggacggccaccccagcagatactgcgccaccgtgagagtgcagaccagcagacaggagatcagccaggagctgctgtacagccaggaggtgatccaggacctgaccaacatggtgagagagctgctgatccagttctacaagagcaccagattcaagcccaccagaatcatctactacagaggcggcgtgagcgagggccagatgaagcaggtggcctggcccgagctgatcgccatcagaaaggcctgcatcagcctggaggaggactacagacccggcatcacctacatcgtggtgcagaagagacaccacaccagactgttctgcgccgacaagaccgagagagtgggcaagagcggcaacgtgcccgccggcaccaccgtggacagcaccatcacccaccccagcgagttcgacttctacctgtgcagccacgccggcatccagggcaccagcagacccagccactaccaggtgctgtgggacgacaactgcttcaccgccgacgagctgcagctgctgacctaccagctgtgccacacctacgtgagatgcaccagaagcgtgagcatccccgcccccgcctactacgccagactggtggccttcagagccagataccacctggtggacaaggaccacgacagcgccgagggcagccacgtgagcggccagagcaacggcagagacccccaggccctggccaaggccgtgcagatccaccacgacacccagcacaccatgtacttcgcctag

SEQ ID NO: 80887 - DNA, 1755 bp, Artificial Sequence
  Description of Artificial Sequence: Synthetic coding sequence
atgttcgccaaggccttcagagtgaagagcaacaccgccatcaagggcagcgacagaagaaagctgagagccgacgtgaccaccgccttccccaccctgggcaccgaccaggtgagcgagctggtgcccggcaaggaggagctgaacatcgtgaagctgtacgcccacaagggcgacgccgtgaccgtgtacgtgagcggcggcaaccccatcctgttcgagctggagaagaacctgtaccccaccgtgtacaccctgtggagctaccccgacctgctgcccaccttcaccacctggcccctggtgctggagaagctggtgggcggcgccgacctgatgctgcccggcctggtgatgccccccgccggcctgccccaggtgcagaagggcgacctgtgcgccatcagcctggtgggcaacagagcccccgtggccatcggcgtggccgccatgagcaccgccgagatgctgaccagcggcctgaagggcagaggcttcagcgtgctgcacacctaccaggaccacctgtggagaagcggcaacaagagcagcccccccagcatcgcccccctggccctggacagcgccgacctgagcgaggagaagggcagcgtgcagatggacagcaccctgcagggcgacatgagacacatgaccctggagggcgaggaggagaacggcgaggtgcaccaggccagagaggacaagagcctgagcgaggcccccgaggacaccagcaccagaggcctgaaccaggacagcaccgacagcaagaccctgcaggagcagatggacgagctgctgcagcagtgcttcctgcacgccctgaagtgcagagtgaagaaggccgacctgcccctgctgaccagcaccttcctgggcagccacatgttcagctgctgccccgagggcagacagctggacatcaagaagagcagctacaagaagctgagcaagttcctgcagcagatgcagcaggagcagatcatccaggtgaaggagctgagcaagggcgtggagagcatcgtggccgtggactggaagcaccccagaatcaccagcttcgtgatccccgagcccagccccaccagccagaccatccaggagggcagcagagagcagccctaccacccccccgacatcaagcccctgtactgcgtgcccgccagcatgaccctgctgttccaggagagcggccacaagaagggcagcttcctggagggcagcgaggtgagaaccatcgtgatcaactacgccaagaagaacgacctggtggacgccgacaacaagaacctggtgagactggaccccatcctgtgcgactgcatcctggagaagaacgagcagcacaccgtgatgaagctgccctgggacagcctgctgaccagatgcctggagaagctgcagcccgcctaccaggtgaccctgcccggccaggagcccatcgtgaagaagggcagaatctgccccatcgacatcaccctggcccagagagccagcaacaagaaggtgaccgtggtgagaaacctggaggcctacggcctggacccctacagcgtggccgccatcctgcagcagagatgccaggccagcaccaccgtgaaccccgcccccggcgccaaggacagcctgcaggtgcagatccagggcaaccaggtgcaccacctgggctggctgctgctggaggagtaccagctgcccagaaagcacatccagggcctggagaaggccctgaagcccggcaagaagaagtag

SEQ ID NO: 80888 - DNA, 816 bp, Artificial Sequence
  Description of Artificial Sequence: Synthetic coding sequence
atgttcgccaaggccttcagagtgaagagcaacaccgccatcaagggcagcgacagaagaaagctgagagccgacgtgaccaccgccttccccaccctgggcaccgaccaggtgagcgagctggtgcccggcaaggaggagctgaacatcgtgaagctgtacgcccacaagggcgacgccgtgaccgtgtacgtgagcggcggcaaccccatcctgttcgagctggagaagaacctgtaccccaccgacctgatgctgcccggcctggtgatgccccccgccggcctgccccaggtgcagaagggcgacctgtgcgccatcagcctggtgggcaacagagcccccgtggccatcggcgtggccgccatgagcaccgccgagatgctgaccagcggcctgaagggcagaggcttcagcgtgctgcacacctaccaggaccacctgtggagaagcggcaacaagagcagcccccccagcatcgcccccctggccctggacagcgccgacctgagcgaggagaagggcagcgtgcagatggacagcaccctgcagggcgacatgagacacatgaccctggagggcgaggaggagaacggcgaggtgcaccaggccagagaggacaagagcctgagcgaggcccccgaggacaccagcaccagaggcctgaaccaggacagcaccgacagcaagaccctgcaggagcagatggacgagctgctgcagcagtgcttcctgcacgccctgaagtgcagagtgaagaaggccgacctgcccctgctgaccagcaccttcctgggcagccacatgttcagctag

SEQ ID NO: 80889 - DNA, 1383 bp, Artificial Sequence
  Description of Artificial Sequence: Synthetic coding sequence
atgttcgccaaggccttcagagtgaagagcaacaccgccatcaagggcagcgacagaagaaagctgagagccgacgtgaccaccgccttccccaccctgggcaccgaccaggtgagcgagctggtgcccggcaaggaggagctgaacatcgtgaagctgtacgcccacaagggcgacgccgtgaccgtgtacgtgagcggcggcaaccccatcctgttcgagctggagaagaacctgtaccccaccgtgtacaccctgtggagctaccccgacctgctgcccaccttcaccacctggcccctggtgctggagaagctggtgggcggcgccgacctgatgctgcccggcctggtgatgccccccgccggcctgccccaggtgcagaagggcgacctgtgcgccatcagcctggtgggcaacagagcccccgtggccatcggcgtggccgccatgagcaccgccgagatgctgaccagcggcctgaagggcagaggcttcagcgtgctgcacacctaccaggaccacctgtgccccgagggcagacagctggacatcaagaagagcagctacaagaagctgagcaagttcctgcagcagatgcagcaggagcagatcatccaggtgaaggagctgagcaagggcgtggagagcatcgtggccgtggactggaagcaccccagaatcaccagcttcgtgatccccgagcccagccccaccagccagaccatccaggagggcagcagagagcagccctaccacccccccgacatcaagcccctgtactgcgtgcccgccagcatgaccctgctgttccaggagagcggccacaagaagggcagcttcctggagggcagcgaggtgagaaccatcgtgatcaactacgccaagaagaacgacctggtggacgccgacaacaagaacctggtgagactggaccccatcctgtgcgactgcatcctggagaagaacgagcagcacaccgtgatgaagctgccctgggacagcctgctgaccagatgcctggagaagctgcagcccgcctaccaggtgaccctgcccggccaggagcccatcgtgaagaagggcagaatctgccccatcgacatcaccctggcccagagagccagcaacaagaaggtgaccgtggtgagaaacctggaggcctacggcctggacccctacagcgtggccgccatcctgcagcagagatgccaggccagcaccaccgtgaaccccgcccccggcgccaaggacagcctgcaggtgcagatccagggcaaccaggtgcaccacctgggctggctgctgctggaggagtaccagctgcccagaaagcacatccagggcctggagaaggccctgaagcccggcaagaagaagtag

SEQ ID NO: 80890 - DNA, 816 bp, Artificial Sequence; identical to SEQ ID NO: 80888
  Description of Artificial Sequence: Synthetic coding sequence

SEQ ID NO: 80891 - DNA, 2742 bp, Artificial Sequence
  Description of Artificial Sequence: Synthetic coding sequence
atgagcagattcttcaccaccggcagcgacagcgagagcgagagcagcctgagcggcgaggagctggtgaccaagcccgtgggcggcaactacggcaagcagcccctgctgctgagcgaggacgaggaggacaccaagagagtggtgagaagcgccaaggacaagagattcgaggagctgaccaacctgatcagaaccatcagaaacgccatgaagatcagagacgtgaccaagtgcctggaggagttcgagctgctgggcaaggcctacggcaaggccaagagcatcgtggacaaggagggcgtgcccagattctacatcagaatcctggccgacctggaggactacctgaacgagctgtgggaggacaaggagggcaagaagaagatgaacaagaacaacgccaaggccctgagcaccctgagacagaagatcagaaagtacaacagagacttcgagagccacatcaccagctacaagcagaaccccgagcagagcgccgacgaggacgccgagaagaacgaggaggacagcgagggcagcagcgacgaggacgaggacgaggacggcgtgagcgccgccaccttcctgaagaagaagagcgaggcccccagcggcgagagcagaaagttcctgaagaagatggacgacgaggacgaggacagcgaggacagcgaggacgacgaggactgggacaccggcagcaccagcagcgacagcgacagcgaggaggaggagggcaagcagaccgccctggccagcagattcctgaagaaggcccccaccaccgacgaggacaagaaggccgccgagaagaagagagaggacaaggccaagaagaagcacgacagaaagagcaagagactggacgaggaggaggaggacaacgagggcggcgagtgggagagagtgagaggcggcgtgcccctggtgaaggagaagcccaagatgttcgccaagggcaccgagatcacccacgccgtggtgatcaagaagctgaacgagatcctgcaggccagaggcaagaagggcaccgacagagccgcccagatcgagctgctgcagctgctggtgcagatcgccgccgagaacaacctgggcgagggcgtgatcgtgaagatcaagttcaacatcatcgccagcctgtacgactacaaccccaacctggccacctacatgaagcccgagatgtggggcaagtgcctggactgcatcaacgagctgatggacatcctgttcgccaaccccaacatcttcgtgggcgagaacatcctggaggagagcgagaacctgcacaacgccgaccagcccctgagagtgagaggctgcatcctgaccctggtggagagaatggacgaggagttcaccaagatcatgcagaacaccgacccccacagccaggagtacgtggagcacctgaaggacgaggcccaggtgtgcgccatcatcgagagagtgcagagatacctggaggagaagggcaccaccgaggaggtgtgcagaatctacctgctgagaatcctgcacacctactacaagttcgactacaaggcccaccagagacagctgaccccccccgagggcagcagcaagagcgagcaggaccaggccgagaacgagggcgaggacagcgccgtgctgatggagagactgtgcaagtacatctacgccaaggacagaaccgacagaatcagaacctgcgccatcctgtgccacatctaccaccacgccctgcacagcagatggtaccaggccagagacctgatgctgatgagccacctgcaggacaacatccagcacgccgacccccccgtgcagatcctgtacaacagaaccatggtgcagctgggcatctgcgccttcagacagggcctgaccaaggacgcccacaacgccctgctggacatccagagcagcggcagagccaaggagctgctgggccagggcctgctgctgagaagcctgcaggagagaaaccaggagcaggagaaggtggagagaagaagacaggtgcccttccacctgcacatcaacctggagctgctggagtgcgtgtacctggtgagcgccatgctgctggagatcccctacatggccgcccacgagagcgacgccagaagaagaatgatcagcaagcagttccaccaccagctgagagtgggcgagagacagcccctgctgggcccccccgagagcatgagagagcacgtggtggccgccagcaaggccatgaagatgggcgactggaagacctgccacagcttcatcatcaacgagaagatgaacggcaaggtgtgggacctgttccccgaggccgacaaggtgagaaccatgctggtgagaaagatccaggaggagagcctgagaacctacctgttcacctacagcagcgtgtacgacagcatcagcatggagaccctgagcgacatgttcgagctggacctgcccaccgtgcacagcatcatcagcaagatgatcatcaacgaggagctgatggccagcctggaccagcccacccagaccgtggtgatgcacagaaccgagcccaccgcccagcagaacctggccctgcagctggccgagaagctgggcagcctggtggagaacaacgagagagtgttcgaccacaagcagggcacctacggcggctacttcagagaccagaaggacggctacagaaagaacgagggctacatgagaagaggcggctacagacagcagcagagccagaccgcctactag

SEQ ID NO: 80892 - DNA, 4149 bp, Artificial Sequence
  Description of Artificial Sequence: Synthetic coding sequence
atgcccgcctacttccagagacccgagaacgccctgaagagagccaacgagttcctggaggtgggcaagaagcagcccgccctggacgtgctgtacgacgtgatgaagagcaagaagcacagaacctggcagaagatccacgagcccatcatgctgaagtacctggagctgtgcgtggacctgagaaagagccacctggccaaggagggcctgtaccagtacaagaacatctgccagcaggtgaacatcaagagcctggaggacgtggtgagagcctacctgaagatggccgaggagaagaccgaggccgccaaggaggagagccagcagatggtgctggacatcgaggacctggacaacatccagacccccgagagcgtgctgctgagcgccgtgagcggcgaggacacccaggacagaaccgacagactgctgctgaccccctgggtgaagttcctgtgggagagctacagacagtgcctggacctgctgagaaacaacagcagagtggagagactgtaccacgacatcgcccagcaggccttcaagttctgcctgcagtacaccagaaaggccgagttcagaaagctgtgcgacaacctgagaatgcacctgagccagatccagagacaccacaaccagagcaccgccatcaacctgaacaaccccgagagccagagcatgcacctggagaccagactggtgcagctggacagcgccatcagcatggagctgtggcaggaggccttcaaggccgtggaggacatccacggcctgttcagcctgagcaagaagccccccaagccccagctgatggccaactactacaacaaggtgagcaccgtgttctggaagagcggcaacgccctgttccacgccagcaccctgcacagactgtaccacctgagcagagagatgagaaagaacctgacccaggacgagatgcagagaatgagcaccagagtgctgctggccaccctgagcatccccatcacccccgagagaaccgacatcgccagactgctggacatggacggcatcatcgtggagaagcagagaagactggccaccctgctgggcctgcaggccccccccaccagaatcggcctgatcaacgacatggtgagattcaacgtgctgcagtacgtggtgcccgaggtgaaggacctgtacaactggctggaggtggagttcaaccccctgaagctgtgcgagagagtgaccaaggtgctgaactgggtgagagagcagcccgagaaggagcccgagctgcagcagtacgtgccccagctgcagaacaacaccatcctgagactgctgcagcaggtgagccagatctaccagagcatcgagttcagcagactgaccagcctggtgcccttcgtggacgccttccagctggagagagccatcgtggacgccgccagacactgcgacctgcaggtgagaatcgaccacaccagcagaaccctgagcttcggcagcgacctgaactacgccaccagagaggacgcccccatcggcccccacctgcagagcatgcccagcgagcagatcagaaaccagctgaccgccatgagcagcgtgctggccaaggccctggaggtgatcaagcccgcccacatcctgcaggagaaggaggagcagcaccagctggccgtgaccgcctacctgaagaacagcagaaaggagcaccagagaatcctggccagaagacagaccatcgaggagagaaaggagagactggagagcctgaacatccagagagagaaggaggagctggagcagagagaggccgagctgcagaaggtgagaaaggccgaggaggagagactgagacaggaggccaaggagagagagaaggagagaatcctgcaggagcacgagcagatcaagaagaagaccgtgagagagagactggagcagatcaagaagaccgagctgggcgccaaggccttcaaggacatcgacatcgaggacctggaggagctggaccccgacttcatcatggccaagcaggtggagcagctggagaaggagaagaaggagctgcaggagagactgaagaaccaggagaagaagatcgactacttcgagagagccaagagactggaggagatccccctgatcaagagcgcctacgaggagcagagaatcaaggacatggacctgtgggagcagcaggaggaggagagaatcaccaccatgcagctggagagagagaaggccctggagcacaagaacagaatgagcagaatgctggaggacagagacctgttcgtgatgagactgaaggccgccagacagagcgtgtacgaggagaagctgaagcagttcgaggagagactggccgaggagagacacaacagactggaggagagaaagagacagagaaaggaggagagaagaatcacctactacagagagaaggaggaggaggagcagagaagagccgaggagcagatgctgaaggagagagaggagagagagagagccgagagagccaagagagaggaggagctgagagagtaccaggagagagtgaagaagctggaggaggtggagagaaagaagagacagagagagctggagatcgaggagagagagagaagaagagaggaggagagaagactgggcgacagcagcctgagcagaaaggacagcagatggggcgacagagacagcgagggcacctggagaaagggccccgaggccgacagcgagtggagaagaggcccccccgagaaggagtggagaagaggcgagggcagagacgaggacagaagccacagaagagacgaggagagacccagaagactgggcgacgacgaggacagagagcccagcctgagacccgacgacgacagagtgcccagaagaggcatggacgacgacagaggccccagaagaggccccgaggaggacagattcagcagaagaggcgccgacgacgacagacccagctggagaaacaccgacgacgacagaccccccagaagaatcgccgacgaggacagaggcaactggagacacgccgacgacgacagaccccccagaagaggcctggacgaggacagaggcagctggagaaccgccgacgaggacagaggccccagaagaggcatggacgacgacagaggccccagaagaggcggcgccgacgacgagagaagcagctggagaaacgccgacgacgacagaggccccagaagaggcctggacgacgacagaggccccagaagaggcatggacgacgacagaggccccagaagaggcatggacgacgacagaggccccagaagaggcatggacgacgacagaggccccagaagaggcctggacgacgacagaggcccctggagaaacgccgacgacgacagaatccccagaagaggcgccgaggacgacagaggcccctggagaaacatggacgacgacagactgagcagaagagccgacgacgacagattccccagaagaggcgacgacagcagacccggcccctggagacccctggtgaagcccggcggctggagagagaaggagaaggccagagaggagagctggggcccccccagagagagcagacccagcgaggagagagagtgggacagagagaaggagagagacagagacaaccaggacagagaggagaacgacaaggaccccgagagagagagagacagagagagagacgtggacagagaggacagattcagaagacccagagacgagggcggctggagaagaggccccgccgaggagagcagcagctggagagacagcagcagaagagacgacagagacagagacgacagaagaagagagagagacgacagaagagacctgagagagagaagagacctgagagacgacagagacagaagaggcccccccctgagaagcgagagagaggaggtgagcagctggagaagagccgacgacagaaaggacgacagagtggaggagagagacccccccagaagagtgcccccccccgccctgagcagagacagagagagagacagagacagagagagagagggcgagaaggagaaggccagctggagagccgagaaggacagagagagcctgagaagaaccaagaacgagaccgacgaggacggctggaccaccgtgagaagatag

SEQ ID NO: 80893 - DNA, 4047 bp, Artificial Sequence
  Description of Artificial Sequence: Synthetic coding sequence
atgaagagcaagaagcacagaacctggcagaagatccacgagcccatcatgctgaagtacctggagctgtgcgtggacctgagaaagagccacctggccaaggagggcctgtaccagtacaagaacatctgccagcaggtgaacatcaagagcctggaggacgtggtgagagcctacctgaagatggccgaggagaagaccgaggccgccaaggaggagagccagcagatggtgctggacatcgaggacctggacaacatccagacccccgagagcgtgctgctgagcgccgtgagcggcgaggacacccaggacagaaccgacagactgctgctgaccccctgggtgaagttcctgtgggagagctacagacagtgcctggacctgctgagaaacaacagcagagtggagagactgtaccacgacatcgcccagcaggccttcaagttctgcctgcagtacaccagaaaggccgagttcagaaagctgtgcgacaacctgagaatgcacctgagccagatccagagacaccacaaccagagcaccgccatcaacctgaacaaccccgagagccagagcatgcacctggagaccagactggtgcagctggacagcgccatcagcatggagctgtggcaggaggccttcaaggccgtggaggacatccacggcctgttcagcctgagcaagaagccccccaagccccagctgatggccaactactacaacaaggtgagcaccgtgttctggaagagcggcaacgccctgttccacgccagcaccctgcacagactgtaccacctgagcagagagatgagaaagaacctgacccaggacgagatgcagagaatgagcaccagagtgctgctggccaccctgagcatccccatcacccccgagagaaccgacatcgccagactgctggacatggacggcatcatcgtggagaagcagagaagactggccaccctgctgggcctgcaggccccccccaccagaatcggcctgatcaacgacatggtgagattcaacgtgctgcagtacgtggtgcccgaggtgaaggacctgtacaactggctggaggtggagttcaaccccctgaagctgtgcgagagagtgaccaaggtgctgaactgggtgagagagcagcccgagaaggagcccgagctgcagcagtacgtgccccagctgcagaacaacaccatcctgagactgctgcagcaggtgagccagatctaccagagcatcgagttcagcagactgaccagcctggtgcccttcgtggacgccttccagctggagagagccatcgtggacgccgccagacactgcgacctgcaggtgagaatcgaccacaccagcagaaccctgagcttcggcagcgacctgaactacgccaccagagaggacgcccccatcggcccccacctgcagagcatgcccagcgagcagatcagaaaccagctgaccgccatgagcagcgtgctggccaaggccctggaggtgatcaagcccgcccacatcctgcaggagaaggaggagcagcaccagctggccgtgaccgcctacctgaagaacagcagaaaggagcaccagagaatcctggccagaagacagaccatcgaggagagaaaggagagactggagagcctgaacatccagagagagaaggaggagctggagcagagagaggccgagctgcagaaggtgagaaaggccgaggaggagagactgagacaggaggccaaggagagagagaaggagagaatcctgcaggagcacgagcagatcaagaagaagaccgtgagagagagactggagcagatcaagaagaccgagctgggcgccaaggccttcaaggacatcgacatcgaggacctggaggagctggaccccgacttcatcatggccaagcaggtggagcagctggagaaggagaagaaggagctgcaggagagactgaagaaccaggagaagaagatcgactacttcgagagagccaagagactggaggagatccccctgatcaagagcgcctacgaggagcagagaatcaaggacatggacctgtgggagcagcaggaggaggagagaatcaccaccatgcagctggagagagagaaggccctggagcacaagaacagaatgagcagaatgctggaggacagagacctgttcgtgatgagactgaaggccgccagacagagcgtgtacgaggagaagctgaagcagttcgaggagagactggccgaggagagacacaacagactggaggagagaaagagacagagaaaggaggagagaagaatcacctactacagagagaaggaggaggaggagcagagaagagccgaggagcagatgctgaaggagagagaggagagagagagagccgagagagccaagagagaggaggagctgagagagtaccaggagagagtgaagaagctggaggaggtggagagaaagaagagacagagagagctggagatcgaggagagagagagaagaagagaggaggagagaagactgggcgacagcagcctgagcagaaaggacagcagatggggcgacagagacagcgagggcacctggagaaagggccccgaggccgacagcgagtggagaagaggcccccccgagaaggagtggagaagaggcgagggcagagacgaggacagaagccacagaagagacgaggagagacccagaagactgggcgacgacgaggacagagagcccagcctgagacccgacgacgacagagtgcccagaagaggcatggacgacgacagaggccccagaagaggccccgaggaggacagattcagcagaagaggcgccgacgacgacagacccagctggagaaacaccgacgacgacagaccccccagaagaatcgccgacgaggacagaggcaactggagacacgccgacgacgacagaccccccagaagaggcctggacgaggacagaggcagctggagaaccgccgacgaggacagaggccccagaagaggcatggacgacgacagaggccccagaagaggcggcgccgacgacgagagaagcagctggagaaacgccgacgacgacagaggccccagaagaggcctggacgacgacagaggccccagaagaggcatggacgacgacagaggccccagaagaggcatggacgacgacagaggccccagaagaggcatggacgacgacagaggccccagaagaggcctggacgacgacagaggcccctggagaaacgccgacgacgacagaatccccagaagaggcgccgaggacgacagaggcccctggagaaacatggacgacgacagactgagcagaagagccgacgacgacagattccccagaagaggcgacgacagcagacccggcccctggagacccctggtgaagcccggcggctggagagagaaggagaaggccagagaggagagctggggcccccccagagagagcagacccagcgaggagagagagtgggacagagagaaggagagagacagagacaaccaggacagagaggagaacgacaaggaccccgagagagagagagacagagagagagacgtggacagagaggacagattcagaagacccagagacgagggcggctggagaagaggccccgccgaggagagcagcagctggagagacagcagcagaagagacgacagagacagagacgacagaagaagagagagagacgacagaagagacctgagagagagaagagacctgagagacgacagagacagaagaggcccccccctgagaagcgagagagaggaggtgagcagctggagaagagccgacgacagaaaggacgacagagtggaggagagagacccccccagaagagtgcccccccccgccctgagcagagacagagagagagacagagacagagagagagagggcgagaaggagaaggccagctggagagccgagaaggacagagagagcctgagaagaaccaagaacgagaccgacgaggacggctggaccaccgtgagaagatag

SEQ ID NO: 80894 - DNA, 2619 bp, Artificial Sequence
  Description of Artificial Sequence: Synthetic coding sequence
atgcaggacgccgagaacgtggccgtgcccgaggccgccgaggagagagccgagcccggccagcagcagcccgccgccgagcccccccccgccgagggcctgctgagacccgccggccccggcgcccccgaggccgccggcaccgaggccagcagcgaggaggtgggcatcgccgaggccggccccgagagcgaggtgagaaccgagcccgccgccgaggccgaggccgccagcggccccagcgagagccccagcccccccgccgccgaggagctgcccggcagccacgccgagccccccgtgcccgcccagggcgaggcccccggcgagcaggccagagacgagagaagcgacagcagagcccaggccgtgagcgaggacgccggcggcaacgagggcagagccgccgaggccgagcccagagccctggagaacggcgacgccgacgagcccagcttcagcgaccccgaggacttcgtggacgacgtgagcgaggaggagctgctgggcgacgtgctgaaggacagaccccaggaggccgacggcatcgacagcgtgatcgtggtggacaacgtgccccaggtgggccccgacagactggagaagctgaagaacgtgatccacaagatcttcagcaagttcggcaagatcaccaacgacttctaccccgaggaggacggcaagaccaagggctacatcttcctggagtacgccagccccgcccacgccgtggacgccgtgaagaacgccgacggctacaagctggacaagcagcacaccttcagagtgaacctgttcaccgacttcgacaagtacatgaccatcagcgacgagtgggacatccccgagaagcagcccttcaaggacctgggcaacctgagatactggctggaggaggccgagtgcagagaccagtacagcgtgatcttcgagagcggcgacagaaccagcatcttctggaacgacgtgaaggaccccgtgagcatcgaggagagagccagatggaccgagacctacgtgagatggagccccaagggcacctacctggccaccttccaccagagaggcatcgccctgtggggcggcgagaagttcaagcagatccagagattcagccaccagggcgtgcagctgatcgacttcagcccctgcgagagatacctggtgaccttcagccccctgatggacacccaggacgacccccaggccatcatcatctgggacatcctgaccggccacaagaagagaggcttccactgcgagagcagcgcccactggcccatcttcaagtggagccacgacggcaagttcttcgccagaatgaccctggacaccctgagcatctacgagacccccagcatgggcctgctggacaagaagagcctgaagatcagcggcatcaaggacttcagctggagccccggcggcaacatcatcgccttctgggtgcccgaggacaaggacatccccgccagagtgaccctgatgcagctgcccaccagacaggagatcagagtgagaaacctgttcaacgtggtggactgcaagctgcactggcagaagaacggcgactacctgtgcgtgaaggtggacagaacccccaagggcacccagggcgtggtgaccaacttcgagatcttcagaatgagagagaagcaggtgcccgtggacgtggtggagatgaaggagaccatcatcgccttcgcctgggagcccaacggcagcaagttcgccgtgctgcacggcgaggcccccagaatcagcgtgagcttctaccacgtgaagaacaacggcaagatcgagctgatcaagatgttcgacaagcagcaggccaacaccatcttctggagcccccagggccagttcgtggtgctggccggcctgagaagcatgaacggcgccctggccttcgtggacaccagcgactgcaccgtgatgaacatcgccgagcactacatggccagcgacgtggagtgggaccccaccggcagatacgtggtgaccagcgtgagctggtggagccacaaggtggacaacgcctactggctgtggaccttccagggcagactgctgcagaagaacaacaaggacagattctgccagctgctgtggagacccagaccccccaccctgctgagccaggagcagatcaagcagatcaagaaggacctgaagaagtacagcaagatcttcgagcagaaggacagactgagccagagcaaggccagcaaggagctggtggagagaagaagaaccatgatggaggacttcagaaagtacagaaagatggcccaggagctgtacatggagcagaagaacgagagactggagctgagaggcggcgtggacaccgacgagctggacagcaacgtggacgactgggaggaggagaccatcgagttcttcgtgaccgaggagatcatccccggcatcagaagcgacctggagcactgcgcccagccctgcgtgctgtggagcagaggcagacccgccggcagcagagtgacccccgccagcagcctgtgcagcctggccctggactgcgactgcgcctggatcctgcccctgagacacatcttcgtgcccttcagcccctggtgcctgcagtggggcatctag

SEQ ID NO: 80895 - DNA, 2445 bp, Artificial Sequence
  Description of Artificial Sequence: Synthetic coding sequence
atgcaggacgccgagaacgtggccgtgcccgaggccgccgaggagagagccgagcccggccagcagcagcccgccgccgagcccccccccgccgagggcctgctgagacccgccggccccggcgcccccgaggccgccggcaccgaggccagcagcgaggaggtgggcatcgccgaggccggccccgagagcgaggtgagaaccgagcccgccgccgaggccgaggccgccagcggccccagcgagagccccagcccccccgccgccgaggagctgcccggcagccacgccgagccccccgtgcccgcccagggcgaggcccccggcgagcaggccagagacgagagaagcgacagcagagcccaggccgtgagcgaggacgccggcggcaacgagggcagagccgccgaggccgagcccagagccctggagaacggcgacgccgacgagcccagcttcagcgaccccgaggacttcgtggacgacgtgagcgaggaggagctgctgggcgacgtgctgaaggacagaccccaggaggccgacggcatcgacagcgtgatcgtggtggacaacgtgccccaggtgggccccgacagactggagaagctgaagaacgtgatccacaagatcttcagcaagttcggcaagatcaccaacgacttctaccccgaggaggacggcaagaccaagggctacatcttcctggagtacgccagccccgcccacgccgtggacgccgtgaagaacgccgacggctacaagctggacaagcagcacaccttcagagtgaacctgttcaccgacttcgacaagtacatgaccatcagcgacgagtgggacatccccgagaagcagcccttcaaggacctgggcaacctgagatactggctggaggaggccgagtgcagagaccagtacagcgtgatcttcgagagcggcgacagaaccagcatcttctggaacgacgtgaaggaccccgtgagcatcgaggagagagccagatggaccgagacctacgtgagatggagccccaagggcacctacctggccaccttccaccagagaggcatcgccctgtggggcggcgagaagttcaagcagatccagagattcagccaccagggcgtgcagctgatcgacttcagcccctgcgagagatacctggtgaccttcagccccctgatggacacccaggacgacccccaggccatcatcatctgggacatcctgaccggccacaagaagagaggcttccactgcgagagcagcgcccactggcccatcttcaagtggagccacgacggcaagttcttcgccagaatgaccctggacaccctgagcatctacgagacccccagcatgggcctgctggacaagaagagcctgaagatcagcggcatcaaggacttcagctggagccccggcggcaacatcatcgccttctgggtgcccgaggacaaggacatccccgccagagtgaccctgatgcagctgcccaccagacaggagatcagagtgagaaacctgttcaacgtggtggactgcaagctgcactggcagaagaacggcgactacctgtgcgtgaaggtggacagaacccccaagggcacccagggcgtggtgaccaacttcgagatcttcagaatgagagagaagcaggtgcccgtggacgtggtggagatgaaggagaccatcatcgccttcgcctgggagcccaacggcagcaagttcgccgtgctgcacggcgaggcccccagaatcagcgtgagcttctaccacgtgaagaacaacggcaagatcgagctgatcaagatgttcgacaagcagcaggccaacaccatcttctggagcccccagggccagttcgtggtgctggccggcctgagaagcatgaacggcgccctggccttcgtggacaccagcgactgcaccgtgatgaacatcgccgagcactacatggccagcgacgtggagtgggaccccaccggcagatacgtggtgaccagcgtgagctggtggagccacaaggtggacaacgcctactggctgtggaccttccagggcagactgctgcagaagaacaacaaggacagattctgccagctgctgtggagacccagaccccccaccctgctgagccaggagcagatcaagcagatcaagaaggacctgaagaagtacagcaagatcttcgagcagaaggacagactgagccagagcaaggccagcaaggagctggtggagagaagaagaaccatgatggaggacttcagaaagtacagaaagatggcccaggagctgtacatggagcagaagaacgagagactggagctgagaggcggcgtggacaccgacgagctggacagcaacgtggacgactgggaggaggagaccatcgagttcttcgtgaccgaggagatcatccccctgggcaaccaggagtag

SEQ ID NO: 80896 - DNA, 2445 bp, Artificial Sequence; identical to SEQ ID NO: 80895
  Description of Artificial Sequence: Synthetic coding sequence

SEQ ID NO: 80897 - DNA, 2217 bp, Artificial Sequence
  Description of Artificial Sequence: Synthetic coding sequence
atgcaggacgccgagaacgtggccgtgcccgaggccgccgaggagagagccggcagccacgccgagccccccgtgcccgcccagggcgaggcccccggcgagcaggccagagacgagagaagcgacagcagagcccaggccgtgagcgaggacgccggcggcaacgagggcagagccgccgaggccgagcccagagccctggagaacggcgacgccgacgagcccagcttcagcgaccccgaggacttcgtggacgacgtgagcgaggaggagctgctgggcgacgtgctgaaggacagaccccaggaggccgacggcatcgacagcgtgatcgtggtggacaacgtgccccaggtgggccccgacagactggagaagctgaagaacgtgatccacaagatcttcagcaagttcggcaagatcaccaacgacttctaccccgaggaggacggcaagaccaagggctacatcttcctggagtacgccagccccgcccacgccgtggacgccgtgaagaacgccgacggctacaagctggacaagcagcacaccttcagagtgaacctgttcaccgacttcgacaagtacatgaccatcagcgacgagtgggacatccccgagaagcagcccttcaaggacctgggcaacctgagatactggctggaggaggccgagtgcagagaccagtacagcgtgatcttcgagagcggcgacagaaccagcatcttctggaacgacgtgaaggaccccgtgagcatcgaggagagagccagatggaccgagacctacgtgagatggagccccaagggcacctacctggccaccttccaccagagaggcatcgccctgtggggcggcgagaagttcaagcagatccagagattcagccaccagggcgtgcagctgatcgacttcagcccctgcgagagatacctggtgaccttcagccccctgatggacacccaggacgacccccaggccatcatcatctgggacatcctgaccggccacaagaagagaggcttccactgcgagagcagcgcccactggcccatcttcaagtggagccacgacggcaagttcttcgccagaatgaccctggacaccctgagcatctacgagacccccagcatgggcctgctggacaagaagagcctgaagatcagcggcatcaaggacttcagctggagccccggcggcaacatcatcgccttctgggtgcccgaggacaaggacatccccgccagagtgaccctgatgcagctgcccaccagacaggagatcagagtgagaaacctgttcaacgtggtggactgcaagctgcactggcagaagaacggcgactacctgtgcgtgaaggtggacagaacccccaagggcacccagggcgtggtgaccaacttcgagatcttcagaatgagagagaagcaggtgcccgtggacgtggtggagatgaaggagaccatcatcgccttcgcctgggagcccaacggcagcaagttcgccgtgctgcacggcgaggcccccagaatcagcgtgagcttctaccacgtgaagaacaacggcaagatcgagctgatcaagatgttcgacaagcagcaggccaacaccatcttctggagcccccagggccagttcgtggtgctggccggcctgagaagcatgaacggcgccctggccttcgtggacaccagcgactgcaccgtgatgaacatcgccgagcactacatggccagcgacgtggagtgggaccccaccggcagatacgtggtgaccagcgtgagctggtggagccacaaggtggacaacgcctactggctgtggaccttccagggcagactgctgcagaagaacaacaaggacagattctgccagctgctgtggagacccagaccccccaccctgctgagccaggagcagatcaagcagatcaagaaggacctgaagaagtacagcaagatcttcgagcagaaggacagactgagccagagcaaggccagcaaggagctggtggagagaagaagaaccatgatggaggacttcagaaagtacagaaagatggcccaggagctgtacatggagcagaagaacgagagactggagctgagaggcggcgtggacaccgacgagctggacagcaacgtggacgactgggaggaggagaccatcgagttcttcgtgaccgaggagatcatccccctgggcaaccaggagtag

SEQ ID NO: 80898 - DNA, 2742 bp, Artificial Sequence; identical to SEQ ID NO: 80891
  Description of Artificial Sequence: Synthetic coding sequence

SEQ ID NO: 80899 - DNA, 2286 bp, Artificial Sequence
  Description of Artificial Sequence: Synthetic coding sequence
atgagcagattcttcaccaccggcagcgacagcgagagcgagagcagcctgagcggcgaggagctggtgaccaagcccgtgggcggcaactacggcaagcagcccctgctgctgagcgaggacgaggaggacaccaagagagtggtgagaagcgccaaggacaagagattcgaggagctgaccaacctgatcagaaccatcagaaacgccatgaagatcagagacgtgaccaagtgcctggaggagttcgagctgctgggcaaggcctacggcaaggccaagagcatcgtggacaaggagggcgtgcccagattctacatcagaatcctggccgacctggaggactacctgaacgagctgtgggaggacaaggagggcaagaagaagcacgacagaaagagcaagagactggacgaggaggaggaggacaacgagggcggcgagtgggagagagtgagaggcggcgtgcccctggtgaaggagaagcccaagatgttcgccaagggcaccgagatcacccacgccgtggtgatcaagaagctgaacgagatcctgcaggccagaggcaagaagggcaccgacagagccgcccagatcgagctgctgcagctgctggtgcagatcgccgccgagaacaacctgggcgagggcgtgatcgtgaagatcaagttcaacatcatcgccagcctgtacgactacaaccccaacctggccacctacatgaagcccgagatgtggggcaagtgcctggactgcatcaacgagctgatggacatcctgttcgccaaccccaacatcttcgtgggcgagaacatcctggaggagagcgagaacctgcacaacgccgaccagcccctgagagtgagaggctgcatcctgaccctggtggagagaatggacgaggagttcaccaagatcatgcagaacaccgacccccacagccaggagtacgtggagcacctgaaggacgaggcccaggtgtgcgccatcatcgagagagtgcagagatacctggaggagaagggcaccaccgaggaggtgtgcagaatctacctgctgagaatcctgcacacctactacaagttcgactacaaggcccaccagagacagctgaccccccccgagggcagcagcaagagcgagcaggaccaggccgagaacgagggcgaggacagcgccgtgctgatggagagactgtgcaagtacatctacgccaaggacagaaccgacagaatcagaacctgcgccatcctgtgccacatctaccaccacgccctgcacagcagatggtaccaggccagagacctgatgctgatgagccacctgcaggacaacatccagcacgccgacccccccgtgcagatcctgtacaacagaaccatggtgcagctgggcatctgcgccttcagacagggcctgaccaaggacgcccacaacgccctgctggacatccagagcagcggcagagccaaggagctgctgggccagggcctgctgctgagaagcctgcaggagagaaaccaggagcaggagaaggtggagagaagaagacaggtgcccttccacctgcacatcaacctggagctgctggagtgcgtgtacctggtgagcgccatgctgctggagatcccctacatggccgcccacgagagcgacgccagaagaagaatgatcagcaagcagttccaccaccagctgagagtgggcgagagacagcccctgctgggcccccccgagagcatgagagagcacgtggtggccgccagcaaggccatgaagatgggcgactggaagacctgccacagcttcatcatcaacgagaagatgaacggcaaggtgtgggacctgttccccgaggccgacaaggtgagaaccatgctggtgagaaagatccaggaggagagcctgagaacctacctgttcacctacagcagcgtgtacgacagcatcagcatggagaccctgagcgacatgttcgagctggacctgcccaccgtgcacagcatcatcagcaagatgatcatcaacgaggagctgatggccagcctggaccagcccacccagaccgtggtgatgcacagaaccgagcccaccgcccagcagaacctggccctgcagctggccgagaagctgggcagcctggtggagaacaacgagagagtgttcgaccacaagcagggcacctacggcggctacttcagagaccagaaggacggctacagaaagaacgagggctacatgagaagaggcggctacagacagcagcagagccagaccgcctactag

SEQ ID NO: 80900 - DNA, 2742 bp, Artificial Sequence; identical to SEQ ID NO: 80891
  Description of Artificial Sequence: Synthetic coding sequence

SEQ ID NO: 80901 - DNA, 2208 bp, Artificial Sequence
  Description of Artificial Sequence: Synthetic coding sequence
atgagcagattcttcaccaccggcagcgacagcgagagcgagagcagcctgagcggcgaggagctggtgaccaagcccgtgggcggcaactacggcaagcagcccctgctgctgagcgaggacgaggaggacaccaagagagtggtgagaagcgccaaggacaagagattcgaggagctgaccaacctgatcagaaccatcagaaacgccatgaagatcagagacgtgaccaagtgcctggaggagttcgagctgctgggcaaggcctacggcaaggccaagagcatcgtggacaaggccaagaagaagcacgacagaaagagcaagagactggacgaggaggaggaggacaacgagggcggcgagtgggagagagtgagaggcggcgtgcccctggtgaaggagaagcccaagatgttcgccaagggcaccgagatcacccacgccgtggtgatcaagaagctgaacgagatcctgcaggccagaggcaagaagggcaccgacagagccgcccagatcgagctgctgcagctgctggtgcagatcgccgccgagaacaacctgggcgagggcgtgatcgtgaagatcaagttcaacatcatcgccagcctgtacgactacaaccccaacctggccacctacatgaagcccgagatgtggggcaagtgcctggactgcatcaacgagctgatggacatcctgttcgccaaccccaacatcttcgtgggcgagaacatcctggaggagagcgagaacctgcacaacgccgaccagcccctgagagtgagaggctgcatcctgaccctggtggagagaatggacgaggagttcaccaagatcatgcagaacaccgacccccacagccaggagtacgtggagcacctgaaggacgaggcccaggtgtgcgccatcatcgagagagtgcagagatacctggaggagaagggcaccaccgaggaggtgtgcagaatctacctgctgagaatcctgcacacctactacaagttcgactacaaggcccaccagagacagctgaccccccccgagggcagcagcaagagcgagcaggaccaggccgagaacgagggcgaggacagcgccgtgctgatggagagactgtgcaagtacatctacgccaaggacagaaccgacagaatcagaacctgcgccatcctgtgccacatctaccaccacgccctgcacagcagatggtaccaggccagagacctgatgctgatgagccacctgcaggacaacatccagcacgccgacccccccgtgcagatcctgtacaacagaaccatggtgcagctgggcatctgcgccttcagacagggcctgaccaaggacgcccacaacgccctgctggacatccagagcagcggcagagccaaggagctgctgggccagggcctgctgctgagaagcctgcaggagagaaaccaggagcaggagaaggtggagagaagaagacaggtgcccttccacctgcacatcaacctggagctgctggagtgcgtgtacctggtgagcgccatgctgctggagatcccctacatggccgcccacgagagcgacgccagaagaagaatgatcagcaagcagttccaccaccagctgagagtgggcgagagacagcccctgctgggcccccccgagagcatgagagagcacgtggtggccgccagcaaggccatgaagatgggcgactggaagacctgccacagcttcatcatcaacgagaagatgaacggcaaggtgtgggacctgttccccgaggccgacaaggtgagaaccatgctggtgagaaagatccaggaggagagcctgagaacctacctgttcacctacagcagcgtgtacgacagcatcagcatggagaccctgagcgacatgttcgagctggacctgcccaccgtgcacagcatcatcagcaagatgatcatcaacgaggagctgatggccagcctggaccagcccacccagaccgtggtgatgcacagaaccgagcccaccgcccagcagaacctggccctgcagctggccgagaagctgggcagcctggtggagaacaacgagagagtgttcgaccacaagcagggcacctacggcggctacttcagagaccagaaggacggctacagaaagaacgagggctacatgagaagaggcggctacagacagcagcagagccagaccgcctactag

SEQ ID NO: 80902 - DNA, 2697 bp, Artificial Sequence
  Description of Artificial Sequence: Synthetic coding sequence
atgagcagattcttcaccaccggcagcgacagcgagagcgagagcagcctgagcggcgaggagctggtgaccaagcccgtgggcggcaactacggcaagcagcccctgctgctgagcgaggacgaggaggacaccaagagagtggtgagaagcgccaaggacaagagattcgaggagctgaccaacctgatcagaaccatcagaaacgccatgaagatcagagacgtgaccaagtgcctggaggagttcgagctgctgggcaaggcctacggcaaggccaagagcatcgtggacaaggagggcgtgcccagattctacatcagaatcctggccgacctggaggactacctgaacgagctgtgggaggacaaggagggcaagaagaagatcagaaagtacaacagagacttcgagagccacatcaccagctacaagcagaaccccgagcagagcgccgacgaggacgccgagaagaacgaggaggacagcgagggcagcagcgacgaggacgaggacgaggacggcgtgagcgccgccaccttcctgaagaagaagagcgaggcccccagcggcgagagcagaaagttcctgaagaagatggacgacgaggacgaggacagcgaggacagcgaggacgacgaggactgggacaccggcagcaccagcagcgacagcgacagcgaggaggaggagggcaagcagaccgccctggccagcagattcctgaagaaggcccccaccaccgacgaggacaagaaggccgccgagaagaagagagaggacaaggccaagaagaagcacgacagaaagagcaagagactggacgaggaggaggaggacaacgagggcggcgagtgggagagagtgagaggcggcgtgcccctggtgaaggagaagcccaagatgttcgccaagggcaccgagatcacccacgccgtggtgatcaagaagctgaacgagatcctgcaggccagaggcaagaagggcaccgacagagccgcccagatcgagctgctgcagctgctggtgcagatcgccgccgagaacaacctgggcgagggcgtgatcgtgaagatcaagttcaacatcatcgccagcctgtacgactacaaccccaacctggccacctacatgaagcccgagatgtggggcaagtgcctggactgcatcaacgagctgatggacatcctgttcgccaaccccaacatcttcgtgggcgagaacatcctggaggagagcgagaacctgcacaacgccgaccagcccctgagagtgagaggctgcatcctgaccctggtggagagaatggacgaggagttcaccaagatcatgcagaacaccgacccccacagccaggagtacgtggagcacctgaaggacgaggcccaggtgtgcgccatcatcgagagagtgcagagatacctggaggagaagggcaccaccgaggaggtgtgcagaatctacctgctgagaatcctgcacacctactacaagttcgactacaaggcccaccagagacagctgaccccccccgagggcagcagcaagagcgagcaggaccaggccgagaacgagggcgaggacagcgccgtgctgatggagagactgtgcaagtacatctacgccaaggacagaaccgacagaatcagaacctgcgccatcctgtgccacatctaccaccacgccctgcacagcagatggtaccaggccagagacctgatgctgatgagccacctgcaggacaacatccagcacgccgacccccccgtgcagatcctgtacaacagaaccatggtgcagctgggcatctgcgccttcagacagggcctgaccaaggacgcccacaacgccctgctggacatccagagcagcggcagagccaaggagctgctgggccagggcctgctgctgagaagcctgcaggagagaaaccaggagcaggagaaggtggagagaagaagacaggtgcccttccacctgcacatcaacctggagctgctggagtgcgtgtacctggtgagcgccatgctgctggagatcccctacatggccgcccacgagagcgacgccagaagaagaatgatcagcaagcagttccaccaccagctgagagtgggcgagagacagcccctgctgggcccccccgagagcatgagagagcacgtggtggccgccagcaaggccatgaagatgggcgactggaagacctgccacagcttcatcatcaacgagaagatgaacggcaaggtgtgggacctgttccccgaggccgacaaggtgagaaccatgctggtgagaaagatccaggaggagagcctgagaacctacctgttcacctacagcagcgtgtacgacagcatcagcatggagaccctgagcgacatgttcgagctggacctgcccaccgtgcacagcatcatcagcaagatgatcatcaacgaggagctgatggccagcctggaccagcccacccagaccgtggtgatgcacagaaccgagcccaccgcccagcagaacctggccctgcagctggccgagaagctgggcagcctggtggagaacaacgagagagtgttcgaccacaagcagggcacctacggcggctacttcagagaccagaaggacggctacagaaagaacgagggctacatgagaagaggcggctacagacagcagcagagccagaccgcctactag

SEQ ID NO: 80903 - DNA, 2055 bp, Artificial Sequence
  Description of Artificial Sequence: Synthetic coding sequence
atgggcctgagcgccgccgcccccctgtggggcccccccggcctgctgctggccatcgccctgcaccccgccctgagcgtgccccccagaagagactactgcgtgctgggcgccggccccgccggcctgcagatggcctacttcctgcagagagccggcagagactacgccgtgttcgagagagcccccagacccggcagcttcttcaccagataccccagacacagaaagctgatcagcatcaacaagagatacaccggcaaggccaacgccgagttcaacctgagacacgactggaacagcctgctgagccacgaccccagactgctgttcagacactacagcagagcctacttccccgacgccagagacatggtgagatacctgggcgacttcgccgacaccctgggcctgagagtgcagtacaacaccaccatcgcccacgtgaccctggacaaggacagacaggcctggaacggccactacttcatcctgaccgaccagaagggccaggtgcaccagtgcagcgtgctgttcgtggccaccggcctgagcgtgcccaaccaggtggacttccccggcagcgagtacgccgagggctacgagagcgtgagcgtggaccccgaggacttcgtgggccagaacgtgctgatcctgggcagaggcaacagcgccttcgagaccgccgagaacatcctgggcgtgaccaacttcatccacatgctgagcagaagcagagtgagactgagctgggccacccactacgtgggcgacctgagagccatcaacaacggcctgctggacacctaccagctgaagagcctggacggcctgctggagagcgacctgaccgacctggccatcctgaaggacagcaagggcaagttccacgtgacccccaagttcttcctggaggaggccaacaccaaccagagcgccgacagcatcaccctgccccaggacgacaacgacaacttcgccatgagagtgccctacgacagagtgatcagatgcctgggctggaacttcgacttcagcatcttcaacaagagcctgagactgaacagcggcaacgccttcggcaagaagtaccccctgatcagagccagctacgagagcaagggcagcagaggcctgttcatcctgggcaccgccagccacagcgtggactacagaaagagcgccggcggcttcatccacggcttcagatacaccgtgagagccgtgcacagactgctggagcacagacaccacagcgtgacctggcccgccaccgagctgcccatcacccagctgaccagcagcatcgtgagaagagtgaacgaggccagcggcctgtaccagatgttcggcgtgctggccgacgtgatcctgctgaaggagaacagcaccgccttcgagtacctggaggagttccccatccagatgctggcccagctggagaccctgaccggcagaaaggccaagcacggcctgttcgtgatcaacatggagtacggcagaaacttcagcggccccgacaaggacgtgttcttcgacgacagaagcgtgggccacaccgaggacgcctggcagagcaacttcctgcaccccgtgatctactactacagatacctgcccaccgagcaggaggtgagattcagacccgcccactggcccctgcccagacccaccgccatccaccacatcgtggaggacttcctgaccgactggaccgcccccatcggccacatcctgcccctgagaagattcctggagaactgcctggacaccgacctgagaagcttctacgccgagagctgcttcctgttcgccctgaccagacagaagctgccccccttctgccagcagggctacctgagaatgcagggcctggtgagcaccgagagcctgtggcagcacagagtggagagcagactgctgagagactacgcccccaccggcagaagactggaggacagcagccagcagctgggcgaccaggagcccctgggcagccccctggcccccggccccctggcccagagcgtggacagcaacaaggaggagctgtag

SEQ ID NO: 80904 - DNA, 1602 bp, Artificial Sequence
  Description of Artificial Sequence: Synthetic coding sequence
atggccaagttcatgacccccgtgatccaggacaaccccagcggctggggcccctgcgccgtgcccgagcagttcagagacatgccctaccagcccttcagcaagggcgacagactgggcaaggtggccgactggaccggcgccacctaccaggacaagagatacaccaacaagtacagcagccagttcggcggcggcagccagtacgcctacttccacgaggaggacgagagcagcttccagctggtggacaccgccagaacccagaagaccgcctaccagagaaacagaatgagattcgcccagagaaacctgagaagagacaaggacagaagaaacatgctgcagttcaacctgcagatcctgcccaagagcgccaagcagaaggagagagagagaatcagactgcagaagagccagaagcccagagacagcagcgtggaggtgagaagcgactgggaggtgaaggaggagatggacttcccccagctgatgaagatgagatacctggaggtgagcgagccccaggacatcgagtgctgcggcgccctggagtactacgacaaggccttcgacagaatcaccaccagaagcgagaagcccctgagaagcatcaagagaatcttccacaccgtgaccaccaccgacgaccccgtgatcagaaagctggccaagacccagggcaacgtgttcgccaccgacgccatcctggccaccctgatgagctgcaccagaagcgtgtacagctgggacatcgtggtgcagagagtgggcagcaagctgttcttcgacaagagagacaacagcgacttcgacctgctgaccgtgagcgagaccgccaacgagcccccccaggacgagggcaacagcttcaacagccccagaaacctggccatggaggccacctacatcaaccacaacttcagccagcagtgcctgagaatgggcaaggagagatacaacttccccaaccccaaccccttcgtggaggacgacatggacaagaacgagatcgccagcgtggcctacagatacagaagatggaagctgggcgacgacatcgacctgatcgtgagatgcgagcacgacggcgtgatgaccggcgccaacggcgaggtgagcttcatcaacatcaagaccctgaacgagtgggacagcagacactgcaacggcgtggactggagacagaagctggacagccagagaggcgccgtgatcgccaccgagctgaagaacaacagctacaagctggccagatggacctgctgcgccctgctggccggcagcgagtacctgaagctgggctacgtgagcagataccacgtgaaggacagcagcagacacgtgatcctgggcacccagcagttcaagcccaacgagttcgccagccagatcaacctgagcgtggagaacgcctggggcatcctgagatgcgtgatcgacatctgcatgaagctggaggagggcaagtacctgatcctgaaggaccccaacaagcaggtgatcagagtgtacagcctgcccgacggcaccttcagcagcgacgaggacgaggaggaggaggaggaggaggaggaggaggaggaggaggaggagacctag

SEQ ID NO: 80905 - DNA, 372 bp, Artificial Sequence
  Description of Artificial Sequence: Synthetic coding sequence
atggccaagttcatgacccccgtgatccaggacaaccccagcggctggggcccctgcgccgtgcccgagcagttcagagacatgccctaccagcccttcagcaagggcgacagactgggcaaggtggccgactggaccggcgccacctaccaggacaagagatacaccaacaagtacagcagccagttcggcggcggcagccagtacgcctacttccacgaggaggacgagagcagcttccagctggtggacaccgccagaacccagaagaccgcctaccagagaaacagaatgagattcgcccagagaaacctgagaagagacaaggacagaagaaacatgctgcagttcaacctgcagatcctgccctag

SEQ ID NO: 80906 - DNA, 1647 bp, Artificial Sequence; identical to SEQ ID NO: 72129
  Description of Artificial Sequence: Synthetic coding sequence

SEQ ID NO: 80907 - DNA, 519 bp, Artificial Sequence
  Description of Artificial Sequence: Synthetic coding sequence
atggacaagaacgagatcgccagcgtggcctacagatacagaagatggaagctgggcgacgacatcgacctgatcgtgagatgcgagcacgacggcgtgatgaccggcgccaacggcgaggtgagcttcatcaacatcaagaccctgaacgagtgggacagcagacactgcaacggcgtggactggagacagaagctggacagccagagaggcgccgtgatcgccaccgagctgaagaacaacagctacaagctggccagatggacctgctgcgccctgctggccggcagcgagtacctgaagctgggctacgtgagcagataccacgtgaaggacagcagcagacacgtgatcctgggcacccagcagttcaagcccaacgagttcgccagccagatcaacctgagcgtggagaacgcctggggcatcctgagatgcgtgatcgacatctgcatgaagctggaggagggcaagtacctgatcctgaaggaccccaacaagcaggtgatcagagtgtag

SEQ ID NO: 80908 - DNA, 561 bp, Artificial Sequence
  Description of Artificial Sequence: Synthetic coding sequence
atggccaagttcatgacccccgtgatccaggacaaccccagcggctggggcccctgcgccgtgcccgagcagttcagagacatgccctaccagcccttcagcaagggcgacagactgggcaaggtggccgactggaccggcgccacctaccaggacaagagatacaccaacaagtacagcagccagttcggcggcggcagccagtacgcctacttccacgaggaggacgagagcagcttccagctggtggacaccgccagaacccagaagaccgcctaccagagaaacagaatgagattcgcccagagaaacctgagaagagacaaggacagaagaaacatgctgcagttcaacctgcagatcctgcccaagagcgccaagcagaaggagagagagagaatcagactgcagaagaagttccagaagcagttcggcgtgagacagaagtgggaccagaagagccaggtgatgtacctgtaccagaacagcgccctggagttcggcagcgtgtacctggtggtgttcatcaacagcctggacgagatctacttcacctactag

SEQ ID NO: 80909 - DNA, 810 bp, Artificial Sequence
  Description of Artificial Sequence: Synthetic coding sequence
atggccaagttcatgacccccgtgatccaggacaaccccagcggctggggcccctgcgccgtgcccgagcagttcagagacatgccctaccagcccttcagcaagggcgacagactgggcaaggtggccgactggaccggcgccacctaccaggacaagagatacaccaacaagtacagcagccagttcggcggcggcagccagtacgcctacttccacgaggaggacgagagcagcttccagctggtggacaccgccagaacccagaagaccgcctaccagagaaacagaatgagattcgcccagagaaacctgagaagagacaaggacagaagaaacatgctgcagttcaacctgcagatcctgcccaagagcgccaagcagaaggagagagagagaatcagactgcagaagaagttccagaagcagttcggcgtgagacagaagtgggaccagaagagccagaagcccagagacagcagcgtggaggtgagaagcgactgggaggtgaaggaggagatggacttcccccagctgatgaagatgagatacctggaggtgagcgagccccaggacatcgagtgctgcggcgccctggagtactacgacaaggccttcgacagaatcaccaccagaagcgagaagcccctgagaagcatcaagagaatcttccacaccgtgaccaccaccgacgaccccgtgatcagaaagctggccaagacccagggcaacgtgttcgccaccgacgccatcctggccaccctgatgagctgcaccagaagcgtgtacagctgggacatcgtggtgtag

SEQ ID NO: 80910 - DNA, 522 bp, Artificial Sequence
  Description of Artificial Sequence: Synthetic coding sequence
atggccaagttcatgacccccgtgatccaggacaaccccagcggctggggcccctgcgccgtgcccgagcagttcagagacatgccctaccagcccttcagcaagggcgacagactgggcaaggtggccgactggaccggcgccacctaccaggacaagagatacaccaacaagtacagcagccagttcggcggcggcagccagtacgcctacttccacgaggaggacgagagcagcttccagctggtggacaccgccagaacccagaagaccgcctaccagagaaacagaatgagattcgcccagagaaacctgagaagagacaaggacagaagaaacatgctgcagttcaacctgcagatcctgcccaagagcgccaagcagaaggagagagagagaatcagactgcagaagaagttccagaagcagttcggcgtgagacagaagtgggaccagaagagccagaagcccagagacagcagcgtggaggtgagaagcgactgggaggtgaaggaggagtag

SEQ ID NO: 80911 - DNA, 498 bp, Artificial Sequence
  Description of Artificial Sequence: Synthetic coding sequence
atggaggccacctacatcaaccacaacttcagccagcagtgcctgagaatgggcaaggagagatacaacttccccaaccccaaccccttcgtggaggacgacatggacaagaacgagatcgccagcgtggcctacagatacagaagatggaagctgggcgacgacatcgacctgatcgtgagatgcgagcacgacggcgtgatgaccggcgccaacggcgaggtgagcttcatcaacatcaagaccctgaacgagtgggacagcagacactgcaacggcgtggactggagacagaagctggacagccagagaggcgccgtgatcgccaccgagctgaagaacaacagctacaagctggccagatggacctgctgcgccctgctggccggcagcgagtacctgaagctgggctacgtgagcagataccacgtgaaggacagcagcagacacgtgatcctgggcacccagcagttcaagcccaacgagttcgccagctag

SEQ ID NO: 80912 - DNA, 1500 bp, Artificial Sequence
  Description of Artificial Sequence: Synthetic coding sequence
atggccaagttcatgacccccgtgatccaggacaaccccagcggctggggcccctgcgccgtgcccgagcagttcagagacatgccctaccagcccttcagcaagggcgacagactgggcaaggtggccgactggaccggcgccacctaccaggacaagagaaacctgagaagagacaaggacagaagaaacatgctgcagttcaacctgcagatcctgcccaagagcgccaagcagaaggagagagagagaatcagactgcagaagaagttccagaagcagttcggcgtgagacagaagtgggaccagaagagccagaagcccagagacagcagcgtggaggtgagaagcgactgggaggtgaaggaggagatggacttcccccagctgatgaagatgagatacctggaggtgagcgagccccaggacatcgagtgctgcggcgccctggagtactacgacaaggccttcgacagaatcaccaccagaagcgagaagcccctgagaagcatcaagagaatcttccacaccgtgaccaccaccgacgaccccgtgatcagaaagctggccaagacccagggcaacgtgttcgccaccgacgccatcctggccaccctgatgagctgcaccagaagcgtgtacagctgggacatcgtggtgcagagagtgggcagcaagctgttcttcgacaagagagacaacagcgacttcgacctgctgaccgtgagcgagaccgccaacgagcccccccaggacgagggcaacagcttcaacagccccagaaacctggccatggaggccacctacatcaaccacaacttcagccagcagtgcctgagaatgggcaaggagagatacaacttccccaaccccaaccccttcgtggaggacgacatggacaagaacgagatcgccagcgtggcctacagatacagaagatggaagctgggcgacgacatcgacctgatcgtgagatgcgagcacgacggcgtgatgaccggcgccaacggcgaggtgagcttcatcaacatcaagaccctgaacgagtgggacagcagacactgcaacggcgtggactggagacagaagctggacagccagagaggcgccgtgatcgccaccgagctgaagaacaacagctacaagctggccagatggacctgctgcgccctgctggccggcagcgagtacctgaagctgggctacgtgagcagataccacgtgaaggacagcagcagacacgtgatcctgggcacccagcagttcaagcccaacgagttcgccagccagatcaacctgagcgtggagaacgcctggggcatcctgagatgcgtgatcgacatctgcatgaagctggaggagggcaagtacctgatcctgaaggaccccaacaagcaggtgatcagagtgtacagcctgcccgacggcaccttcagcagcgacgaggacgaggaggaggaggaggaggaggaggaggaggaggaggaggaggagacctag

SEQ ID NO: 80913 - DNA, 1215 bp, Artificial Sequence
  Description of Artificial Sequence: Synthetic coding sequence
atgttcaccgagaagaccaccacctaccagtaccccagagccatcctgagcgtggacctgagcggcgagaacctgagcgacgtggacttcctggacgacagcagcaccgagagcctgctgctgagcggcgacgagtacaaccaggacttcgacagcaccaacttcgaggagagccaggacgaggacgacgccctgaacgagatcgtgagatgcatctgcgagatggacgaggagaacggcttcatgatccagtgcgaggagtgcctgtgctggcagcacagcgtgtgcatgggcctgctggaggagagcatccccgagcagtacatctgctacatctgcagagacccccccggccagagatggagcgccaagtacagatacgacaaggagtggctgaacaacggcagaatgtgcggcctgagcttcttcaaggagaactacagccacctgaacgccaagaagatcgtgagcacccaccacctgctggccgacgtgtacggcgtgaccgaggtgctgcacggcctgcagctgaagatcggcatcctgaagaacaagcaccaccccgacctgcacctgtgggcctgcagcggcaagagaaaggaccaggaccagatcatcgccggcgtggagaagaagatcgcccaggacaccgtgaacagagaggagaagaagtacgtgcagaaccacaaggagccccccagactgcccctgaagatggagggcacctacatcaccagcgagcacagctaccagaagccccagagcttcggccaggactgcaagagcctggccgaccccggcagcagcgacgacgacgacgtgagcagcctggaggaggagcaggagttccacatgagaagcaagaacagcctgcagtacagcgccaaggagcacggcatgcccgagaagaaccccgccgagggcaacaccgtgttcgtgtacaacgacaagaagggcaccgaggaccccggcgacagccacctgcagtggcagctgaacctgctgacccacatcgagaacgtgcagaacgaggtgaccagcagaatggacctgatcgagaaggaggtggacgtgctggagagctggctggacttcaccggcgagctggagccccccgaccccctggccagactgccccagctgaagagacacatcaagcagctgctgatcgacatgggcaaggtgcagcagatcgccaccctgtgcagcgtgtag

SEQ ID NO: 80914 - DNA, 1074 bp, Artificial Sequence
  Description of Artificial Sequence: Synthetic coding sequence
atggccacccccgccgtgcccgtgagcgccccccccgccacccccacccccgtgcccgccgccgcccccgccagcgtgcccgcccccacccccgcccccgccgccgcccccgtgcccgccgccgcccccgccagcagcagcgaccccgccgccgccgccgccgccaccgccgcccccggccagacccccgccagcgcccaggcccccgcccagacccccgcccccgccctgcccggccccgccctgcccggccccttccccggcggcagagtggtgagactgcaccccgtgatcctggccagcatcgtggacagctacgagagaagaaacgagggcgccgccagagtgatcggcaccctgctgggcaccgtggacaagcacagcgtggaggtgaccaactgcttcagcgtgccccacaacgagagcgaggacgaggtggccgtggacatggagttcgccaagaacatgtacgagctgcacaagaaggtgagccccaacgagctgatcctgggctggtacgccaccggccacgacatcaccgagcacagcgtgctgatccacgagtactacagcagagaggcccccaaccccatccacctgaccgtggacaccagcctgcagaacggcagaatgagcatcaaggcctacgtgagcaccctgatgggcgtgcccggcagaaccatgggcgtgatgttcacccccctgaccgtgaagtacgcctactacgacaccgagagaatcggcgtggacctgatcatgaagacctgcttcagccccaacagagtgatcggcctgagcagcgacctgcagcaggtgggcggcgccagcgccagaatccaggacgccctgagcaccgtgctgcagtacgccgaggacgtgctgagcggcaaggtgagcgccgacaacaccgtgggcagattcctgatgagcctggtgaaccaggtgcccaagatcgtgcccgacgacttcgagaccatgctgaacagcaacatcaacgacctgctgatggtgacctacctggccaacctgacccagagccagatcgccctgaacgagaagctggtgaacctgtag

SEQ ID NO: 80915 - DNA, 627 bp, Artificial Sequence
  Description of Artificial Sequence: Synthetic coding sequence
atggagttcgccaagaacatgtacgagctgcacaagaaggtgagccccaacgagctgatcctgggctggtacgccaccggccacgacatcaccgagcacagcgtgctgatccacgagtactacagcagagaggcccccaaccccatccacctgaccgtggacaccagcctgcagaacggcagaatgagcatcaaggcctacgtgagcaccctgatgggcgtgcccggcagaaccatgggcgtgatgttcacccccctgaccgtgaagtacgcctactacgacaccgagagaatcggcgtggacctgatcatgaagacctgcttcagccccaacagagtgatcggcctgagcagcgacctgcagcaggtgggcggcgccagcgccagaatccaggacgccctgagcaccgtgctgcagtacgccgaggacgtgctgagcggcaaggtgagcgccgacaacaccgtgggcagattcctgatgagcctggtgaaccaggtgcccaagatcgtgcccgacgacttcgagaccatgctgaacagcaacatcaacgacctgctgatggtgacctacctggccaacctgacccagagccagatcgccctgaacgagaagctggtgaacctgtag

SEQ ID NO: 80916 - DNA, 1074 bp, Artificial Sequence; identical to SEQ ID NO: 80914
  Description of Artificial Sequence: Synthetic coding sequence

SEQ ID NO: 80917 - DNA, 1119 bp, Artificial Sequence
  Description of Artificial Sequence: Synthetic coding sequence
atgaacgccgtgatcagcgccagcgccagcttcttcctggacaagatggccacccccgccgtgcccgtgagcgccccccccgccacccccacccccgtgcccgccgccgcccccgccagcgtgcccgcccccacccccgcccccgccgccgcccccgtgcccgccgccgcccccgccagcagcagcgaccccgccgccgccgccgccgccaccgccgcccccggccagacccccgccagcgcccaggcccccgcccagacccccgcccccgccctgcccggccccgccctgcccggccccttccccggcggcagagtggtgagactgcaccccgtgatcctggccagcatcgtggacagctacgagagaagaaacgagggcgccgccagagtgatcggcaccctgctgggcaccgtggacaagcacagcgtggaggtgaccaactgcttcagcgtgccccacaacgagagcgaggacgaggtggccgtggacatggagttcgccaagaacatgtacgagctgcacaagaaggtgagccccaacgagctgatcctgggctggtacgccaccggccacgacatcaccgagcacagcgtgctgatccacgagtactacagcagagaggcccccaaccccatccacctgaccgtggacaccagcctgcagaacggcagaatgagcatcaaggcctacgtgagcaccctgatgggcgtgcccggcagaaccatgggcgtgatgttcacccccctgaccgtgaagtacgcctactacgacaccgagagaatcggcgtggacctgatcatgaagacctgcttcagccccaacagagtgatcggcctgagcagcgacctgcagcaggtgggcggcgccagcgccagaatccaggacgccctgagcaccgtgctgcagtacgccgaggacgtgctgagcggcaaggtgagcgccgacaacaccgtgggcagattcctgatgagcctggtgaaccaggtgcccaagatcgtgcccgacgacttcgagaccatgctgaacagcaacatcaacgacctgctgatggtgacctacctggccaacctgacccagagccagatcgccctgaacgagaagctggtgaacctgtag

SEQ ID NO: 80918 - DNA, 924 bp, Artificial Sequence
  Description of Artificial Sequence: Synthetic coding sequence
atggccacccccgccgtgcccgtgagcgccccccccgccacccccacccccgtgcccgccgccgcccccgcccccgccctgcccggccccgccctgcccggccccttccccggcggcagagtggtgagactgcaccccgtgatcctggccagcatcgtggacagctacgagagaagaaacgagggcgccgccagagtgatcggcaccctgctgggcaccgtggacaagcacagcgtggaggtgaccaactgcttcagcgtgccccacaacgagagcgaggacgaggtggccgtggacatggagttcgccaagaacatgtacgagctgcacaagaaggtgagccccaacgagctgatcctgggctggtacgccaccggccacgacatcaccgagcacagcgtgctgatccacgagtactacagcagagaggcccccaaccccatccacctgaccgtggacaccagcctgcagaacggcagaatgagcatcaaggcctacgtgagcaccctgatgggcgtgcccggcagaaccatgggcgtgatgttcacccccctgaccgtgaagtacgcctactacgacaccgagagaatcggcgtggacctgatcatgaagacctgcttcagccccaacagagtgatcggcctgagcagcgacctgcagcaggtgggcggcgccagcgccagaatccaggacgccctgagcaccgtgctgcagtacgccgaggacgtgctgagcggcaaggtgagcgccgacaacaccgtgggcagattcctgatgagcctggtgaaccaggtgcccaagatcgtgcccgacgacttcgagaccatgctgaacagcaacatcaacgacctgctgatggtgacctacctggccaacctgacccagagccagatcgccctgaacgagaagctggtgaacctgtag

SEQ ID NO: 80919 - DNA, 963 bp, Artificial Sequence
  Description of Artificial Sequence: Synthetic coding sequence
atgcccaccggcgacttcgacagcaagcccagctgggccgaccaggtggaggaggagggcgaggacgacaagtgcgtgaccagcgagctgctgaagggcatccccctggccaccggcgacaccagccccgagcccgagctgctgcccggcgcccccctgcccccccccaaggaggtgatcaacggcaacatcaagaccgtgaccgagtacaagatcgacgaggacggcaagaagttcaagatcgtgagaaccttcagaatcgagaccagaaaggccagcaaggccgtggccagaagaaagaactggaagaagttcggcaacagcgagttcgacccccccggccccaacgtggccaccaccaccgtgagcgacgacgtgagcatgaccttcatcaccagcaaggaggacctgaactgccaggaggaggaggaccccatgaacaagctgaagggccagaagatcgtgagctgcagaatctgcaagggcgaccactggaccaccagatgcccctacaaggacaccctgggccccatgcagaaggagctggccgagcagctgggcctgagcaccggcgagaaggagaagctgcccggcgagctggagcccgtgcaggccacccagaacaagaccggcaagtacgtgccccccagcctgagagacggcgccagcagaagaggcgagagcatgcagcccaacagaagagccgacgacaacgccaccatcagagtgaccaacctgagcgaggacaccagagagaccgacctgcaggagctgttcagacccttcggcagcatcagcagaatctacctggccaaggacaagaccaccggccagagcaagggcttcgccttcatcagcttccacagaagagaggacgccgccagagccatcgccggcgtgagcggcttcggctacgaccacctgatcctgaacgtggagtgggccaagcccagcaccaactag

SEQ ID NO: 80920 - DNA, 1101 bp, Artificial Sequence
  Description of Artificial Sequence: Synthetic coding sequence
atgtacagcagacacgcccagagaatcccccccggcaagaagatggccagcagaaaggagggcaccggcagcaccgccaccagcagcagcagcaccgccggcgccgccggcaagggcaagggcaagggcggcagcggcgacagcgccgtgaagcaggtgcagatcgacggcctggtggtgctgaagatcatcaagcactaccaggaggagggccagggcaccgaggtggtgcagggcgtgctgctgggcctggtggtggaggacagactggagatcaccaactgcttccccttcccccagcacaccgaggacgacgccgacttcgacgaggtgcagtaccagatggagatgatgagaagcctgagacacgtgaacatcgaccacctgcacgtgggctggtaccagagcacctactacggcagcttcgtgaccagagccctgctggacagccagttcagctaccagcacgccatcgaggagagcgtggtgctgatctacgaccccatcaagaccgcccagggcagcctgagcctgaaggcctacagactgacccccaagctgatggaggtgtgcaaggagaaggacttcagccccgaggccctgaagaaggccaacatcaccttcgagtacatgttcgaggaggtgcccatcgtgatcaagaacagccacctgatcaacgtgctgatgtgggagctggagaagaagagcgccgtggccgacaagcacgagctgctgagcctggccagcagcaaccacctgggcaagaacctgcagctgctgatggacagagtggacgagatgagccaggacatcgtgaagtacaacacctacatgagaaacaccagcaagcagcagcagcagaagcaccagtaccagcagagaagacagcaggagaacatgcagagacagagcagaggcgagccccccctgcccgaggaggacctgagcaagctgttcaagcccccccagccccccgccagaatggacagcctgctgatcgccggccagatcaacacctactgccagaacatcaaggagttcaccgcccagaacctgggcaagctgttcatggcccaggccctgcaggagtacaacaactag

SEQ ID NO: 80921 - DNA, 1059 bp, Artificial Sequence
  Description of Artificial Sequence: Synthetic coding sequence
atggccagcagaaaggagggcaccggcagcaccgccaccagcagcagcagcaccgccggcgccgccggcaagggcaagggcaagggcggcagcggcgacagcgccgtgaagcaggtgcagatcgacggcctggtggtgctgaagatcatcaagcactaccaggaggagggccagggcaccgaggtggtgcagggcgtgctgctgggcctggtggtggaggacagactggagatcaccaactgcttccccttcccccagcacaccgaggacgacgccgacttcgacgaggtgcagtaccagatggagatgatgagaagcctgagacacgtgaacatcgaccacctgcacgtgggctggtaccagagcacctactacggcagcttcgtgaccagagccctgctggacagccagttcagctaccagcacgccatcgaggagagcgtggtgctgatctacgaccccatcaagaccgcccagggcagcctgagcctgaaggcctacagactgacccccaagctgatggaggtgtgcaaggagaaggacttcagccccgaggccctgaagaaggccaacatcaccttcgagtacatgttcgaggaggtgcccatcgtgatcaagaacagccacctgatcaacgtgctgatgtgggagctggagaagaagagcgccgtggccgacaagcacgagctgctgagcctggccagcagcaaccacctgggcaagaacctgcagctgctgatggacagagtggacgagatgagccaggacatcgtgaagtacaacacctacatgagaaacaccagcaagcagcagcagcagaagcaccagtaccagcagagaagacagcaggagaacatgcagagacagagcagaggcgagccccccctgcccgaggaggacctgagcaagctgttcaagcccccccagccccccgccagaatggacagcctgctgatcgccggccagatcaacacctactgccagaacatcaaggagttcaccgcccagaacctgggcaagctgttcatggcccaggccctgcaggagtacaacaactag

SEQ ID NO: 80922 - DNA, 378 bp, Artificial Sequence
  Description of Artificial Sequence: Synthetic coding sequence
atgaagcccatcctgctgcagggccacgagagaagcatcacccagatcaagtacaacagagagggcgacctgctgttcaccgtggccaaggaccccatcgtgaacgtgtggtacagcgtgaacggcgagagactgggcacctacatgggccacaccggcgccgtgtggtgcgtggacgccgactgggacaccaagcacgtgctgaccggcagcgccgacaacagctgcagactgtgggactgcgagaccggcaagcagctggccctgctgaagaccaacagcgccgtgagaacctgcggcttcgacttcggcggcaacatcatcatgttcagcaccgacaagcagatgggctaccagtgcttcgtgagcttcttctag

SEQ ID NO: 80923 - DNA, 978 bp, Artificial Sequence
  Description of Artificial Sequence: Synthetic coding sequence
atgaagcccatcctgctgcagggccacgagagaagcatcacccagatcaagtacaacagagagggcgacctgctgttcaccgtggccaaggaccccatcgtgaacgtgtggtacagcgtgaacggcgagagactgggcacctacatgggccacaccggcgccgtgtggtgcgtggacgccgactgggacaccaagcacgtgctgaccggcagcgccgacaacagctgcagactgtgggactgcgagaccggcaagcagctggccctgctgaagaccaacagcgccgtgagaacctgcggcttcgacttcggcggcaacatcatcatgttcagcaccgacaagcagatgggctaccagtgcttcgtgagcttcttcgacctgagagaccccagccagatcgacaacaacgagccctacatgaagatcccctgcaacgacagcaagatcaccagcgccgtgtggggccccctgggcgagtgcatcatcgccggccacgagagcggcgagctgaaccagtacagcgccaagagcggcgaggtgctggtgaacgtgaaggagcacagcagacagatcaacgacatccagctgagcagagacatgaccatgttcgtgaccgccagcaaggacaacaccgccaagctgttcgacagcaccaccctggagcaccagaagaccttcagaaccgagagacccgtgaacagcgccgccctgagccccaactacgaccacgtggtgctgggcggcggccaggaggccatggacgtgaccaccaccagcaccagaatcggcaagttcgaggccagattcttccacctggccttcgaggaggagttcggcagagtgaagggccacttcggccccatcaacagcgtggccttccaccccgacggcaagagctacagcagcggcggcgaggacggctacgtgagaatccactacttcgacccccagtacttcgagttcgagttcgaggcctag

SEQ ID NO: 80924 - DNA, 777 bp, Artificial Sequence
  Description of Artificial Sequence: Synthetic coding sequence
atggccgccgccgccgccgccgccggcgacagcgacagctgggacgccgacgccttcagcgtggaggaccccgtgagaaaggtgggcggcggcggcaccgccggcggcgacagatgggagggcgaggacgaggacgaggacgtgaaggacaactgggacgacgacgacgacgagaagaaggaggaggccgaggtgaagcccgaggtgaagatcagcgagaagaagaagatcgccgagaagatcaaggagaaggagagacagcagaagaagagacaggaggagatcaagaagagactggaggagcccgaggagcccaaggtgctgacccccgaggagcagctggccgacaagctgagactgaagaagctgcaggaggagagcgacctggagctggccaaggagaccttcggcgtgaacaacgccgtgtacggcatcgacgccatgaaccccagcagcagagacgacttcaccgagttcggcaagctgctgaaggacaagatcacccagtacgagaagagcctgtactacgccagcttcctggaggtgctggtgagagacgtgtgcatcagcctggagatcgacgacctgaagaagatcaccaacagcctgaccgtgctgtgcagcgagaagcagaagcaggagaagcagagcaaggccaagaagaagaagaagggcgtggtgcccggcggcggcctgaaggccaccatgaaggacgacctggccgactacggcggctacgacggcggctacgtgcaggactacgaggacttcatgtag

SEQ ID NO: 80925 - DNA, 657 bp, Artificial Sequence
  Description of Artificial Sequence: Synthetic coding sequence
atggccatgttcgagcagatgagagccaacgtgggcaagctgctgaagggcatcgacagatacaaccccgagaacctggccaccctggagagatacgtggagacccaggccaaggagaacgcctacgacctggaggccaacctggccgtgctgaagctgtaccagttcaaccccgccttcttccagaccaccgtgaccgcccagatcctgctgaaggccctgaccaacctgccccacaccgacttcaccctgtgcaagtgcatgatcgaccaggcccaccaggaggagagacccatcagacagatcctgtacctgggcgacctgctggagacctgccacttccaggccttctggcaggccctggacgagaacatggacctgctggagggcatcaccggcttcgaggacagcgtgagaaagttcatctgccacgtggtgggcatcacctaccagcacatcgacagatggctgctggccgagatgctgggcgacctgagcgacagccagctgaaggtgtggatgagcaagtacggctggagcgccgacgagagcggccagatcttcatctgcagccaggaggagagcatcaagcccaagaacatcgtggagaagatcgacttcgacagcgtgagcagcatcatggccagcagccagtag

SEQ ID NO: 80926 - DNA, 375 bp, Artificial Sequence
  Description of Artificial Sequence: Synthetic coding sequence
atgatcgaccaggcccaccaggaggagagacccatcagacagatcctgtacctgggcgacctgctggagacctgccacttccaggccttctggcaggccctggacgagaacatggacctgctggagggcatcaccggcttcgaggacagcgtgagaaagttcatctgccacgtggtgggcatcacctaccagcacatcgacagatggctgctggccgagatgctgggcgacctgagcgacagccagctgaaggtgtggatgagcaagtacggctggagcgccgacgagagcggccagatcttcatctgcagccaggaggagagcatcaagcccaagaacatcgtggagaagatcgacttcgacagcgagtggtag

SEQ ID NO: 80927 - DNA, 636 bp, Artificial Sequence
  Description of Artificial Sequence: Synthetic coding sequence
atggccatgttcgagcagatgagagccaacgtgggcaagctgctgaagggcatcgacagatacaaccccgagaacctggccaccctggagagatacgtggagacccaggccaaggagaacgcctacgacctggaggccaacctggccgtgctgaagctgtaccagttcaaccccgccttcttccagaccaccgtgaccgcccagatcctgctgaaggccctgaccaacctgccccacaccgacttcaccctgtgcaagtgcatgatcgaccaggcccaccaggaggagagacccatcagacagatcctgtacctgggcgacctgctggagacctgccacttccaggccttctggcaggccctggacgagaacatggacctgctggagggcatcaccggcttcgaggacagcgtgagaaagttcatctgccacgtggtgggcatcacctaccagcacatcgacagatggctgctggccgagatgctgggcgacctgagcgacagccagctgaaggtgtggatgagcaagtacggctggagcgccgacgagagcggccagatcttcatctgcagccaggaggagagcatcaagcccaagaacatcgtggagaagatcgacttcgacagcgagtggtag

SEQ ID NO: 80928 - DNA, 1125 bp, Artificial Sequence
  Description of Artificial Sequence: Synthetic coding sequence
atgagcgtgcccgccttcatcgacatcagcgaggaggaccaggccgccgagctgagagcctacctgaagagcaagggcgccgagatcagcgaggagaacagcgagggcggcctgcacgtggacctggcccagatcatcgaggcctgcgacgtgtgcctgaaggaggacgacaaggacgtggagagcgtgatgaacagcgtggtgagcctgctgctgatcctggagcccgacaagcaggaggccctgatcgagagcctgtgcgagaagctggtgaagttcagagagggcgagagacccagcctgagactgcagctgctgagcaacctgttccacggcatggacaagaacacccccgtgagatacaccgtgtactgcagcctgatcaaggtggccgccagctgcggcgccatccagtacatccccaccgagctggaccaggtgagaaagtggatcagcgactggaacctgaccaccgagaagaagcacaccctgctgagactgctgtacgaggccctggtggactgcaagaagagcgacgccgccagcaaggtgatggtggagctgctgggcagctacaccgaggacaacgccagccaggccagagtggacgcccacagatgcatcgtgagagccctgaaggaccccaacgccttcctgttcgaccacctgctgaccctgaagcccgtgaagttcctggagggcgagctgatccacgacctgctgaccatcttcgtgagcgccaagctggccagctacgtgaagttctaccagaacaacaaggacttcatcgacagcctgggcctgctgcacgagcagaacatggccaagatgagactgctgaccttcatgggcatggccgtggagaacaaggagatcagcttcgacaccatgcagcaggagctgcagatcggcgccgacgacgtggaggccttcgtgatcgacgccgtgagaaccaagatggtgtactgcaagatcgaccagacccagagaaaggtggtggtgagccacagcacccacagaaccttcggcaagcagcagtggcagcagctgtacgacaccctgaacgcctggaagcagaacctgaacaaggtgaagaacagcctgctgagcctgagcgacacctag

SEQ ID NO: 80929 - DNA, 2724 bp, Artificial Sequence
  Description of Artificial Sequence: Synthetic coding sequence
gtggagagcgccatcgccgagggcggcgccagcagattcagcgccagcagcggcggcggcggcagcagaggcgccccccagcactaccccaagaccgccggcaacagcgagttcctgggcaagacccccggccagaacgcccagaagtggatccccgccagaagcaccagaagagacgacaacagcgccgccaacaacagcgccaacgagaaggagagacacgacgccatcttcagaaaggtgagaggcatcctgaacaagctgacccccgagaagttcgacaagctgtgcctggagctgctgaacgtgggcgtggagagcaagctgatcctgaagggcgtgatcctgctgatcgtggacaaggccctggaggagcccaagtacagcagcctgtacgcccagctgtgcctgagactggccgaggacgcccccaacttcgacggccccgccgccgagggccagcccggccagaagcagagcaccaccttcagaagactgctgatcagcaagctgcaggacgagttcgagaacagaaccagaaacgtggacgtgtacgacaagagagagaaccccctgctgcccgaggaggaggagcagagagccatcgccaagatcaagatgctgggcaacatcaagttcatcggcgagctgggcaagctggacctgatccacgagagcatcctgcacaagtgcatcaagaccctgctggagaagaagaagagagtgcagctgaaggacatgggcgaggacctggagtgcctgtgccagatcatgagaaccgtgggccccagactggaccacgagagagccaagagcctgatggaccagtacttcgccagaatgtgcagcctgatgctgagcaaggagctgcccgccagaatcagattcctgctgcaggacaccgtggagctgagagagcaccactgggtgcccagaaaggccttcctggacaacggccccaagaccatcaaccagatcagacaggacgccgtgaaggacctgggcgtgttcatccccgcccccatggcccagggcatgagaagcgacttcttcctggagggccccttcatgccccccagaatgaagatggacagagaccccctgggcggcctggccgacatgttcggccagatgcccggcagcggcatcggcaccggccccggcgtgatccaggacagattcagccccaccatgggcagacacagaagcaaccagctgttcaacggccacggcggccacatcatgccccccacccagagccagttcggcgagatgggcggcaagttcatgaagagccagggcctgagccagctgtaccacaaccagagccagggcctgctgagccagctgcagggccagagcaaggacatgccccccagattcagcaagaagggccagctgaacgccgacgagatcagcctgagacccgcccagagcttcctgatgaacaagaaccaggtgcccaagctgcagccccagatcaccatgatcccccccagcgcccagccccccagaacccagaccccccccctgggccagaccccccagctgggcctgaagaccaacccccccctgatccaggagaagcccgccaagaccagcaagaagcccccccccagcaaggaggagctgctgaagctgaccgagaccgtggtgaccgagtacctgaacagcggcaacgccaacgaggccgtgaacggcgtgagagagatgagagcccccaagcacttcctgcccgagatgctgagcaaggtgatcatcctgagcctggacagaagcgacgaggacaaggagaaggccagcagcctgatcagcctgctgaagcaggagggcatcgccaccagcgacaacttcatgcaggccttcctgaacgtgctggaccagtgccccaagctggaggtggacatccccctggtgaagagctacctggcccagttcgccgccagagccatcatcagcgagctggtgagcatcagcgagctggcccagcccctggagagcggcacccacttccccctgttcctgctgtgcctgcagcagctggccaagctgcaggacagagagtggctgaccgagctgttccagcagagcaaggtgaacatgcagaagatgctgcccgagatcgaccagaacaaggacagaatgctggagatcctggagggcaagggcctgagcttcctgttccccctgctgaagctggagaaggagctgctgaagcagatcaagctggaccccagcccccagaccatctacaagtggatcaaggacaacatcagccccaagctgcacgtggacaagggcttcgtgaacatcctgatgaccagcttcctgcagtacatcagcagcgaggtgaacccccccagcgacgagaccgacagcagcagcgcccccagcaaggagcagctggagcaggagaagcagctgctgctgagcttcaagcccgtgatgcagaagttcctgcacgaccacgtggacctgcaggtgagcgccctgtacgccctgcaggtgcactgctacaacagcaacttccccaagggcatgctgctgagattcttcgtgcacttctacgacatggagatcatcgaggaggaggccttcctggcctggaaggaggacatcacccaggagttccccggcaagggcaaggccctgttccaggtgaaccagtggctgacctggctggagaccgccgaggaggaggagagcgaggaggaggccgactag

SEQ ID NO: 80930 - DNA, 762 bp, Artificial Sequence
  Description of Artificial Sequence: Synthetic coding sequence
atgcaggccttcctgaacgtgctggaccagtgccccaagctggaggtggacatccccctggtgaagagctacctggcccagttcgccgccagagccatcatcagcgagctggtgagcatcagcgagctggcccagcccctggagagcggcacccacttccccctgttcctgctgtgcctgcagcagctggccaagctgcaggacagagagtggctgaccgagctgttccagcagagcaaggtgaacatgcagaagatgctgcccgagatcgaccagaacaaggacagaatgctggagatcctggagggcaagggcctgagcttcctgttccccctgctgaagctggagaaggagctgctgaagcagatcaagctggaccccagcccccagaccatctacaagtggatcaaggacaacatcagccccaagctgcacgtggacaagggcttcgtgaacatcctgatgaccagcttcctgcagtacatcagcagcgaggtgaacccccccagcgacgagaccgacagcagcagcgcccccagcaaggagcagctggagcaggagaagcagctgctgctgagcttcaagcccgtgatgcagaagttcctgcacgaccacgtggacctgcaggtgagcgccctgtacgccctgcaggtgcactgctacaacagcaacttccccaagggcatgctgctgttcctgtgcaccagcatgacctggaagctgctgaagaagaagctgagctggctgggcaagaagatctag

SEQ ID NO: 80931 - DNA, 2610 bp, Artificial Sequence
  Description of Artificial Sequence: Synthetic coding sequence
gtggagagcgccatcgccgagggcggcgccagcagattcagcgccagcagcggcggcggcggcagcagaggcgccccccagcactaccccaagaccgccggcaacagcgagttcctgggcaagacccccggccagaacgcccagaagtggatccccgccagaagcaccagaagagacgacaacagcgccgccaacaacagcgccaacgagaaggagagacacgacgccatcttcagaaaggtgagaggcatcctgaacaagctgacccccgagaagttcgacaagctgtgcctggagctgctgaacgtgggcgtggagagcaagctgatcctgaagggcgtgatcctgctgatcgtggacaaggccctggaggagcccaagtacagcagcctgtacgcccagctgtgcctgagactggccgaggacgcccccaacttcgacggccccgccgccgagggccagcccggccagaagcagagcaccaccttcagaagactgctgatcagcaagctgcaggacgagttcgagaacagaaccagaaacgtggacgtgtacgacaagagagagaaccccctgctgcccgaggaggaggagcagagagccatcgccaagatcaagatgctgggcaacatcaagttcatcggcgagctgggcaagctggacctgatccacgagagcatcctgcacaagtgcatcaagaccctgctggagaagaagaagagagtgcagctgaaggacatgggcgaggacctggagtgcctgtgccagatcatgagaaccgtgggccccagactggaccacgagagagccaagagcctgatggaccagtacttcgccagaatgtgcagcctgatgctgagcaaggagctgcccgccagaatcagattcctgctgcaggacaccgtggagctgagagagcaccactgggtgcccagaaaggccttcctggacaacggccccaagaccatcaaccagatcagacaggacgccgtgaaggacctgggcgtgttcatccccgcccccatggcccagggcatgagaagcgacttcttcctggagggccccttcatgccccccagaatgaagatggacagagaccccctgggcggcctggccgacatgttcggccagatgcccggcagcggcatcggcaccggccccggcgtgatccaggacagattcagccccaccatgggcagacacagaagcaaccagctgttcaacggccacggcggccacatcatgccccccacccagagccagttcggcgagatgggcggcaagttcatgaagagccagatcagcctgagacccgcccagagcttcctgatgaacaagaaccaggtgcccaagctgcagccccagatcaccatgatcccccccagcgcccagccccccagaacccagaccccccccctgggccagaccccccagctgggcctgaagaccaacccccccctgatccaggagaagcccgccaagaccagcaagaagcccccccccagcaaggaggagctgctgaagctgaccgagaccgtggtgaccgagtacctgaacagcggcaacgccaacgaggccgtgaacggcgtgagagagatgagagcccccaagcacttcctgcccgagatgctgagcaaggtgatcatcctgagcctggacagaagcgacgaggacaaggagaaggccagcagcctgatcagcctgctgaagcaggagggcatcgccaccagcgacaacttcatgcaggccttcctgaacgtgctggaccagtgccccaagctggaggtggacatccccctggtgaagagctacctggcccagttcgccgccagagccatcatcagcgagctggtgagcatcagcgagctggcccagcccctggagagcggcacccacttccccctgttcctgctgtgcctgcagcagctggccaagctgcaggacagagagtggctgaccgagctgttccagcagagcaaggtgaacatgcagaagatgctgcccgagatcgaccagaacaaggacagaatgctggagatcctggagggcaagggcctgagcttcctgttccccctgctgaagctggagaaggagctgctgaagcagatcaagctggaccccagcccccagaccatctacaagtggatcaaggacaacatcagccccaagctgcacgtggacaagggcttcgtgaacatcctgatgaccagcttcctgcagtacatcagcagcgaggtgaacccccccagcgacgagaccgacagcagcagcgcccccagcaaggagcagctggagcaggagaagcagctgctgctgagcttcaagcccgtgatgcagaagttcctgcacgaccacgtggacctgcaggtgagcgccctgtacgccctgcaggtgcactgctacaacagcaacttccccaagggcatgctgctgagattcttcgtgcacttctacgacatggagatcatcgaggaggaggccttcctggcctggaaggaggacatcacccaggagttccccggcaagggcaaggccctgttccaggtgaaccagtggctgacctggctggagaccgccgaggaggaggagagcgaggaggaggccgactag

SEQ ID NO: 80932 - DNA, 2943 bp, Artificial Sequence
  Description of Artificial Sequence: Synthetic coding sequence
atggccggctggcccacccccgccggcaccagaccctggagaaccgaggccagactgtgcagcgacggcgagggcgcctggctgggccccctggccccctggagagaggccagactggccagcagaagaggcggcatcagcttcctgctgagcccccccctgcccacccccagcatcaacatcatcctgctgaagatcctgagatgccaggccgccaaggtggagagcgccatcgccgagggcggcgccagcagattcagcgccagcagcggcggcggcggcagcagaggcgccccccagcactaccccaagaccgccggcaacagcgagttcctgggcaagacccccggccagaacgcccagaagtggatccccgccagaagcaccagaagagacgacaacagcgccgccaacaacagcgccaacgagaaggagagacacgacgccatcttcagaaaggtgagaggcatcctgaacaagctgacccccgagaagttcgacaagctgtgcctggagctgctgaacgtgggcgtggagagcaagctgatcctgaagggcgtgatcctgctgatcgtggacaaggccctggaggagcccaagtacagcagcctgtacgcccagctgtgcctgagactggccgaggacgcccccaacttcgacggccccgccgccgagggccagcccggccagaagcagagcaccaccttcagaagactgctgatcagcaagctgcaggacgagttcgagaacagaaccagaaacgtggacgtgtacgacaagagagagaaccccctgctgcccgaggaggaggagcagagagccatcgccaagatcaagatgctgggcaacatcaagttcatcggcgagctgggcaagctggacctgatccacgagagcatcctgcacaagtgcatcaagaccctgctggagaagaagaagagagtgcagctgaaggacatgggcgaggacctggagtgcctgtgccagatcatgagaaccgtgggccccagactggaccacgagagagccaagagcctgatggaccagtacttcgccagaatgtgcagcctgatgctgagcaaggagctgcccgccagaatcagattcctgctgcaggacaccgtggagctgagagagcaccactgggtgcccagaaaggccttcctggacaacggccccaagaccatcaaccagatcagacaggacgccgtgaaggacctgggcgtgttcatccccgcccccatggcccagggcatgagaagcgacttcttcctggagggccccttcatgccccccagaatgaagatggacagagaccccctgggcggcctggccgacatgttcggccagatgcccggcagcggcatcggcaccggccccggcgtgatccaggacagattcagccccaccatgggcagacacagaagcaaccagctgttcaacggccacggcggccacatcatgccccccacccagagccagttcggcgagatgggcggcaagttcatgaagagccagggcctgagccagctgtaccacaaccagagccagggcctgctgagccagctgcagggccagagcaaggacatgccccccagattcagcaagaagggccagctgaacgccgacgagatcagcctgagacccgcccagagcttcctgatgaacaagaaccaggtgcccaagctgcagccccagatcaccatgatcccccccagcgcccagccccccagaacccagaccccccccctgggccagaccccccagctgggcctgaagaccaacccccccctgatccaggagaagcccgccaagaccagcaagaagcccccccccagcaaggaggagctgctgaagctgaccgagaccgtggtgaccgagtacctgaacagcggcaacgccaacgaggccgtgaacggcgtgagagagatgagagcccccaagcacttcctgcccgagatgctgagcaaggtgatcatcctgagcctggacagaagcgacgaggacaaggagaaggccagcagcctgatcagcctgctgaagcaggagggcatcgccaccagcgacaacttcatgcaggccttcctgaacgtgctggaccagtgccccaagctggaggtggacatccccctggtgaagagctacctggcccagttcgccgccagagccatcatcagcgagctggtgagcatcagcgagctggcccagcccctggagagcggcacccacttccccctgttcctgctgtgcctgcagcagctggccaagctgcaggacagagagtggctgaccgagctgttccagcagagcaaggtgaacatgcagaagatgctgcccgagatcgaccagaacaaggacagaatgctggagatcctggagggcaagggcctgagcttcctgttccccctgctgaagctggagaaggagctgctgaagcagatcaagctggaccccagcccccagaccatctacaagtggatcaaggacaacatcagccccaagctgcacgtggacaagggcttcgtgaacatcctgatgaccagcttcctgcagtacatcagcagcgaggtgaacccccccagcgacgagaccgacagcagcagcgcccccagcaaggagcagctggagcaggagaagcagctgctgctgagcttcaagcccgtgatgcagaagttcctgcacgaccacgtggacctgcaggtgagcgccctgtacgccctgcaggtgcactgctacaacagcaacttccccaagggcatgctgctgagattcttcgtgcacttctacgacatggagatcatcgaggaggaggccttcctggcctggaaggaggacatcacccaggagttccccggcaagggcaaggccctgttccaggtgaaccagtggctgacctggctggagaccgccgaggaggaggagagcgaggaggaggccgactag

SEQ ID NO: 80933 - DNA, 735 bp, Artificial Sequence
  Description of Artificial Sequence: Synthetic coding sequence
gtggagagcgccatcgccgagggcggcgccagcagattcagcgccagcagcggcggcggcggcagcagaggcgccccccagcactaccccaagaccgccggcaacagcgagttcctgggcaagacccccggccagaacgcccagaagtggatccccgccagaagcaccagaagagacgacaacagcgccgccaacaacagcgccaacgagaaggagagacacgacgccatcttcagaaaggtgagaggcatcctgaacaagctgacccccgagaagttcgacaagctgtgcctggagctgctgaacgtgggcgtggagagcaagctgatcctgaagggcgtgatcctgctgatcgtggacaaggccctggaggagcccaagtacagcagcctgtacgcccagctgtgcctgagactggccgaggacgcccccaacttcgacggccccgccgccgagggccagcccggccagaagcagagcaccaccttcagaagactgctgatcagcaagctgcaggacgagttcgagaacagaaccagaaacgtggacgtgtacgacaagagagagaaccccctgctgcccgaggaggaggagcagagagccatcgccaagatcaagatgctgggcaacatcaagttcatcggcgagctgggcaagctggacctgatccacgagagcatcctgcacaagtgcatcaagaccctgctggagaagaagaagagagtgcagctgtag

SEQ ID NO: 80934 - DNA, 2724 bp, Artificial Sequence; identical to SEQ ID NO: 80929
  Description of Artificial Sequence: Synthetic coding sequence

SEQ ID NO: 80935 - DNA, 2724 bp, Artificial Sequence; identical to SEQ ID NO: 80929
  Description of Artificial Sequence: Synthetic coding sequence

SEQ ID NO: 80936 - DNA, 375 bp, Artificial Sequence
  Description of Artificial Sequence: Synthetic coding sequence
gtggagagcgccatcgccgagggcggcgccagcagattcagcgccagcagcggcggcggcggcagcagaggcgccccccagcactaccccaagaccgccggcaacagcgagttcctgggcaagacccccggccagaacgcccagaagtggatccccgccagaagcaccagaagagacgacaacagcgccgccaacaacagcgccaacgagaaggagagacacgacgccatcttcagaaaggtgagaggcatcctgaacaagctgacccccgagaagttcgacaagctgtgcctggagctgctgaacgtgggcgtggagagcaagctgatcctgaagggcgtgatcctgctgatcgtggacaaggccctggagtag

SEQ ID NO: 80937 - DNA, 339 bp, Artificial Sequence
  Description of Artificial Sequence: Synthetic coding sequence
gtggagagcgccatcgccgagggcggcgccagcagattcagcgccagcagcggcggcggcggcagcagaggcgccccccagcactaccccaagaccgccggcaacagcgagttcctgggcaagacccccggccagaacgcccagaagtggatccccgccagaagcaccagaagagacgacaacagcgccgccaacaacagcgccaacgagaaggagagacacgacgccatcttcagaaaggtgagaggcatcctgaacaagctgacccccgagaagttcgacaagctgtgcctggagctgctgaacgtgggcgtggagagcaagctgatcctgaagtag

SEQ ID NO: 80938 - DNA, 351 bp, Artificial Sequence
  Description of Artificial Sequence: Synthetic coding sequence
gtggagagcgccatcgccgagggcggcgccagcagattcagcgccagcagcggcggcggcggcagcagaggcgccccccagcactaccccaagaccgccggcaacagcgagttcctgggcaagacccccggccagaacgcccagaagtggatccccgccagaagcaccagaagagacgacaacagcgccgccaacaacagcgccaacgagaaggagagacacgacgccatcttcagaaaggtgagaggcatcctgaacaagctgacccccgagaagttcgacaagctgtgcctggagctgctgaacgtgggcgtggagagcaagctgatcctgaagggcgtgatcctgtag

SEQ ID NO: 80939 - DNA, 1335 bp, Artificial Sequence
  Description of Artificial Sequence: Synthetic coding sequence
gtggagagcgccatcgccgagggcggcgccagcagattcagcgccagcagcggcggcggcggcagcagaggcgccccccagcactaccccaagaccgccggcaacagcgagttcctgggcaagacccccggccagaacgcccagaagtggatccccgccagaagcaccagaagagacgacaacagcgccgccaacaacagcgccaacgagaaggagagacacgacgccatcttcagaaaggtgagaggcatcctgaacaagctgacccccgagaagttcgacaagctgtgcctggagctgctgaacgtgggcgtggagagcaagctgatcctgaagggcgtgatcctgctgatcgtggacaaggccctggaggagcccaagtacagcagcctgtacgcccagctgtgcctgagactggccgaggacgcccccaacttcgacggccccgccgccgagggccagcccggccagaagcagagcaccaccttcagaagactgctgatcagcaagctgcaggacgagttcgagaacagaaccagaaacgtggacgtgtacgacaagagagagaaccccctgctgcccgaggaggaggagcagagagccatcgccaagatcaagatgctgggcaacatcaagttcatcggcgagctgggcaagctggacctgatccacgagagcatcctgcacaagtgcatcaagaccctgctggagaagaagaagagagtgcagctgaaggacatgggcgaggacctggagtgcctgtgccagatcatgagaaccgtgggccccagactggaccacgagagagccaagagcctgatggaccagtacttcgccagaatgtgcagcctgatgctgagcaaggagctgcccgccagaatcagattcctgctgcaggacaccgtggagctgagagagcaccactgggtgcccagaaaggccttcctggacaacggccccaagaccatcaaccagatcagacaggacgccgtgaaggacctgggcgtgttcatccccgcccccatggcccagggcatgagaagcgacttcttcctggagggccccttcatgccccccagaatgaagatggacagagaccccctgggcggcctggccgacatgttcggccagatgcccggcagcggcatcggcaccggccccggcgtgatccaggacagattcagccccaccatgggcagacacagaagcaaccagctgttcaacggccacggcggccacatcatgccccccacccagagccagttcggcgagatgggcggcaagttcatgaagagccagatcagcctgagacccgcccagagcttcctgatgtag

SEQ ID NO: 80940 - DNA, 849 bp, Artificial Sequence
  Description of Artificial Sequence: Synthetic coding sequence
gtggagagcgccatcgccgagggcggcgccagcagattcagcgccagcagcggcggcggcggcagcagaggcgccccccagcactaccccaagaccgccggcaacagcgagttcctgggcaagacccccggccagaacgcccagaagtggatccccgccagaagcaccagaagagacgacaacagcgccgccaacaacagcgccaacgagaaggagagacacgacgccatcttcagaaaggtgagaggcatcctgaacaagctgacccccgagaagttcgacaagctgtgcctggagctgctgaacgtgggcgtggagagcaagctgatcctgaagggcgtgatcctgctgatcgtggacaaggccctggaggagcccaagtacagcagcctgtacgcccagctgtgcctgagactggccgaggacgcccccaacttcgacggccccgccgccgagggccagcccggccagaagcagagcaccaccttcagaagactgctgatcagcaagctgcaggacgagttcgagaacagaaccagaaacgtggacgtgtacgacaagagagagaaccccctgctgcccgaggaggaggagcagagagccatcgccaagatcaagatgctgggcaacatcaagttcatcggcgagctgggcaagctggacctgatccacgagagcatcctgcacaagtgcatcaagaccctgctggagaagaagaagagagtgcagctgaaggacatgggcgaggacctggagtgcctgtgccagatcatgagaaccgtgggccccagactggaccacgagagagccaagagcctgatggaccagtacttcgccagaatgtgctag

SEQ ID NO: 80941 - DNA, 393 bp, Artificial Sequence
  Description of Artificial Sequence: Synthetic coding sequence
gtggagagcgccatcgccgagggcggcgccagcagattcagcgccagcagcggcggcggcggcagcagaggcgccccccagcactaccccaagaccgccggcaacagcgagttcctgggcaagacccccggccagaacgcccagaagtggatccccgccagaagcaccagaagagacgacaacagcgccgccaacaacagcgccaacgagaaggagagacacgacgccatcttcagaaaggtgagaggcatcctgaacaagctgacccccgagaagttcgacaagctgtgcctggagctgctgaacgtgggcgtggagagcaagctgatcctgaagggcgtgatcctgctgatcgtggacaaggccctggaggagcccaagtacagcagctag

SEQ ID NO: 80942 - DNA, 1221 bp, Artificial Sequence
  Description of Artificial Sequence: Synthetic coding sequence
atgagcgccagccaggacagcagaagcagagacaacggccccgacggcatggagcccgagggcgtgatcgagagcaactggaacgagatcgtggacagcttcgacgacatgaacctgagcgagagcctgctgagaggcatctacgcctacggcttcgagaagcccagcgccatccagcagagagccatcctgccctgcatcaagggctacgacgtgatcgcccaggcccagagcggcaccggcaagaccgccaccttcgccatcagcatcctgcagcagatcgagctggacctgaaggccacccaggccctggtgctggcccccaccagagagctggcccagcagatccagaaggtggtgatggccctgggcgactacatgggcgccagctgccacgcctgcatcggcggcaccaacgtgagagccgaggtgcagaagctgcagatggaggccccccacatcatcgtgggcacccccggcagagtgttcgacatgctgaacagaagatacctgagccccaagtacatcaagatgttcgtgctggacgaggccgacgagatgctgagcagaggcttcaaggaccagatctacgacatcttccagaagctgaacagcaacacccaggtggtgctgctgagcgccaccatgcccagcgacgtgctggaggtgaccaagaagttcatgagagaccccatcagaatcctggtgaagaaggaggagctgaccctggagggcatcagacagttctacatcaacgtggagagagaggagtggaagctggacaccctgtgcgacctgtacgagaccctgaccatcacccaggccgtgatcttcatcaacaccagaagaaaggtggactggctgaccgagaagatgcacgccagagacttcaccgtgagcgccatgcacggcgacatggaccagaaggagagagacgtgatcatgagagagttcagaagcggcagcagcagagtgctgatcaccaccgacctgctggccagaggcatcgacgtgcagcaggtgagcctggtgatcaactacgacctgcccaccaacagagagaactacatccacagaatcggcagaggcggcagattcggcagaaagggcgtggccatcaacatggtgaccgaggaggacaagagaaccctgagagacatcgagaccttctacaacaccagcatcgaggagatgcccctgaacgtggccgacctgatctag

SEQ ID NO: 80943 - DNA, 441 bp, Artificial Sequence
  Description of Artificial Sequence: Synthetic coding sequence
atggagcccgagggcgtgatcgagagcaactggaacgagatcgtggacagcttcgacgacatgaacctgagcgagagcctgctgagaggcatctacgcctacggcttcgagaagcccagcgccatccagcagagagccatcctgccctgcatcaagggctacgacgtgatcgcccaggcccagagcggcaccggcaagaccgccaccttcgccatcagcatcctgcagcagatcgagctggacctgaaggccacccaggccctggtgctggcccccaccagagagctggcccagcaggtgagagtggccagcatccccagcttcagagccgacctgggcatgatgagcatcatccagggccccgagaagagcagcctgatcaccaccctgggcggcagacacggctgccccaacaccctggagacctgctgggtgaactag

SEQ ID NO: 80944 - DNA, 603 bp, Artificial Sequence
  Description of Artificial Sequence: Synthetic coding sequence
atgttcgtgctggacgaggccgacgagatgctgagcagaggcttcaaggaccagatctacgacatcttccagaagctgaacagcaacacccaggtggtgctgctgagcgccaccatgcccagcgacgtgctggaggtgaccaagaagttcatgagagaccccatcagaatcctggtgaagaaggaggagctgaccctggagggcatcagacagttctacatcaacgtggagagagaggagtggaagctggacaccctgtgcgacctgtacgagaccctgaccatcacccaggccgtgatcttcatcaacaccagaagaaaggtggactggctgaccgagaagatgcacgccagagacttcaccgtgagcgccatggtgtgcctgcccgccgccagcctgctgtgggtgtgccccagcgaggtgagctacctgaagcccggcttcctggagcccagatgcctgcccggcctgctgcacatctgcttcctgttccagcacggcgacatggaccagaaggagagagacgtgatcatgagagagttcagaagcggcagcagcagagtgctgatcaccaccgacctgctggtgagcagaggcaactag

SEQ ID NO: 80945 - DNA, 1026 bp, Artificial Sequence
  Description of Artificial Sequence: Synthetic coding sequence
atgagcgccagccaggacagcagaagcagagacaacggccccgacggcatggagcccgagggcgtgatcgagagcaactggaacgagatcgtggacagcttcgacgacatgaacctgagcgagagcctgctgagaggcatctacgcctacggcttcgagaagcccagcgccatccagcagagagccatcctgccctgcatcaagggctacgacgtgatcgcccaggcccagagcggcaccggcaagaccgccaccttcgccatcagcatcctgcagcagatcgagctggacctgaaggccacccaggccctggtgctggcccccaccagagagctggcccagcagatccagaaggtggtgatggccctgggcgactacatgggcgccagctgccacgcctgcatcggcggcaccaacgtgagagccgaggtgcagaagctgcagatggaggccccccacatcatcgtgggcacccccggcagagtgttcgacatgctgaacagaagatacctgagccccaagtacatcaagatgttcgtgctggacgaggccgacgagatgctgagcagaggcttcaaggaccagatctacgacatcttccagaagctgaacagcaacacccaggtggtgctgctgagcgccaccatgcccagcgacgtgctggaggtgaccaagaagttcatgagagaccccatcagaatcctggtgaagaaggaggagctgaccctggagggcatcagacagttctacatcaacgtggagagagaggagtggaagctggacaccctgtgcgacctgtacgagaccctgaccatcacccaggccgtgatcttcatcaacaccagaagaaaggtggactggctgaccgagaagatgcacgccagagacttcaccgtgagcgccatgcacggcgacatggaccagaaggagagagacgtgatcatgagagagttcagaagcggcagcagcagagtgctgatcaccaccgacctgctgaacagaagcagatggaccgtgtggccctag

SEQ ID NO: 80946 - DNA, 1224 bp, Artificial Sequence
  Description of Artificial Sequence: Synthetic coding sequence
atgagcggcggcagcgccgactacaacagagagcacggcggccccgagggcatggaccccgacggcgtgatcgagagcaactggaacgagatcgtggacaacttcgacgacatgaacctgaaggagagcctgctgagaggcatctacgcctacggcttcgagaagcccagcgccatccagcagagagccatcatcccctgcatcaagggctacgacgtgatcgcccaggcccagagcggcaccggcaagaccgccaccttcgccatcagcatcctgcagcagctggagatcgagttcaaggagacccaggccctggtgctggcccccaccagagagctggcccagcagatccagaaggtgatcctggccctgggcgactacatgggcgccacctgccacgcctgcatcggcggcaccaacgtgagaaacgagatgcagaagctgcaggccgaggccccccacatcgtggtgggcacccccggcagagtgttcgacatgctgaacagaagatacctgagccccaagtggatcaagatgttcgtgctggacgaggccgacgagatgctgagcagaggcttcaaggaccagatctacgagatcttccagaagctgaacaccagcatccaggtggtgctgctgagcgccaccatgcccaccgacgtgctggaggtgaccaagaagttcatgagagaccccatcagaatcctggtgaagaaggaggagctgaccctggagggcatcaagcagttctacatcaacgtggagagagaggagtggaagctggacaccctgtgcgacctgtacgagaccctgaccatcacccaggccgtgatcttcctgaacaccagaagaaaggtggactggctgaccgagaagatgcacgccagagacttcaccgtgagcgccctgcacggcgacatggaccagaaggagagagacgtgatcatgagagagttcagaagcggcagcagcagagtgctgatcaccaccgacctgctggccagaggcatcgacgtgcagcaggtgagcctggtgatcaactacgacctgcccaccaacagagagaactacatccacagaatcggcagaggcggcagattcggcagaaagggcgtggccatcaacttcgtgaccgaggaggacaagagaatcctgagagacatcgagaccttctacaacaccaccgtggaggagatgcccatgaacgtggccgacctgatctag

SEQ ID NO: 80947 - DNA, 939 bp, Artificial Sequence
  Description of Artificial Sequence: Synthetic coding sequence
atgctgaccgtgctgagaagcctgcccctgttcagcagagagctgctgttccccgtgctgaagatccagaaggtgatcctggccctgggcgactacatgggcgccacctgccacgcctgcatcggcggcaccaacgtgagaaacgagatgcagaagctgcaggccgaggccccccacatcgtggtgggcacccccggcagagtgttcgacatgctgaacagaagatacctgagccccaagtggatcaagatgttcgtgctggacgaggccgacgagatgctgagcagaggcttcaaggaccagatctacgagatcttccagaagctgaacaccagcatccaggtggtgctgctgagcgccaccatgcccaccgacgtgctggaggtgaccaagaagttcatgagagaccccatcagaatcctggtgaagaaggaggagctgaccctggagggcatcaagcagttctacatcaacgtggagagagaggagtggaagctggacaccctgtgcgacctgtacgagaccctgaccatcacccaggccgtgatcttcctgaacaccagaagaaaggtggactggctgaccgagaagatgcacgccagagacttcaccgtgagcgccctgcacggcgacatggaccagaaggagagagacgtgatcatgagagagttcagaagcggcagcagcagagtgctgatcaccaccgacctgctggccagaggcatcgacgtgcagcaggtgagcctggtgatcaactacgacctgcccaccaacagagagaactacatccacagaatcggcagaggcggcagattcggcagaaagggcgtggccatcaacttcgtgaccgaggaggacaagagaatcctgagagacatcgagaccttctacaacaccaccgtggaggagatgcccatgaacgtggccgacctgatctag

SEQ ID NO: 80948 - DNA, 1227 bp, Artificial Sequence
  Description of Artificial Sequence: Synthetic coding sequence
atgagcggcggcagcgccgactacaacagcagagagcacggcggccccgagggcatggaccccgacggcgtgatcgagagcaactggaacgagatcgtggacaacttcgacgacatgaacctgaaggagagcctgctgagaggcatctacgcctacggcttcgagaagcccagcgccatccagcagagagccatcatcccctgcatcaagggctacgacgtgatcgcccaggcccagagcggcaccggcaagaccgccaccttcgccatcagcatcctgcagcagctggagatcgagttcaaggagacccaggccctggtgctggcccccaccagagagctggcccagcagatccagaaggtgatcctggccctgggcgactacatgggcgccacctgccacgcctgcatcggcggcaccaacgtgagaaacgagatgcagaagctgcaggccgaggccccccacatcgtggtgggcacccccggcagagtgttcgacatgctgaacagaagatacctgagccccaagtggatcaagatgttcgtgctggacgaggccgacgagatgctgagcagaggcttcaaggaccagatctacgagatcttccagaagctgaacaccagcatccaggtggtgctgctgagcgccaccatgcccaccgacgtgctggaggtgaccaagaagttcatgagagaccccatcagaatcctggtgaagaaggaggagctgaccctggagggcatcaagcagttctacatcaacgtggagagagaggagtggaagctggacaccctgtgcgacctgtacgagaccctgaccatcacccaggccgtgatcttcctgaacaccagaagaaaggtggactggctgaccgagaagatgcacgccagagacttcaccgtgagcgccctgcacggcgacatggaccagaaggagagagacgtgatcatgagagagttcagaagcggcagcagcagagtgctgatcaccaccgacctgctggccagaggcatcgacgtgcagcaggtgagcctggtgatcaactacgacctgcccaccaacagagagaactacatccacagaatcggcagaggcggcagattcggcagaaagggcgtggccatcaacttcgtgaccgaggaggacaagagaatcctgagagacatcgagaccttctacaacaccaccgtggaggagatgcccatgaacgtggccgacctgatctag

SEQ ID NO: 80949 - DNA, 174 bp, Artificial Sequence
  Description of Artificial Sequence: Synthetic coding sequence
atgagcggcggcagcgccgactacaacagagagcacggcggccccgagggcatggaccccgacggcgtgatcgagagcaactggaacgagatcgtggacaacttcgacgacatgaacctgaaggagagcctgctgagaggcatctacgcctacggcttcgagaagcccagctag

SEQ ID NO: 80950 - DNA, 297 bp, Artificial Sequence
  Description of Artificial Sequence: Synthetic coding sequence
atgagcggcggcagcgccgactacaacagagagcacggcggccccgagggcatggaccccgacggcgtgatcgagagcaactggaacgagatcgtggacaacttcgacgacatgaacctgaaggagagcctgctgagaggcatctacgcctacggcttcgagaagcccagcgccatccagcagagagccatcatcccctgcatcaagggctacgacgtgatcgcccaggcccagagcggcaccggcaagaccgccaccttcgccatcagcatcctgcagcagctggagatcgagtag

SEQ ID NO: 80951 - DNA, 363 bp, Artificial Sequence
  Description of Artificial Sequence: Synthetic coding sequence
atgagcagcagcgccggcagcggccaccagcccagccagagcagagccatccccaccagaaccgtggccatcagcgacgccgcccagctgccccacgactactgcaccacccccggcggcaccctgttcagcaccacccccggcggcaccagaatcatctacgacagaaagttcctgctggacagaagaaacagccccatggcccagacccccccctgccacctgcccaacatccccggcgtgaccagccccggcaccctgatcgaggacagcaaggtggaggtgaacaacctgaacaacctgaacaaccacgacagaaagcacgccgtgggcgacgacgcccagttcgagatggacatctag

SEQ ID NO: 80952 - DNA, 738 bp, Artificial Sequence
  Description of Artificial Sequence: Synthetic coding sequence
atgaacaacaagttcgacgccctgaaggacgacgacagcggcgaccacgaccagaacgaggagaacagcacccagaaggacggcgagaaggagaagaccgagagagacaagaaccagagcagcagcaagagaaaggccgtggtgcccggccccgccgagcaccccctgcagtacaactacaccttctggtacagcagaagaacccccggcagacccaccagcagccagagctacgagcagaacatcaagcagatcggcaccttcgccagcgtggagcagttctggagattctacagccacatggtgagacccggcgacctgaccggccacagcgacttccacctgttcaaggagggcatcaagcccatgtgggaggacgacgccaacaagaacggcggcaagtggatcatcagactgagaaagggcctggccagcagatgctgggagaacctgatcctggccatgctgggcgagcagttcatggtgggcgaggagatctgcggcgccgtggtgagcgtgagattccaggaggacatcatcagcatctggaacaagaccgccagcgaccaggccaccaccgccagaatcagagacaccctgagaagagtgctgaacctgccccccaacaccatcatggagtacaagacccacaccgacagcatcaagatgcccggcagactgggcccccagagactgctgttccagaacctgtggaagcccagactgaacgtgccctag

SEQ ID NO: 80953 - DNA, 705 bp, Artificial Sequence
  Description of Artificial Sequence: Synthetic coding sequence
atgaacaacaagttcgacgccctgaaggacgacgacagcggcgaccacgaccagaacgaggagaacagcacccagaaggacggcgagaaggagaagaccgagagagacaagaaccagagcagcagcaagagaaaggccgtggtgcccggccccgccgagcaccccctgcagtacaactacaccttctggtacagcagaagaacccccggcagacccaccagcagccagagctacgagcagaacatcaagcagatcggcaccttcgccagcgtggagcagttctggagattctacagccacatggtgagacccggcgacctgaccggccacagcgacttccacctgttcaaggagggcatcaagcccatgtgggaggacgacgccaacaagaacggcggcaagtggatcatcagactgagaaagggcctggccagcagatgctgggagaacctgatcctggccatgctgggcgagcagttcatggtgggcgaggagatctgcggcgccgtggtgagcgtgagattccaggaggacatcatcagcatctggaacaagaccgccagcgaccaggccaccaccgccagaatcagagacaccctgagaagagtgctgaacctgccccccaacaccatcatggagtacaagacccacaccgacagcatcaaggacaacagcagcttcagaaacaccaagatcaccctgtag

SEQ ID NO: 80954 - DNA, 567 bp, Artificial Sequence
  Description of Artificial Sequence: Synthetic coding sequence
atgaacaacaagttcgacgccctgaaggacgacgacagcggcgaccacgaccagaacgaggagaacagcacccagaaggacggcgagaaggagaagaccgagagagacaagaaccagagcagcagcaagagaaaggtggagcagttctggagattctacagccacatggtgagacccggcgacctgaccggccacagcgacttccacctgttcaaggagggcatcaagcccatgtgggaggacgacgccaacaagaacggcggcaagtggatcatcagactgagaaagggcctggccagcagatgctgggagaacctgatcctggccatgctgggcgagcagttcatggtgggcgaggagatctgcggcgccgtggtgagcgtgagattccaggaggacatcatcagcatctggaacaagaccgccagcgaccaggccaccaccgccagaatcagagacaccctgagaagagtgctgaacctgccccccaacaccatcatggagtacaagacccacaccgacagcatcaagtacgtgctgggcggctacggcagaacctgcccctag

SEQ ID NO: 80955 - DNA, 357 bp, Artificial Sequence
  Description of Artificial Sequence: Synthetic coding sequence
atgagaggcgagagaagacccctgtgggaggaggagagcaacgccaagggcggcgtgtggaagatgaaggtgcccaaggacagcaccagcaccgtgtggaaggagctgctgctggccaccatcggcgagcagttcaccgactgcgccgccgccgacgacgaggtgatcggcgtgagcgtgagcgtgagagacagagaggacgtggtgcaggtgtggaacgtgaacgccagcctggtgggcgaggccaccgtgctggagaagatctacgagctgctgccccacatcaccttcaaggccgtgttctacaagccccacgaggagcaccacgccttcgagggcggcagaggcaagcactag

SEQ ID NO: 80956 - DNA, 357 bp, Artificial Sequence; identical to SEQ ID NO: 80955
  Description of Artificial Sequence: Synthetic coding sequence

SEQ ID NO: 80957 - DNA, 357 bp, Artificial Sequence; identical to SEQ ID NO: 80955
  Description of Artificial Sequence: Synthetic coding sequence

SEQ ID NO: 80958 - DNA, 675 bp, Artificial Sequence
  Description of Artificial Sequence: Synthetic coding sequence
atggccctgccccccgccgccgccccccccgccggcgccagagagccccccggcagcagagccgccgccgccgccgccgcccccgagccccccctgggcctgcagcagctgagcgccctgcagcccgagcccggcggcgtgcccctgcacagcagctggaccttctggctggacagaagcctgcccggcgccaccgccgccgagtgcgccagcaacctgaagaagatctacaccgtgcagaccgtgcagatcttctggagcgtgtacaacaacatcccccccgtgaccagcctgcccctgagatgcagctaccacctgatgagaggcgagagaagacccctgtgggaggaggagagcaacgccaagggcggcgtgtggaagatgaaggtgcccaaggacagcaccagcaccgtgtggaaggagctgctgctggccaccatcggcgagcagttcaccgactgcgccgccgccgacgacgaggtgatcggcgtgagcgtgagcgtgagagacagagaggacgtggtgcaggtgtggaacgtgaacgccagcctggtgggcgaggccaccgtgctggagaagatctacgagctgctgccccacatcaccttcaaggccgtgttctacaagccccacgaggagcaccacgccttcgagggcggcagaggcaagcactag

SEQ ID NO: 80959 - DNA, 357 bp, Artificial Sequence; identical to SEQ ID NO: 80955
  Description of Artificial Sequence: Synthetic coding sequence

SEQ ID NO: 80960 - DNA, 135 bp, Artificial Sequence
  Description of Artificial Sequence: Synthetic coding sequence
atgagaggcgagagaagacccctgtgggaggaggagagcaacgccaagggcggcgtgtggaagatgaaggtgcccaaggacagcaccagcaccgtgtggaaggagctgctgctggccaccatcggcgagcagtag

SEQ ID NO: 80961 - DNA, 156 bp, Artificial Sequence
  Description of Artificial Sequence: Synthetic coding sequence
atgagaggcgagagaagacccctgtgggaggaggagagcaacgccaagggcggcgtgtggaagatgaaggtgcccaaggacagcaccagcaccgtgtggaaggagctgctgctggccaccatcggcgagcagttcaccgactgcgccgccgcctag

SEQ ID NO: 80962 - DNA, 282 bp, Artificial Sequence
  Description of Artificial Sequence: Synthetic coding sequence
atgagaggcgagagaagacccctgtgggaggaggagagcaacgccaagggcggcgtgtggaagatgaaggtgcccaaggacagcaccagcaccgtgtggaaggagctgctgctggccaccatcggcgagcagttcaccgactgcgccgccgccgacgacgaggtgatcggcgtgagcgtgagcgtgagagacagagaggacgtggtgcaggtgtggaacgtgaacgccagcctggtgggcgaggccaccgtgctggagaagatctacgagctgctgccctag

SEQ ID NO: 80963 - DNA, 2958 bp, Artificial Sequence
  Description of Artificial Sequence: Synthetic coding sequence
atggacagaagaagcatgggcgagaccgagagcggcgacgccttcctggacctgaagaagccccccgccagcaagtgcccccacagatacaccaaggaggagctgctggacatcaaggagctgccccacagcaagcagagacccagctgcctgagcgagaagtacgacagcgacggcgtgtgggaccccgagaagtggcacgccagcctgtaccccgccagcggcagaagcagccccgtggagagcctgaagaaggagctggacaccgacagacccagcctggtgagaagaatcgtggaccccagagagagagtgaaggaggacgacctggacgtggtgctgagcccccagagaagaagcttcggcggcggctgccacgtgaccgccgccgtgagcagcagaagaagcggcagccccctggagaaggacagcgacggcctgagactgctgggcggcagaagaatcggcagcggcagaatcatcagcgccagaaccttcgagaaggaccacagactgagcgacaaggacctgagagacctgagagacagagacagagagagagacttcaaggacaagagattcagaagagagttcggcgacagcaagagagtgttcggcgagagaagaagaaacgacagctacaccgaggaggagcccgagtggttcagcgccggccccaccagccagagcgagaccatcgagctgaccggcttcgacgacaagatcctggaggaggaccacaagggcagaaagagaaccagaagaagaaccgccagcgtgaaggagggcatcgtggagtgcaacggcggcgtggccgaggaggacgaggtggaggtgatcctggcccaggagcccgccgccgaccaggaggtgcccagagacgccgtgctgcccgagcagagccccggcgacttcgacttcaacgagttcttcaacctggacaaggtgccctgcctggccagcatgatcgaggacgtgctgggcgagggcagcgtgagcgccagcagattcagcagatggttcagcaaccccagcagaagcggcagcagaagcagcagcctgggcagcaccccccacgaggagctggagagactggccggcctggagcaggccatcctgagccccggccagaacagcggcaactacttcgcccccatccccctggaggaccacgccgagaacaaggtggacatcctggagatgctgcagaaggccaaggtggacctgaagcccctgctgagcagcctgagcgccaacaaggagaagctgaaggagagcagccacagcggcgtggtgctgagcgtggaggaggtggaggccggcctgaagggcctgaaggtggaccagcaggtgaagaacagcacccccttcatggccgagcacctggaggagaccctgagcgccgtgaccaacaacagacagctgaagaaggacggcgacatgaccgccttcaacaagctggtgagcaccatgaaggccagcggcaccctgcccagccagcccaaggtgagcagaaacctggagagccacctgatgagccccgccgagatccccggccagcccgtgcccaagaacatcctgcaggagctgctgggccagcccgtgcagagacccgccagcagcaacctgctgagcggcctgatgggcagcctggagcccaccaccagcctgctgggccagagagcccccagcccccccctgagccaggtgttccagaccagagccgccagcgccgactacctgagacccagaatccccagccccatcggcttcacccccggcccccagcagctgctgggcgaccccttccagggcatgagaaagcccatgagccccatcaccgcccagatgagccagctggagctgcagcaggccgccctggagggcctggccctgccccacgacctggccgtgcaggccgccaacttctaccagcccggcttcggcaagccccaggtggacagaaccagagacggcttcagaaacagacagcagagagtgaccaagagccccgcccccgtgcacagaggcaacagcagcagccccgcccccgccgccagcatcaccagcatgctgagccccagcttcacccccaccagcgtgatcagaaagatgtacgagagcaaggagaagagcaaggaggagcccgccagcggcaaggccgccctgggcgacagcaaggaggacacccagaaggccagcgaggagaacctgctgagcagcagcagcgtgcccagcgccgacagagacagcagccccaccaccaacagcaagctgagcgccctgcagagaagcagctgcagcacccccctgagccaggccaacagatacaccaaggagcaggactacagacccaaggccaccggcagaaagacccccaccctggccagccccgtgcccaccacccccttcctgagacccgtgcaccaggtgcccctggtgccccacgtgcccatggtgagacccgcccaccagctgcaccccggcctggtgcagagaatgctggcccagggcgtgcacccccagcacctgcccagcctgctgcagaccggcgtgctgccccccggcatggacctgagccacctgcagggcatcagcggccccatcctgggccagcccttctaccccctgcccgccgccagccaccccctgctgaaccccagacccggcacccccctgcacctggccatggtgcagcagcagctgcagagaagcgtgctgcacccccccggcagcggcagccacgccgccgccgtgagcgtgcagaccaccccccagaacgtgcccagcagaagcggcctgccccacatgcacagccagctggagcacagacccagccagagaagcagcagccccgtgggcctggccaagtggttcggcagcgacgtgctgcagcagcccctgcccagcatgcccgccaaggtgatcagcgtggacgagctggagtacagacagtag

SEQ ID NO: 80964 - DNA, 2436 bp, Artificial Sequence
  Description of Artificial Sequence: Synthetic coding sequence
atggacagaagaagcatgggcgagaccgagagcggcgacgccttcctggacctgaagaagccccccgccagcaagtgcccccacagatacaccaaggaggagctgctggacatcaaggagctgccccacagcaagcagagacccagctgcctgagcgagaagtacgacagcgacggcgtgtgggaccccgagaagtggcacgccagcctgtaccccgccagcggcagaagcagccccgtggagagcctgaagaaggagctggacaccgacagacccagcctggtgagaagaatcgtgggcatcgtggagtgcaacggcggcgtggccgaggaggacgaggtggaggtgatcctggcccaggagcccgccgccgaccaggaggtgcccagagacgccgtgctgcccgagcagagccccggcgacttcgacttcaacgagttcttcaacctggacaaggtgccctgcctggccagcatgatcgaggacgtgctgggcgagggcagcgtgagcgccagcagattcagcagatggttcagcaaccccagcagaagcggcagcagaagcagcagcctgggcagcaccccccacgaggagctggagagactggccggcctggagcaggccatcctgagccccggccagaacagcggcaactacttcgcccccatccccctggaggaccacgccgagaacaaggtggacatcctggagatgctgcagaaggccaaggtggacctgaagcccctgctgagcagcctgagcgccaacaaggagaagctgaaggagagcagccacagcggcgtggtgctgagcgtggaggaggtggaggccggcctgaagggcctgaaggtggaccagcaggtgaagaacagcacccccttcatggccgagcacctggaggagaccctgagcgccgtgaccaacaacagacagctgaagaaggacggcgacatgaccgccttcaacaagctggtgagcaccatgaagagaaacctggagagccacctgatgagccccgccgagatccccggccagcccgtgcccaagaacatcctgcaggagctgctgggccagcccgtgcagagacccgccagcagcaacctgctgagcggcctgatgggcagcctggagcccaccaccagcctgctgggccagagagcccccagcccccccctgagccaggtgttccagaccagagccgccagcgccgactacctgagacccagaatccccagccccatcggcttcacccccggcccccagcagctgctgggcgaccccttccagggcatgagaaagcccatgagccccatcaccgcccagcagatgagccagctggagctgcagcaggccgccctggagggcctggccctgccccacgacctggccgtgcaggccgccaacttctaccagcccggcttcggcaagccccaggtggacagaaccagagacggcttcagaaacagacagcagagagtgaccaagagccccgcccccgtgcacagaggcaacagcagcagccccgcccccgccgccagcatcaccagcatgctgagccccagcttcacccccaccagcgtgatcagaaagatgtacgagagcaaggagaagagcaaggaggagcccgccagcggcaaggccgccctgggcgacagcaaggaggacacccagaaggccagcgaggagaacctgctgagcagcagcagcgtgcccagcgccgacagagacagcagccccaccaccaacagcaagctgagcgccctgcagagaagcagctgcagcacccccctgagccaggccaacagatacaccaaggagcaggactacagacccaaggccaccggcagaaagacccccaccctggccagccccgtgcccaccacccccttcctgagacccgtgcaccaggtgcccctggtgccccacgtgcccatggtgagacccgcccaccagctgcaccccggcctggtgcagagaatgctggcccagggcgtgcacccccagcacctgcccagcctgctgcagaccggcgtgctgccccccggcatggacctgagccacctgcagggcatcagcggccccatcctgggccagcccttctaccccctgcccgccgccagccaccccctgctgaaccccagacccggcacccccctgcacctggccatggtgcagcagcagctgcagagaagcgtgctgcacccccccggcagcggcagccacgccgccgccgtgagcgtgcagaccaccccccagaacgtgcccagcagaagcggcctgccccacatgcacagccagctggagcacagacccagccagagaagcagcagccccgtgggcctggccaagtggttcggcagcgacgtgctgcagcagcccctgcccagcatgcccgccaaggtgatcagcgtggacgagctggagtacagacagtag

SEQ ID NO: 80965 - DNA, 1923 bp, Artificial Sequence
  Description of Artificial Sequence: Synthetic coding sequence
atgatcgaggacgtgctgggcgagggcagcgtgagcgccagcagattcagcagatggttcagcaaccccagcagaagcggcagcagaagcagcagcctgggcagcaccccccacgaggagctggagagactggccggcctggagcaggccatcctgagccccggccagaacagcggcaactacttcgcccccatccccctggaggaccacgccgagaacaaggtggacatcctggagatgctgcagaaggccaaggtggacctgaagcccctgctgagcagcctgagcgccaacaaggagaagctgaaggagagcagccacagcggcgtggtgctgagcgtggaggaggtggaggccggcctgaagggcctgaaggtggaccagcaggtgaagaacagcacccccttcatggccgagcacctggaggagaccctgagcgccgtgaccaacaacagacagctgaagaaggacggcgacatgaccgccttcaacaagctggtgagcaccatgaaggccagcggcaccctgcccagccagcccaaggtgagcgagctgctgggccagcccgtgcagagacccgccagcagcaacctgctgagcggcctgatgggcagcctggagcccaccaccagcctgctgggccagagagcccccagcccccccctgagccaggtgttccagaccagagccgccagcgccgactacctgagacccagaatccccagccccatcggcttcacccccggcccccagcagctgctgggcgaccccttccagggcatgagaaagcccatgagccccatcaccgcccagatgagccagctggagctgcagcaggccgccctggagggcctggccctgccccacgacctggccgtgcaggccgccaacttctaccagcccggcttcggcaagccccaggtggacagaaccagagacggcttcagaaacagacagcagagagtgaccaagagccccgcccccgtgcacagaggcaacagcagcagccccgcccccgccgccagcatcaccagcatgctgagccccagcttcacccccaccagcgtgatcagaaagatgtacgagagcaaggagaagagcaaggaggagcccgccagcggcaaggccgccctgggcgacagcaaggaggacacccagaaggccagcgaggagaacctgctgagcagcagcagcgtgcccagcgccgacagagacagcagccccaccaccaacagcaagctgagcgccctgcagagaagcagctgcagcacccccctgagccaggccaacagatacaccaaggagcaggactacagacccaaggccaccggcagaaagacccccaccctggccagccccgtgcccaccacccccttcctgagacccgtgcaccaggtgcccctggtgccccacgtgcccatggtgagacccgcccaccagctgcaccccggcctggtgcagagaatgctggcccagggcgtgcacccccagcacctgcccagcctgctgcagaccggcgtgctgccccccggcatggacctgagccacctgcagggcatcagcggccccatcctgggccagcccttctaccccctgcccgccgccagccaccccctgctgaaccccagacccggcacccccctgcacctggccatggtgcagcagcagctgcagagaagcgtgctgcacccccccggcagcggcagccacgccgccgccgtgagcgtgcagaccaccccccagaacgtgcccagcagaagcggcctgccccacatgcacagccagctggagcacagacccagccagagaagcagcagccccgtgggcctggccaagtggttcggcagcgacgtgctgcagcagcccctgcccagcatgcccgccaaggtgatcagcgtggacgagctggagtacagacagtag

SEQ ID NO: 80966 - DNA, 192 bp, Artificial Sequence
  Description of Artificial Sequence: Synthetic coding sequence
atggacagaagaagcatgggcgagaccgagagcggcgacgccttcctggacctgaagaagccccccgccagcaagtgcccccacagatacaccaaggaggagctgctggacatcaaggagctgccccacagcaagcagagacccagctgcctgagcgagaagtacgacagcgacggcgtgtgggacccctag

SEQ ID NO: 80967 - DNA, 192 bp, Artificial Sequence; identical to SEQ ID NO: 80966
  Description of Artificial Sequence: Synthetic coding sequence

SEQ ID NO: 80968 - DNA, 2886 bp, Artificial Sequence
  Description of Artificial Sequence: Synthetic coding sequence
atggacagaagaagcatgggcgagaccgagagcggcgacgccttcctggacctgaagaagccccccgccagcaagtgcccccacagatacaccaaggaggagctgctggacatcaaggagctgccccacagcaagcagagacccagctgcctgagcgagaagtacgacagcgacggcgtgtgggaccccgagaagtggcacgccagcctgtaccccgccagcggcagaagcagccccgtggagagcctgaagaaggagctggacaccgacagacccagcctggtgagaagaatcgtggaccccagagagagagtgaaggaggacgacctggacgtggtgctgagcccccagagaagaagcttcggcggcggctgccacgtgaccgccgccgtgagcagcagaagaagcggcagccccctggagaaggacagcgacggcctgagactgctgggcggcagaagaatcggcagcggcagaatcatcagcgccagaaccttcgagaaggaccacagactgagcgacaaggacctgagagacctgagagacagagacagagagagagacttcaaggacaagagattcagaagagagttcggcgacagcaagagagtgttcggcgagagaagaagaaacgacagctacaccgaggaggagcccgagtggttcagcgccggccccaccagccagagcgagaccatcgagctgaccggcttcgacgacaagatcctggaggaggaccacaagggcagaaagagaaccagaagaagaaccgccagcgtgaaggagggcatcgtggagtgcaacggcggcgtggccgaggaggacgaggtggaggtgatcctggcccaggagcccgccgccgaccaggaggtgcccagagacgccgtgctgcccgagcagagccccggcgacttcgacttcaacgagttcttcaacctggacaaggtgccctgcctggccagcatgatcgaggacgtgctgggcgagggcagcgtgagcgccagcagattcagcagatggttcagcaaccccagcagaagcggcagcagaagcagcagcctgggcagcaccccccacgaggagctggagagactggccggcctggagcaggccatcctgagccccggccagaacagcggcaactacttcgcccccatccccctggaggaccacgccgagaacaaggtggacatcctggagatgctgcagaaggccaaggtggacctgaagcccctgctgagcagcctgagcgccaacaaggagaagctgaaggagagcagccacagcggcgtggtgctgagcgtggaggaggtggaggccggcctgaagggcctgaaggtggaccagcaggtgaagaacagcacccccttcatggccgagcacctggaggagaccctgagcgccgtgaccaacaacagacagctgaagaaggacggcgacatgaccgccttcaacaagctggtgagcaccatgaaggccagcggcaccctgcccagccagcccaaggtgagcgagctgctgggccagcccgtgcagagacccgccagcagcaacctgctgagcggcctgatgggcagcctggagcccaccaccagcctgctgggccagagagcccccagcccccccctgagccaggtgttccagaccagagccgccagcgccgactacctgagacccagaatccccagccccatcggcttcacccccggcccccagcagctgctgggcgaccccttccagggcatgagaaagcccatgagccccatcaccgcccagatgagccagctggagctgcagcaggccgccctggagggcctggccctgccccacgacctggccgtgcaggccgccaacttctaccagcccggcttcggcaagccccaggtggacagaaccagagacggcttcagaaacagacagcagagagtgaccaagagccccgcccccgtgcacagaggcaacagcagcagccccgcccccgccgccagcatcaccagcatgctgagccccagcttcacccccaccagcgtgatcagaaagatgtacgagagcaaggagaagagcaaggaggagcccgccagcggcaaggccgccctgggcgacagcaaggaggacacccagaaggccagcgaggagaacctgctgagcagcagcagcgtgcccagcgccgacagagacagcagccccaccaccaacagcaagctgagcgccctgcagagaagcagctgcagcacccccctgagccaggccaacagatacaccaaggagcaggactacagacccaaggccaccggcagaaagacccccaccctggccagccccgtgcccaccacccccttcctgagacccgtgcaccaggtgcccctggtgccccacgtgcccatggtgagacccgcccaccagctgcaccccggcctggtgcagagaatgctggcccagggcgtgcacccccagcacctgcccagcctgctgcagaccggcgtgctgccccccggcatggacctgagccacctgcagggcatcagcggccccatcctgggccagcccttctaccccctgcccgccgccagccaccccctgctgaaccccagacccggcacccccctgcacctggccatggtgcagcagcagctgcagagaagcgtgctgcacccccccggcagcggcagccacgccgccgccgtgagcgtgcagaccaccccccagaacgtgcccagcagaagcggcctgccccacatgcacagccagctggagcacagacccagccagagaagcagcagccccgtgggcctggccaagtggttcggcagcgacgtgctgcagcagcccctgcccagcatgcccgccaaggtgatcagcgtggacgagctggagtacagacagtag

SEQ ID NO: 80969 - DNA, 2958 bp, Artificial Sequence; identical to SEQ ID NO: 80963
  Description of Artificial Sequence: Synthetic coding sequence

SEQ ID NO: 80970 - DNA, 1311 bp, Artificial Sequence
  Description of Artificial Sequence: Synthetic coding sequence
atggacagaagaagcatgggcgagaccgagagcggcgacgccttcctggacctgaagaagccccccgccagcaagtgcccccacagatacaccaaggaggagctgctggacatcaaggagctgccccacagcaagcagagacccagctgcctgagcgagaagtacgacagcgacggcgtgtgggaccccgagaagtggcacgccagcctgtaccccgccagcggcagaagcagccccgtggagagcctgaagaaggagctggacaccgacagacccagcctggtgagaagaatcgtggaccccagagagagagtgaaggaggacgacctggacgtggtgctgagcccccagagaagaagcttcggcggcggctgccacgtgaccgccgccgtgagcagcagaagaagcggcagccccctggagaaggacagcgacggcctgagactgctgggcggcagaagaatcggcagcggcagaatcatcagcgccagaaccttcgagaaggaccacagactgagcgacaaggacctgagagacctgagagacagagacagagagagagacttcaaggacaagagattcagaagagagttcggcgacagcaagagagtgttcggcgagagaagaagaaacgacagctacaccgaggaggagcccgagtggttcagcgccggccccaccagccagagcgagaccatcgagctgaccggcttcgacgacaagatcctggaggaggaccacaagggcagaaagagaaccagaagaagaaccgccagcgtgaaggagggcatcgtggagtgcaacggcggcgtggccgaggaggacgaggtggaggtgatcctggcccaggagcccgccgccgaccaggaggtgcccagagacgccgtgctgcccgagcagagccccggcgacttcgacttcaacgagttcttcaacctggacaaggtgccctgcctggccagcatgatcgaggacgtgctgggcgagggcagcgtgagcgccagcagattcagcagatggttcagcaaccccagcagaagcggcagcagaagcagcagcctgggcagcaccccccacgaggagctggagagactggccggcctggagcaggccatcctgagccccggccagaacagcggcaactacttcgcccccatccccctggaggaccacgccgagaacaaggtggacatcctggagatgctgcagaaggccaaggtggacctgaagcccctgctgagcagcctgagcgccaacaaggagaagctgaaggagagcctgagactgagccccaagaagaagaagaagtag

SEQ ID NO: 80971 - DNA, 567 bp, Artificial Sequence
  Description of Artificial Sequence: Synthetic coding sequence
atggacagaagaagcatgggcgagaccgagagcggcgacgccttcctggacctgaagaagccccccgccagcaagtgcccccacagatacaccaaggaggagctgctggacatcaaggagctgccccacagcaagcagagacccagctgcctgagcgagaagtacgacagcgacggcgtgtgggaccccgagaagtggcacgccagcctgtaccccgccagcggcagaagcagccccgtggagagcctgaagaaggagctggacaccgacagacccagcctggtgagaagaatcgtggaccccagagagagagtgaaggaggacgacctggacgtggtgctgagcccccagagaagaagcttcggcggcggctgccacgtgaccgccgccgtgagcagcagaagaagcggcagccccctggagaaggacagcgacggcctgagactgctgggcggcagaagaatcggcagcggcagaatcatcagcgccagaaccttcgagaaggaccacagactgagcgacaaggacctgagagacctgagagacagagacagagagagagactag

SEQ ID NO: 80972 - DNA, 747 bp, Artificial Sequence
  Description of Artificial Sequence: Synthetic coding sequence
atggccgacttcgacacctacgacgacagagcctacagcagcttcggcggcggcagaggcagcagaggcagcgccggcggccacggcagcagaagccagaaggagctgcccaccgagcccccctacaccgcctacgtgggcaacctgcccttcaacaccgtgcagggcgacatcgacgccatcttcaaggacctgagcatcagaagcgtgagactggtgagagacaaggacaccgacaagttcaagggcttctgctacgtggagttcgacgaggtggacagcctgaaggaggccctgacctacgacggcgccctgctgggcgacagaagcctgagagtggacatcgccgagggcagaaagcaggacaagggcggcttcggcttcagaaagggcggccccgacgacagaggcatgggcagcagcagagagagcagaggcggctgggacagcagagacgacttcaacagcggcttcagagacgacttcctgggcggcagaggcggcagcagacccggcgacagaagaaccggcccccccatgggcagcagattcagagacggcccccccctgagaggcagcaacatggacttcagagagcccaccgaggaggagagagcccagagacccagactgcagctgaagcccagaaccgtggccacccccctgaaccaggtggccaaccccaacagcgccatcttcggcggcgccagacccagagaggaggtggtgcagaaggagcaggagtag

SEQ ID NO: 80973 - DNA, 687 bp, Artificial Sequence
  Description of Artificial Sequence: Synthetic coding sequence
atggccgacttcgacacctacgacgacagagcctacagcagcttcggcggcggcagaggcagcagaggcagcgccggcggccacggcagcagaagccagaaggagctgcccaccgagcccccctacaccgcctacgtgggcaacctgcccttcaacaccgtgcagggcgacatcgacgccatcttcaaggacctgagcatcagaagcgtgagactggtgagagacaaggacaccgacaagttcaagggcttctgctacgtggagttcgacgaggtggacagcctgaaggaggccctgacctacgacggcgccctgctgggcgacagaagcctgagagtggacatcgccgagggcagaaagcaggacaagggcggcttcggcttcagaaagggcggccccgacgacagaggcttcagagacgacttcctgggcggcagaggcggcagcagacccggcgacagaagaaccggcccccccatgggcagcagattcagagacggcccccccctgagaggcagcaacatggacttcagagagcccaccgaggaggagagagcccagagacccagactgcagctgaagcccagaaccgtggccacccccctgaaccaggtggccaaccccaacagcgccatcttcggcggcgccagacccagagaggaggtggtgcagaaggagcaggagtag

SEQ ID NO: 80974 - DNA, 1050 bp, Artificial Sequence
  Description of Artificial Sequence: Synthetic coding sequence
atggaggcccacaacgccagcgcccccttcaacttcaccctgccccccaacttcggcaagagacccaccgacctggccctgagcgtgatcctggtgttcatgctgttcttcatcatgctgagcctgggctgcaccatggagttcagcaagatcaaggcccacctgtggaagcccaagggcctggccatcgccctggtggcccagtacggcatcatgcccctgaccgccttcgtgctgggcaaggtgttcagactgaagaacatcgaggccctggccatcctggtgtgcggctgcagccccggcggcaacctgagcaacgtgttcagcctggccatgaagggcgacatgaacctgagcatcgtgatgaccacctgcagcaccttctgcgccctgggcatgatgcccctgctgctgtacatctacagcagaggcatctacgacggcgacctgaaggacaaggtgccctacaagggcatcgtgatcagcctggtgctggtgctgatcccctgcaccatcggcatcgtgctgaagagcaagagaccccagtacatgagatacgtgatcaagggcggcatgatcatcatcctgctgtgcagcgtggccgtgaccgtgctgagcgccatcaacgtgggcaagagcatcatgttcgccatgacccccctgctgatcgccaccagcagcctgatgcccttcatcggcttcctgctgggctacgtgctgagcgccctgttctgcctgaacggcagatgcagaagaaccgtgagcatggagaccggctgccagaacgtgcagctgtgcagcaccatcctgaacgtggccttcccccccgaggtgatcggccccctgttcttcttccccctgctgtacatgatcttccagctgggcgagggcctgctgctgatcgccatcttctggtgctacgagaagttcaagacccccaaggacaagaccaagatgatctacaccgccgccaccaccgaggagaccatccccggcgccctgggcaacggcacctacaagggcgaggactgcagcccctgcaccgcctag

SEQ ID NO: 80975 - DNA, 1296 bp, Artificial Sequence
  Description of Artificial Sequence: Synthetic coding sequence
atgagcgtgaacgtgaacagaagcgtgagcgaccagttctacagatacaagatgcccagactgatcgccaaggtggagggcaagggcaacggcatcaagaccgtgatcgtgaacatggtggacgtggccaaggccctgaacagaccccccacctaccccaccaagtacttcggctgcgagctgggcgcccagacccagttcgacgtgaagaacgacagatacatcgtgaacggcagccacgaggccaacaagctgcaggacatgctggacggcttcatcaagaagttcgtgctgtgccccgagtgcgagaaccccgagaccgacctgcacgtgaaccccaagaagcagaccatcggcaacagctgcaaggcctgcggctacagaggcatgctggacacccaccacaagctgtgcaccttcatcctgaagaacccccccgagaacagcgacagcggcaccggcaagaaggagaaggagaagaagaacagaaagggcaaggacaaggagaacggcagcgtgagcagcagcgagacccccccccccccccccccccccaacgagatcaacccccccccccacaccatggaggaggaggaggacgacgactggggcgaggacaccaccgaggaggcccagagaagaagaatggacgagatcagcgaccacgccaaggtgctgaccctgagcgacgacctggagagaaccatcgaggagagagtgaacatcctgttcgacttcgtgaagaagaagaaggaggagggcgtgatcgacagcagcgacaaggagatcgtggccgaggccgagagactggacgtgaaggccatgggccccctggtgctgaccgaggtgctgttcaacgagaagatcagagagcagatcaagaagtacagaagacacttcctgagattctgccacaacaacaagaaggcccagagatacctgctgcacggcctggagtgcgtggtggccatgcaccaggcccagctgatcagcaagatcccccacatcctgaaggagatgtacgacgccgacctgctggaggaggaggtgatcatcagctggagcgagaaggccagcaagaagtacgtgagcaaggagctggccaaggagatcagagtgaaggccgagcccttcatcaagtggctgaaggaggccgaggaggagagcagcggcggcgaggaggaggacgaggacgagaacatcgaggtggtgtacagcaaggccgccagcgtgcccaaggtggagaccgtgaagagcgacaacaaggacgacgacatcgacatcgacgccatctag

SEQ ID NO: 80976 - DNA, 603 bp, Artificial Sequence
  Description of Artificial Sequence: Synthetic coding sequence
atgagcgtgaacgtgaacagaagcgtgagcgaccagttctacagatacaagatgcccagactgatcgccaaggtggagggcaagggcaacggcatcaagaccgtgatcgtgaacatggtggacgtggccaaggccctgaacagaccccccacctaccccaccaagtacttcggctgcgagctgggcgcccagacccagttcgacgtgaagaacgacagatacatcgtgaacggcagccacgaggccaacaagctgcaggacatgctggacggcttcatcaagaagttcgtgctgtgccccgagtgcgagaaccccgagaccgacctgcacgtgaaccccaagaagcagaccatcggcaacagctgcaaggcctgcggctacagaggcatgctggacacccaccacaagctgtgcaccttcatcctgaagaacccccccgagaacagcgacagcggcaccggcaagaaggagaaggagaagaagaacagaaagggcaaggacaaggagaacggcagcgtgagcagcagcgagacccccccccccccccccccccccaacgagatcaacccccccccccacaccatggaggaggaggaggactag

SEQ ID NO: 80977 - DNA, 441 bp, Artificial Sequence
  Description of Artificial Sequence: Synthetic coding sequence
atgagcgtgaacgtgaacagaagcgtgagcgaccagttctacagatacaagatgcccagactgatcgccaaggtggagggcaagggcaacggcatcaagaccgtgatcgtgaacatggtggacgtggccaaggccctgaacagaccccccacctaccccaccaagtacttcggctgcgagctgggcgcccagacccagttcgacgtgaagaacgacagatacatcgtgaacggcagccacgaggccaacaagctgcaggacatgctggacggcttcatcaagaagttcgtgctgtgccccgagtgcgagaaccccgagaccgacctgcacgtgaaccccaagaagcagaccatcggcaacagctgcaaggcctgcggctacagaggcatgctggacacccaccacaagctgtgcaccttcatcctgaagaaccccccctag

SEQ ID NO: 80978 - DNA, 1296 bp, Artificial Sequence; identical to SEQ ID NO: 80975
  Description of Artificial Sequence: Synthetic coding sequence

SEQ ID NO: 80979 - DNA, 210 bp, Artificial Sequence
  Description of Artificial Sequence: Synthetic coding sequence
atgagcgtgaacgtgaacagaagcgtgagcgaccagttctacagatacaagatgcccagactgatcgccaaggtggagggcaagggcaacggcatcaagaccgtgatcgtgaacatggtggacgtggccaaggccctgaacagaccccccacctaccccaccaagtacttcggctgcgagctgggcgcccagacccagttcgacgtgtag

SEQ ID NO: 80980 - DNA, 330 bp, Artificial Sequence
  Description of Artificial Sequence: Synthetic coding sequence
atgagcgtgaacgtgaacagaagcgtgagcgaccagttctacagatacaagatgcccagactgatcgccaaggtggagggcaagggcaacggcatcaagaccgtgatcgtgaacatggtggacgtggccaaggccctgaacagaccccccacctaccccaccaagtacttcggctgcgagctgggcgcccagacccagttcgacgtgaagaacgacagatacatcgtgaacggcagccacgaggccaacaagctgcaggacatgctggacggcttcatcaagaagttcgtgctgtgccccgagtgcgagaaccccgagaccgacctgtag

SEQ ID NO: 80981 - DNA, 306 bp, Artificial Sequence
  Description of Artificial Sequence: Synthetic coding sequence
atgagcgtgaacgtgaacagaagcgtgagcgaccagttctacagatacaagatgcccagactgatcgccaaggtggagggcaagggcaacggcatcaagaccgtgatcgtgaacatggtggacgtggccaaggccctgaacagaccccccacctaccccaccaagtacttcggctgcgagctgggcgcccagacccagttcgacgtgaagaacgacagatacatcgtgaacggcagccacgaggccaacaagctgcaggacatgctggacggcttcatcaagaagttcgtgctgtgccccgagtag

SEQ ID NO: 80982 - DNA, 156 bp, Artificial Sequence
  Description of Artificial Sequence: Synthetic coding sequence
atgagcgtgaacgtgaacagaagcgtgagcgaccagttctacagatacaagatgcccagactgatcgccaaggtggagggcaagggcaacggcatcaagaccgtgatcgtgaacatggtggacgtggccaaggccctgaacagaccccccacctag

SEQ ID NO: 80983 - DNA, 330 bp, Artificial Sequence; identical to SEQ ID NO: 80980
  Description of Artificial Sequence: Synthetic coding sequence

SEQ ID NO: 80984 - DNA, 555 bp, Artificial Sequence
  Description of Artificial Sequence: Synthetic coding sequence
atgtgcggcaccggcggcaccgacagcaagaccagaagacccccccacagagccagcttcctgaagagactggagagcaagcccctgaagatggccgacgacctggacttcgagaccggcgacgccggcgccagcgccaccttccccatgcagtgcagcgccctgagaaagaacggcttcgtggtgctgaagggcagaccctgcaagatcgtggagatgagcaccagcaagaccggcaagcacggccacgccaaggtgcacctggtgggcatcgacatcttcaccggcaagaagtacgaggacatctgccccagcacccacaacatggacgtgcccaacatcaagagaaacgacttccagctgatcggcatccaggacggctacctgagcctgctgcaggacagcggcgaggtgagagaggacctgagactgcccgagggcgacctgggcaaggagatcgagcagaagtacgactgcggcgaggagatcctgatcaccgtgctgagcgccatgaccgaggaggccgccgtggccatcaaggccatggccaagtag

SEQ ID NO: 80985 - DNA, 465 bp, Artificial Sequence
  Description of Artificial Sequence: Synthetic coding sequence
atggccgacgacctggacttcgagaccggcgacgccggcgccagcgccaccttccccatgcagtgcagcgccctgagaaagaacggcttcgtggtgctgaagggcagaccctgcaagatcgtggagatgagcaccagcaagaccggcaagcacggccacgccaaggtgcacctggtgggcatcgacatcttcaccggcaagaagtacgaggacatctgccccagcacccacaacatggacgtgcccaacatcaagagaaacgacttccagctgatcggcatccaggacggctacctgagcctgctgcaggacagcggcgaggtgagagaggacctgagactgcccgagggcgacctgggcaaggagatcgagcagaagtacgactgcggcgaggagatcctgatcaccgtgctgagcgccatgaccgaggaggccgccgtggccatcaaggccatggccaagtag

SEQ ID NO: 80986 - DNA, 645 bp, Artificial Sequence
  Description of Artificial Sequence: Synthetic coding sequence
atgacctggaccagcagacaggagatgcagggcccccagccccccagccagtgcagcgcccagcactacgtgagaatggccctgtggtgcagcaaggccggccacgtgagaagcagcagatgcctgctgagaagactggccagcaccgccacccccagactggagttccacctgagaatcctgcccagcccctgcctgcagtacctgtggagaagccagcagcaggccgccaacagcgccgacttccccctgaccctgctgctgctgagcgactgcttctgcctggccctgagcctgcacacccacagcgacaactacacctgcagccccgtgttcagcctgttctgcggctaccccagcgtgcccgccagcttcagcggcagccccagcgtgagccccgccctgtgccagagcctgcagttcatcggcctgtacgccctggccatccagctgctgctgccctacagctggttcagcctgttcctgagcagcctggagcccctgctgagcggctgcttccaccacgtggcccagggcttcagcaacagcacccccagccccggcggcacccccgccagcatcctgagcttccaggtgaccctgctgctgagaagccccgtgctggccttccccctggagctgtag

SEQ ID NO: 80987 - DNA, 465 bp, Artificial Sequence; identical to SEQ ID NO: 80985
  Description of Artificial Sequence: Synthetic coding sequence

SEQ ID NO: 80988 - DNA, 465 bp, Artificial Sequence; identical to SEQ ID NO: 80985
  Description of Artificial Sequence: Synthetic coding sequence

SEQ ID NO: 80989 - DNA, 462 bp, Artificial Sequence
  Description of Artificial Sequence: Synthetic coding sequence
atggccgacgagatcgacttcaccaccggcgacgccggcgccagcagcacctaccccatgcagtgcagcgccctgagaaagaacggcttcgtggtgctgaagggcagaccctgcaagatcgtggagatgagcaccagcaagaccggcaagcacggccacgccaaggtgcacctggtgggcatcgacatcttcaccggcaagaagtacgaggacatctgccccagcacccacaacatggacgtgcccaacatcaagagaaacgactaccagctgatctgcatccaggacggctacctgagcctgctgaccgagaccggcgaggtgagagaggacctgaagctgcccgagggcgagctgggcaaggagatcgagggcaagtacaacgccggcgaggacgtgcaggtgagcgtgatgtgcgccatgagcgaggagtacgccgtggccatcaagccctgcaagtag

SEQ ID NO: 80990 - DNA, 738 bp, Artificial Sequence
  Description of Artificial Sequence: Synthetic coding sequence
atggccgtgagagccagcttcgagaacaactgcgagatcggctgcttcgccaagctgaccaacacctactgcctggtggccatcggcggcagcgagaacttctacagcgtgttcgagggcgagctgagcgacaccatccccgtggtgcacgccagcatcgccggctgcagaatcatcggcagaatgtgcgtgggcaacagacacggcctgctggtgcccaacaacaccaccgaccaggagctgcagcacatcagaaacagcctgcccgacaccgtgcagatcagaagagtggaggagagactgagcgccctgggcaacgtgaccacctgcaacgactacgtggccctggtgcaccccgacctggacagagagaccgaggagatcctggccgacgtgctgaaggtggaggtgttcagacagaccgtggccgaccaggtgctggtgggcagctactgcgtgttcagcaaccagggcggcctggtgcaccccaagaccagcatcgaggaccaggacgagctgagcagcctgctgcaggtgcccctggtggccggcaccgtgaacagaggcagcgaggtgatcgccgccggcatggtggtgaacgactggtgcgccttctgcggcctggacaccaccagcaccgagctgagcgtggtggagagcgtgttcaagctgaacgaggcccagcccagcaccatcgccaccagcatgagagacagcctgatcgacagcctgacctag

SEQ ID NO: 80991 - DNA, 681 bp, Artificial Sequence
  Description of Artificial Sequence: Synthetic coding sequence
atggccgtgagagccagcttcgagaacaactgcgagatcggctgcttcgccaagctgaccaacacctactgcctggtggccatcggcggcagcgagaacttctacagatgcggcggcagccccggcgcctacggcggcggcgaggcctgcgccggcgtgaagagcagcggcagcggcagagtgcccgcccccctgcccagacaccacagagtgcacgtgcccaccgtgtgcagcagagccagcagccccatccccagcccctggtgcaccagactgagccccgccgccgccagcagcggcgcctgcgtgtgggagaccgaggagatcctggccgacgtgctgaaggtggaggtgttcagacagaccgtggccgaccaggtgctggtgggcagctactgcgtgttcagcaaccagggcggcctggtgcaccccaagaccagcatcgaggaccaggacgagctgagcagcctgctgcaggtgcccctggtggccggcaccgtgaacagaggcagcgaggtgatcgccgccggcatggtggtgaacgactggtgcgccttctgcggcctggacaccaccagcaccgagctgagcgtggtggagagcgtgttcaagctgaacgaggcccagcccagcaccatcgccaccagcatgagagacagcctgatcgacagcctgacctag

SEQ ID NO: 80992 - DNA, 738 bp, Artificial Sequence; identical to SEQ ID NO: 80990
  Description of Artificial Sequence: Synthetic coding sequence

SEQ ID NO: 80993 - DNA, 327 bp, Artificial Sequence
  Description of Artificial Sequence: Synthetic coding sequence
atggccgtgagagccagcttcgagaacaactgcgagatcggctgcttcgccaagctgaccaacacctactgcctggtggccatcggcggcagcgagaacttctacagcgtgttcgagggcgagctgagcgacaccatccccgtggtgcacgccagcatcgccggctgcagaatcatcggcagaatgtgcgtgggcaacagacacggcctgctggtgcccaacaacaccaccgaccaggagctgcagcacatcagaaacagcctgcccgacaccgtgcagatcagaagagtggaggagagactgagcgccctgggcaacgtgacctag

SEQ ID NO: 80994 - DNA, 1314 bp, Artificial Sequence
  Description of Artificial Sequence: Synthetic coding sequence
atggccgacgaccccagcgccgccgacagaaacgtggagatctggaagatcaagaagctgatcaagagcctggaggccgccagaggcaacggcaccagcatgatcagcctgatcatcccccccaaggaccagatcagcagagtggccaagatgctggccgacgagttcggcaccgccagcaacatcaagagcagagtgaacagactgagcgtgctgggcgccatcaccagcgtgcagcagagactgaagctgtacaacaaggtgccccccaacggcctggtggtgtactgcggcaccatcgtgaccgaggagggcaaggagaagaaggtgaacatcgacttcgagcccttcaagcccatcaacaccagcctgtacctgtgcgacaacaagttccacaccgaggccctgaccgccctgctgagcgacgacagcaagttcggcttcatcgtgatcgacggcagcggcgccctgttcggcaccctgcagggcaacaccagagaggtgctgcacaagttcaccgtggacctgcccaagaagcacggcagaggcggccagagcgccctgagattcgccagactgagaatggagaagagacacaactacgtgagaaaggtggccgagaccgccgtgcagctgttcatcagcggcgacaaggtgaacgtggccggcctggtgctggccggcagcgccgacttcaagaccgagctgagccagagcgacatgttcgaccagagactgcagagcaaggtgctgaagctggtggacatcagctacggcggcgagaacggcttcaaccaggccatcgagctgagcaccgaggtgctgagcaacgtgaagttcatccaggagaagaagctgatcggcagatacttcgacgagatcagccaggacaccggcaagtactgcttcggcgtggaggacaccctgaaggccctggagatgggcgccgtggagatcctgatcgtgtacgagaacctggacatcatgagatacgtgctgcactgccagggcaccgaggaggagaagatcctgtacctgacccccgagcaggagaaggacaagagccacttcaccgacaaggagaccggccaggagcacgagctgatcgagagcatgcccctgctggagtggttcgccaacaactacaagaagttcggcgccaccctggagatcgtgaccgacaagagccaggagggcagccagttcgtgaagggcttcggcggcatcggcggcatcctgagatacagagtggacttccagggcatggagtaccagggcggcgacgacgagttcttcgacctggacgactactag

SEQ ID NO: 80995 - DNA, 1215 bp, Artificial Sequence
  Description of Artificial Sequence: Synthetic coding sequence
atgatcagcctgatcatcccccccaaggaccagatcagcagagtggccaagatgctggccgacgagttcggcaccgccagcaacatcaagagcagagtgaacagactgagcgtgctgggcgccatcaccagcgtgcagcagagactgaagctgtacaacaaggtgccccccaacggcctggtggtgtactgcggcaccatcgtgaccgaggagggcaaggagaagaaggtgaacatcgacttcgagcccttcaagcccatcaacaccagcctgtacctgtgcgacaacaagttccacaccgaggccctgaccgccctgctgagcgacgacagcaagttcggcttcatcgtgatcgacggcagcggcgccctgttcggcaccctgcagggcaacaccagagaggtgctgcacaagttcaccgtggacctgcccaagaagcacggcagaggcggccagagcgccctgagattcgccagactgagaatggagaagagacacaactacgtgagaaaggtggccgagaccgccgtgcagctgttcatcagcggcgacaaggtgaacgtggccggcctggtgctggccggcagcgccgacttcaagaccgagctgagccagagcgacatgttcgaccagagactgcagagcaaggtgctgaagctggtggacatcagctacggcggcgagaacggcttcaaccaggccatcgagctgagcaccgaggtgctgagcaacgtgaagttcatccaggagaagaagctgatcggcagatacttcgacgagatcagccaggacaccggcaagtactgcttcggcgtggaggacaccctgaaggccctggagatgggcgccgtggagatcctgatcgtgtacgagaacctggacatcatgagatacgtgctgcactgccagggcaccgaggaggagaagatcctgtacctgacccccgagcaggagaaggacaagagccacttcaccgacaaggagaccggccaggagcacgagctgatcgagagcatgcccctgctggagtggttcgccaacaactacaagaagttcggcgccaccctggagatcgtgaccgacaagagccaggagggcagccagttcgtgaagggcttcggcggcatcggcggcatcctgagatacagagtggacttccagggcatggagtaccagggcggcgacgacgagttcttcgacctggacgactactag

SEQ ID NO: 80996 - DNA, 1272 bp, Artificial Sequence
  Description of Artificial Sequence: Synthetic coding sequence
atgaagcaggacgtgctgaactgcaccgagggccccatccacagcaacggcaccagcatgatcagcctgatcatcccccccaaggaccagatcagcagagtggccaagatgctggccgacgagttcggcaccgccagcaacatcaagagcagagtgaacagactgagcgtgctgggcgccatcaccagcgtgcagcagagactgaagctgtacaacaaggtgccccccaacggcctggtggtgtactgcggcaccatcgtgaccgaggagggcaaggagaagaaggtgaacatcgacttcgagcccttcaagcccatcaacaccagcctgtacctgtgcgacaacaagttccacaccgaggccctgaccgccctgctgagcgacgacagcaagttcggcttcatcgtgatcgacggcagcggcgccctgttcggcaccctgcagggcaacaccagagaggtgctgcacaagttcaccgtggacctgcccaagaagcacggcagaggcggccagagcgccctgagattcgccagactgagaatggagaagagacacaactacgtgagaaaggtggccgagaccgccgtgcagctgttcatcagcggcgacaaggtgaacgtggccggcctggtgctggccggcagcgccgacttcaagaccgagctgagccagagcgacatgttcgaccagagactgcagagcaaggtgctgaagctggtggacatcagctacggcggcgagaacggcttcaaccaggccatcgagctgagcaccgaggtgctgagcaacgtgaagttcatccaggagaagaagctgatcggcagatacttcgacgagatcagccaggacaccggcaagtactgcttcggcgtggaggacaccctgaaggccctggagatgggcgccgtggagatcctgatcgtgtacgagaacctggacatcatgagatacgtgctgcactgccagggcaccgaggaggagaagatcctgtacctgacccccgagcaggagaaggacaagagccacttcaccgacaaggagaccggccaggagcacgagctgatcgagagcatgcccctgctggagtggttcgccaacaactacaagaagttcggcgccaccctggagatcgtgaccgacaagagccaggagggcagccagttcgtgaagggcttcggcggcatcggcggcatcctgagatacagagtggacttccagggcatggagtaccagggcggcgacgacgagttcttcgacctggacgactactag

SEQ ID NO: 80997 - DNA, 1224 bp, Artificial Sequence
  Description of Artificial Sequence: Synthetic coding sequence
atggagagcagaaaggacatggtggtgttcctggacggcggccagctgggcaccctggtgggcaagagagtgagcaacctgagcgaggccgtgggcagccccctgcccgagccccccgagaagatggtgcccagaggctgcctgagccccagagccgtgccccccgccaccagagagagaggcggcggcggccccgaggaggagcccgtggacggcctggccggcagcgccgccggccccggcgccgagccccaggtggccggcgccgccatgctgggccccggcccccccgcccccagcgtggacagcctgagcggccagggccagcccagcagcagcgacaccgagagcgacttctacgaggagatcgaggtgagctgcacccccgactgcgccaccggcaacgccgagtaccagcacagcaagggcagcggcagcgaggccctggtgggcagccccaacggcggcagcgagacccccaagagcaacggcggcagcggcggcggcggcagccagggcaccctggcctgcagcgccagcgaccagatgagaagatacagaaccgccttcaccagagagcagatcgccagactggagaaggagttctacagagagaactacgtgagcagacccagaagatgcgagctggccgccgccctgaacctgcccgagaccaccatcaaggtgtggttccagaacagaagaatgaaggacaagagacagagactggccatgacctggccccaccccgccgaccccgccttctacacctacatgatgagccacgccgccgccgccggcggcctgccctaccccttccccagccacctgcccctgccctactacagccccgtgggcctgggcgccgccagcgccgccagcgccgccgccagccccttcagcggcagcctgagacccctggacaccttcagagtgctgagccagccctaccccagacccgagctgctgtgcgccttcagacacccccccctgtaccccggccccgcccacggcctgggcgccagcgccggcggcccctgcagctgcctggcctgccacagcggccccgccaacggcctggcccccagagccgccgccgccagcgacttcacctgcgccagcaccagcagaagcgacagcttcctgaccttcgcccccagcgtgctgagcaaggccagcagcgtggccctggaccagagagaggaggtgcccctgaccagatag

SEQ ID NO: 80998 - DNA, 678 bp, Artificial Sequence
  Description of Artificial Sequence: Synthetic coding sequence
atgagaagatacagaaccgccttcaccagagagcagatcgccagactggagaaggagttctacagagagaactacgtgagcagacccagaagatgcgagctggccgccgccctgaacctgcccgagaccaccatcaaggtgtggttccagaacagaagaatgaaggacaagagacagagactggccatgacctggccccaccccgccgaccccgccttctacacctacatgatgagccacgccgccgccgccggcggcctgccctaccccttccccagccacctgcccctgccctactacagccccgtgggcctgggcgccgccagcgccgccagcgccgccgccagccccttcagcggcagcctgagacccctggacaccttcagagtgctgagccagccctaccccagacccgagctgctgtgcgccttcagacacccccccctgtaccccggccccgcccacggcctgggcgccagcgccggcggcccctgcagctgcctggcctgccacagcggccccgccaacggcctggcccccagagccgccgccgccagcgacttcacctgcgccagcaccagcagaagcgacagcttcctgaccttcgcccccagcgtgctgagcaaggccagcagcgtggccctggaccagagagaggaggtgcccctgaccagatag

SEQ ID NO: 80999 - DNA, 1431 bp, Artificial Sequence
  Description of Artificial Sequence: Synthetic coding sequence
atgatggagagaatcagaaaggagatgatcctgatggagagaggcctgcacagccccaccgccggcaagagattcagcaacctgagcaacagcgccggcaacgccgtgctggaggccctggagaacagccagcaccccgccagactgagccccagactgcccagcgcccccctgcacagcgccctgggcgagctgcccgccaagggcaagttcgagatcgacaccctgttcaacctgcagcacaccggcagcgagagcaccgtgagcagcgagatcagcagcgccgccgagagcagaaagaagcccggccactacagcgaggccgccgccgaggccgacatgagcagcgacgtggaggtgggctgcagcgccctgagaagccccggcggcctgggcgccgcccagctgaaggagaacaacggcaagggctacgccgagagcggcagcgccgccggcaccaccaccagcgccagcggcagcggcctgggcagcctgcacggcggcagcggcggcagcggcggcagcgccgccctgggcggcagcggcagcggcgccgaccaggtgagaagatacagaaccgccttcaccagagagcagatcgccagactggagaaggagttctacagagagaactacgtgagcagacccagaagatgcgagctggccgccgccctgaacctgcccgagaccaccatcaaggtgtggttccagaacagaagaatgaaggacaagagacagagactggccatgagctggccccaccccgccgaccccagcttctacacctacatgatgacccacgccgccgccaccggcagcctgccctaccccttccacagccacgtgcccctgcactactacccccacgtgggcgtgaccgccgccgccgccgccgccgccgccagcggcgccgccgccgccgccagcagccccttcgccaccagcatcagacccctggacaccttcagagccctgagccacccctacagcagacccgagctgctgtgcagcttcagacaccccggcctgtaccaggcccccgccgccgccgccggcctgaacagcgccgccagcgccgccgccgccgccgccgccgccgccgccgccgccagcagcgccgccgccgccggcgccccccccagcggcggcagcgccccctgcagctgcctgagctgccacagcagccagagcgccgccgccgccgccgccgccgccgccgccgccctgggcagcagaggcggcggcggcggcggcggcggcggcggcggcggcggcggcggcggcgccggcgccggcggcggcagcgacttcggctgcagcgccgccgcccccagaagcgagagcggcttcctgccctacagcgccgccgtgctgagcaagaccgccgtgagcccccccgaccagagagacgaggcccccctgaccagatag

SEQ ID NO: 81000 - DNA, 2781 bp, Artificial Sequence
  Description of Artificial Sequence: Synthetic coding sequence
atgagcagaagaagaaagcacgacgacagccccagccccaagaagaccccccacaagaccgtggccgccgaggagtgcggcagcgtggtggagcccggcagaagaagactgagaagcgccagaggcagctggccctgcggcgccagagagggcccccccggccccgtgagacagagagagcagccccccaccgccgccctgtgcagcaagagcaaccccgaggagagatacgagacccccaagagagccctgaagatggacagcctgagcagcagcttcagcagccccaacgaccccgacggccagaacgacatcttctgggaccagaacagccccctgaccaagcagctgggcaagggcagaaagaagcagatctacaccaccgacagcgacgagatcagccacatcgtgaacagaatcgccccccaggacgagaagcccaccaccaacagcatgctggacatgtggatcggcgagaccgccatcccctgcacccccagcgtggccaagggcaagagcagagccaagatcagctgcaccaagctgaagacccagagccaggaggaggagctgatgaagctggccaagcagttcgacaagaacatggaggagctggacgtgatccaggagcagaacaagagaaactacgacttcacccagatgatcagcgagaccgagatcctgagcaactacaaggacaacatccagatgtggagcctgcacaacatcgtgcccgagatcgacaacgccaccaagaagcccatcaagggcaacaccaagatcagcgtggccaacaaccagaacagcagccagaagcccttcgaccagatcgccgaggccgccttcaacgccatcttcgacggcagcacccagaagtgcagcggccagctgagccaggagctgcccgaggccttctggagcaccagcaacaccaccttcgtgaagaccaacgccctgaaggaggagaagatcatcaccaacgagaccctggtgatcgagaagctgagcaacaagacccccagaagcctgagcagccaggtggacacccccatcatgaccaagagctgcgtgaccagctgcaccaaggagcccgagaccagcaacaagtacatcgacgccttcaccaccagcgacttcgaggacgactgggagaacctgctgggcagcgagcccttcgccatgcagaacatcgacatgcccgagctgttccccagcaagaccgcccacgtgaccgaccagaaggagatctgcaccttcaacagcaagaccgtgaagaacaccagcagagccaacaccagccccgacgccagactgggcgacagcaaggtgctgcaggacctgagcagcaagacctacgacagagagctgatcgacgccgagtacagattcagccccaacagcaacaagagcaacaagctgagcaccggcaacaagatgaagttcgagaacagcagcaacaagatcgtgatccaggacgagatccagaactgcatcgtgaccagcaacctgaccaagatcaaggaggacatcctgaccaacagcaccgaggccagcgagagaaagagcgccctgaacaccagatacagcaacgagcagaagaacaagtgcatcctgaaccagagcatcaaggcccccgtgaacaccgacctgttcggcagcgccaacctgggcagcaagaccagcgtgagcaaccccaaccagaccagcgccagcaaggtgggcagcttcttcgacgactggaacgaccccagcttcgccaacgagatcatcaaggcctgccaccagctggacaacacctgggaggccgacgacgtggacgacgacctgctgtaccaggcctgcgacgacatcgagagactgacccagcagcaggacatcagaaaggacagcaagaccagcgagagcatctgcgagatcaacaacaacagcgagcacggcgccaagctgacccagcagcaggacatcagaaaggacagcaagaccagcgagagcatctgcgagatcaacaacaacagcgagcacggcgccaagaacatgttcgccatcagcaagcagggcagcaacctggtgcagagcaagcacctgaaccccggcagcatcagcgtgcagaccagcctgaccaacagcagccagatcgacaagcccatgaagatggagaagggcgagatgtacggcaacagccccagattcctgggcgccaccaacctgaccatgtacagcaagatcagcaactgccagatcaacaacctgcacgtgagctacaccaacaccgacgtgcccatccaggtgaacagcagcaagctggtgctgcccggcagcagcagcctgaacgtgaccagcgaccacatgaacaccgagatcaccacctacaagaagaagctgagcaccaaccagccctgccacaagaccgtgaccgacgaggcccagagcaacctgaacaccaccgtgggcttcagcaagttcaccttcaccagaatgaagaacagccagatcctgagccagttcaaccagaactgcatcaccggcagcatgagcgacaccaagatcacccagggcgtggagaagaagaagggcgtgaaccccctgctggaggaggccgtgggccagcagagcctggtgaagctgagcgagagcctgaagcagagcagcaaggaggaggaggagaagaacagaaagtgcagccccgaggagatccagagaaagagacaggaggccctggtgagaagaatggccaaggccagagccagcagcgtgaacgccgcccccaccagcttcctgtag

SEQ ID NO: 81001 - DNA, 2349 bp, Artificial Sequence
  Description of Artificial Sequence: Synthetic coding sequence
atgggcaagagagacagagccgacagagacaagaagaagagcagaaagagacactacgaggacgaggaggacgacgaggaggacgcccccggcaacgacccccaggaggccgtgcccagcgccgccggcaagcaggtggacgagagcggcaccaaggtggacgagtacggcgccaaggactacagactgcagatgcccctgaaggacgaccacaccagcagacccctgtgggtggcccccgacggccacatcttcctggaggccttcagccccgtgtacaagtacgcccaggacttcctggtggccatcgccgagcccgtgtgcagacccacccacgtgcacgagtacaagctgaccgcctacagcctgtacgccgccgtgagcgtgggcctgcagaccagcgacatcaccgagtacctgagaaagctgagcaagaccggcgtgcccgacggcatcatgcagttcatcaagctgtgcaccgtgagctacggcaaggtgaagctggtgctgaagcacaacagatacttcgtggagagctgccaccccgacgtgatccagcacctgctgcaggaccccgtgatcagagagtgcagactgagaaacagcgagggcgaggccaccgagctgatcaccgagaccttcaccagcaagagcgccatcagcaagaccgccgagagcagcggcggccccagcaccagcagagtgaccgacccccagggcaagagcgacatccccatggacctgttcgacttctacgagcagatggacaaggacgaggaggaggaggaggagacccagaccgtgagcttcgaggtgaagcaggagatgatcgaggagctgcagaagagatgcatccacctggagtaccccctgctggccgagtacgacttcagaaacgacagcgtgaaccccgacatcaacatcgacctgaagcccaccgccgtgctgagaccctaccaggagaagagcctgagaaagatgttcggcaacggcagagccagaagcggcgtgatcgtgctgccctgcggcgccggcaagagcctggtgggcgtgaccgccgcctgcaccgtgagaaagagatgcctggtgctgggcaacagcgccgtgagcgtggagcagtggaaggcccagttcaagatgtggagcaccatcgacgacagccagatctgcagattcaccagcgacgccaaggacaagcccatcggctgcagcgtggccatcagcacctacagcatgctgggccacaccaccaagagaagctgggaggccgagagagtgatggagtggctgaagacccaggagtggggcctgatgatcctggacgaggtgcacaccatccccgccaagatgttcagaagagtgctgaccatcgtgcaggcccactgcaagctgggcctgaccgccaccctggtgagagaggacgacaagatcgtggacctgaacttcctgatcggccccaagctgtacgaggccaactggatggagctgcagaacaacggctacatcgccaaggtgcagtgcgccgaggtgtggtgccccatgagccccgagttctacagagagtacgtggccatcaagaccaagaagagaatcctgctgtacaccatgaaccccaacaagttcagagcctgccagttcctgatcaagttccacgagagaagaaacgacaagatcatcgtgttcgccgacaacgtgttcgccctgaaggagtacgccatcagactgaacaagccctacatctacggccccaccagccagggcgagagaatgcagatcctgcagaacttcaagcacaaccccaagatcaacaccatcttcatcagcaaggtgggcgacaccagcttcgacctgcccgaggccaacgtgctgatccagatcagcagccacggcggcagcagaagacaggaggcccagagactgggcagagtgctgagagccaagaagggcatggtggccgaggagtacaacgccttcttctacagcctggtgagccaggacacccaggagatggcctacagcaccaagagacagagattcctggtggaccagggctacagcttcaaggtgatcaccaagctggccggcatggaggaggaggacctggccttcagcaccaaggaggagcagcagcagctgctgcagaaggtgctggccgccaccgacctggacgccgaggaggaggtggtggccggcgagttcggcagcagaagcagccaggccagcagaagattcggcaccatgagcagcatgagcggcgccgacgacaccgtgtacatggagtaccacagcagcagaagcaaggcccccagcaagcacgtgcaccccctgttcaagagattcagaaagtag

SEQ ID NO: 81002 - DNA, 2157 bp, Artificial Sequence
  Description of Artificial Sequence: Synthetic coding sequence
atgcccctgaaggacgaccacaccagcagacccctgtgggtggcccccgacggccacatcttcctggaggccttcagccccgtgtacaagtacgcccaggacttcctggtggccatcgccgagcccgtgtgcagacccacccacgtgcacgagtacaagctgaccgcctacagcctgtacgccgccgtgagcgtgggcctgcagaccagcgacatcaccgagtacctgagaaagctgagcaagaccggcgtgcccgacggcatcatgcagttcatcaagctgtgcaccgtgagctacggcaaggtgaagctggtgctgaagcacaacagatacttcgtggagagctgccaccccgacgtgatccagcacctgctgcaggaccccgtgatcagagagtgcagactgagaaacagcgagggcgaggccaccgagctgatcaccgagaccttcaccagcaagagcgccatcagcaagaccgccgagagcagcggcggccccagcaccagcagagtgaccgacccccagggcaagagcgacatccccatggacctgttcgacttctacgagcagatggacaaggacgaggaggaggaggaggagacccagaccgtgagcttcgaggtgaagcaggagatgatcgaggagctgcagaagagatgcatccacctggagtaccccctgctggccgagtacgacttcagaaacgacagcgtgaaccccgacatcaacatcgacctgaagcccaccgccgtgctgagaccctaccaggagaagagcctgagaaagatgttcggcaacggcagagccagaagcggcgtgatcgtgctgccctgcggcgccggcaagagcctggtgggcgtgaccgccgcctgcaccgtgagaaagagatgcctggtgctgggcaacagcgccgtgagcgtggagcagtggaaggcccagttcaagatgtggagcaccatcgacgacagccagatctgcagattcaccagcgacgccaaggacaagcccatcggctgcagcgtggccatcagcacctacagcatgctgggccacaccaccaagagaagctgggaggccgagagagtgatggagtggctgaagacccaggagtggggcctgatgatcctggacgaggtgcacaccatccccgccaagatgttcagaagagtgctgaccatcgtgcaggcccactgcaagctgggcctgaccgccaccctggtgagagaggacgacaagatcgtggacctgaacttcctgatcggccccaagctgtacgaggccaactggatggagctgcagaacaacggctacatcgccaaggtgcagtgcgccgaggtgtggtgccccatgagccccgagttctacagagagtacgtggccatcaagaccaagaagagaatcctgctgtacaccatgaaccccaacaagttcagagcctgccagttcctgatcaagttccacgagagaagaaacgacaagatcatcgtgttcgccgacaacgtgttcgccctgaaggagtacgccatcagactgaacaagccctacatctacggccccaccagccagggcgagagaatgcagatcctgcagaacttcaagcacaaccccaagatcaacaccatcttcatcagcaaggtgggcgacaccagcttcgacctgcccgaggccaacgtgctgatccagatcagcagccacggcggcagcagaagacaggaggcccagagactgggcagagtgctgagagccaagaagggcatggtggccgaggagtacaacgccttcttctacagcctggtgagccaggacacccaggagatggcctacagcaccaagagacagagattcctggtggaccagggctacagcttcaaggtgatcaccaagctggccggcatggaggaggaggacctggccttcagcaccaaggaggagcagcagcagctgctgcagaaggtgctggccgccaccgacctggacgccgaggaggaggtggtggccggcgagttcggcagcagaagcagccaggccagcagaagattcggcaccatgagcagcatgagcggcgccgacgacaccgtgtacatggagtaccacagcagcagaagcaaggcccccagcaagcacgtgcaccccctgttcaagagattcagaaagtag

SEQ ID NO: 81003 - DNA, 3753 bp, Artificial Sequence
  Description of Artificial Sequence: Synthetic coding sequence
atggaggccagcagaagattccccgaggccgaggccctgagccccgagcaggccgcccactacctgagatacgtgaaggaggccaaggaggccaccaagaacggcgacctggaggaggccttcaagctgttcaacctggccaaggacatcttccccaacgagaaggtgctgagcagaatccagaagatccaggaggccctggaggagctggccgagcagggcgacgacgagttcaccgacgtgtgcaacagcggcctgctgctgtacagagagctgcacaaccagctgttcgagcaccagaaggagggcatcgccttcctgtacagcctgtacagagacggcagaaagggcggcatcctggccgacgacatgggcctgggcaagaccgtgcagatcatcgccttcctgagcggcatgttcgacgccagcctggtgaaccacgtgctgctgatcatgcccaccaacctgatcaacacctgggtgaaggagttcatcaagtggacccccggcatgagagtgaagaccttccacggccccagcaaggacgagagaaccagaaacctgaacagaatccagcagagaaacggcgtgatcatcaccacctaccagatgctgatcaacaactggcagcagctgagcagcttcagaggccaggagttcgtgtgggactacgtgatcctggacgaggcccacaagatcaagaccagcagcaccaagagcgccatctgcgccagagccatccccgccagcaacagactgctgctgaccggcacccccatccagaacaacctgcaggagctgtggagcctgttcgacttcgcctgccagggcagcctgctgggcaccctgaagaccttcaagatggagtacgagaaccccatcaccagagccagagagaaggacgccacccccggcgagaaggccctgggcttcaagatcagcgagaacctgatggccatcatcaagccctacttcctgagaagaaccaaggaggacgtgcagaagaagaagagcagcaaccccgaggccagactgaacgagaagaaccccgacgtggacgccatctgcgagatgcccagcctgagcagaaagaacgacctgatcatctggatcagactggtgcccctgcaggaggagatctacagaaagttcgtgagcctggaccacatcaaggagctgctgatggagaccagaagccccctggccgagctgggcgtgctgaagaagctgtgcgaccaccccagactgctgagcgccagagcctgctgcctgctgaacctgggcaccttcagcgcccaggacggcaacgagggcgaggacagccccgacgtggaccacatcgaccaggtgaccgacgacaccctgatggaggagagcggcaagatgatcttcctgatggacctgctgaagagactgagagacgagggccaccagaccctggtgttcagccagagcagacagatcctgaacatcatcgagagactgctgaagaacagacacttcaagaccctgagaatcgacggcaccgtgacccacctgctggagagagagaagagaatcaacctgttccagcagaacaaggactacagcgtgttcctgctgaccacccaggtgggcggcgtgggcctgaccctgaccgccgccaccagagtggtgatcttcgaccccagctggaaccccgccaccgacgcccaggccgtggacagagtgtacagaatcggccagaaggagaacgtggtggtgtacagactgatcacctgcggcaccgtggaggagaagatctacagaagacaggtgttcaaggacagcctgatcagacagaccaccggcgagaagaagaaccccttcagatacttcagcaagcaggagctgagagagctgttcaccatcgaggacctgcagaacagcgtgacccagctgcagctgcagagcctgcacgccgcccagagaaagagcgacatcaagctggacgagcacatcgcctacctgcagagcctgggcatcgccggcatcagcgaccacgacctgatgtacacctgcgacctgagcgtgaaggaggagctggacgtggtggaggagagccactacatccagcagagagtgcagaaggcccagttcctggtggagttcgagagccagaacaaggagttcctgatggagcagcagagaaccagaaacgagggcgcctggctgagagagcccgtgttccccagcagcaccaagaagaagtgccccaagctgaacaagccccagccccagcccagccccctgctgagcacccaccacacccaggaggaggacatcagcagcaagatggccagcgtggtgatcgacgacctgcccaaggagggcgagaagcaggacctgagcagcatcaaggtgaacgtgaccaccctgcaggacggcaagggcaccggcagcgccgacagcatcgccaccctgcccaagggcttcggcagcgtggaggagctgtgcaccaacagcagcctgggcatggagaagagcttcgccaccaagaacgaggccgtgcagaaggagaccctgcaggagggccccaagcaggaggccctgcaggaggaccccctggagagcttcaactacgtgctgagcaagagcaccaaggccgacatcggccccaacctggaccagctgaaggacgacgagatcctgagacactgcaacccctggcccatcatcagcatcaccaacgagagccagaacgccgagagcaacgtgagcatcatcgagatcgccgacgacctgagcgccagccacagcgccctgcaggacgcccaggccagcgaggccaagctggaggaggagcccagcgccagcagcccccagtacgcctgcgacttcaacctgttcctggaggacagcgccgacaacagacagaacttcagcagccagagcctggagcacgtggagaaggagaacagcctgtgcggcagcgcccccaacagcagagccggcttcgtgcacagcaagacctgcctgagctgggagttcagcgagaaggacgacgagcccgaggaggtggtggtgaaggccaagatcagaagcaaggccagaagaatcgtgagcgacggcgaggacgaggacgacagcttcaaggacaccagcagcatcaaccccttcaacaccagcctgttccagttcagcagcgtgaagcagttcgacgccagcacccccaagaacgacatcagcccccccggcagattcttcagcagccagatccccagcagcgtgaacaagagcatgaacagcagaagaagcctggccagcagaagaagcctgatcaacatggtgctggaccacgtggaggacatggaggagagactggacgacagcagcgaggccaagggccccgaggactaccccgaggagggcgtggaggagagcagcggcgaggccagcaagtacaccgaggaggaccccagcggcgagaccctgagcagcgagaacaagagcagctggctgatgaccagcaagcccagcgccctggcccaggagaccagcctgggcgcccccgagcccctgagcggcgagcagctggtgggcagcccccaggacaaggccgccgaggccaccaacgactacgagaccctggtgaagagaggcaaggagctgaaggagtgcggcaagatccaggaggccctgaactgcctggtgaaggccctggacatcaagagcgccgaccccgaggtgatgctgctgaccctgagcctgtacaagcagctgaacaacaactag

SEQ ID NO: 81004 - DNA, 2685 bp, Artificial Sequence
  Description of Artificial Sequence: Synthetic coding sequence
atgaccgccatcaagcacgccctgcagagagacatcttcacccccaacgacgagagactgctgagcatcgtgaacgtgtgcaaggccggcaagaagaagaagaactgcttcctgtgcgccaccgtgaccaccgagagacccgtgcaggtgaaggtggtgaaggtgaagaagagcgacaagggcgacttctacaagagacagatcgcctgggccctgagagacctggccgtggtggacgccaaggacgccatcaaggagaaccccgagttcgacctgcacttcgagaagatctacaagtgggtggccagcagcaccgccgagaagaacgccttcatcagctgcatctggaagctgaaccagagatacctgagaaagaagatcgacttcgtgaacgtgagcagccagctgctggaggagagcgtgcccagcggcgagaaccagagcgtgaccggcggcgacgaggaggtggtggacgagtaccaggagctgaacgccagagaggagcaggacatcgagatcatgatggagggctgcgagtacgccatcagcaacgccgaggccttcgccgagaagctgagcagagagctgcaggtgctggacggcgccaacatccagagcatcatggccagcgagaagcaggtgaacatcctgatgaagctgctggacgaggccctgaaggaggtggaccagatcgagctgaagctgagcagctacgaggagatgctgcagagcgtgaaggagcagatggaccagatcagcgagagcaaccacctgatccacctgagcaacaccaacaacgtgaagctgctgagcgagatcgagttcctggtgaaccacatggacctggccaagggccacatcaaggccctgcaggagggcgacctggccagcagcagaggcatcgaggcctgcaccaacgccgccgacgccctgctgcagtgcatgaacgtggccctgagacccggccacgacctgctgctggccgtgaagcagcagcagcagagattcagcgacctgagagagctgttcgccagaagactggccagccacctgaacaacgtgttcgtgcagcagggccacgaccagagcagcaccctggcccagcacagcgtggagctgaccctgcccaaccaccaccccttccacagagacctgctgagatacgccaagctgatggagtggctgaagagcaccgactacggcaagtacgagggcctgaccaagaactacatggactacctgagcagactgtacgagagagagatcaaggacttcttcgaggtggccaagatcaagatgaccggcaccaccaaggagagcaagaagttcgccaccctgcccagaaaggagagcgccgtgaagcaggagaccgagagcctgcacggcagcagcggcaagctgaccggcagcaccagcagcctgaacaagctgagcgtgcagagcagcggcaacagaagaagccagagcagcagcctgctggacatgggcaacatgagcgccagcgacctggacgtggccgacagaaccaagttcgacaagatcttcgagcaggtgctgagcgagctggagcccctgtgcctggccgagcaggacttcatcagcaagttcttcaagctgcagcagcaccagagcatgcccggcaccatggccgaggccgaggacctggacggcggcaccctgagcagacagcacaactgcggcacccccctgcccgtgagcagcgagaaggacatgatcagacagatgatgatcaagatcttcagatgcatcgagcccgagctgaacaacctgatcgccctgggcgacaagatcgacagcttcaacagcctgtacatgctggtgaagatgagccaccacgtgtggaccgcccagaacgtggaccccgccagcttcctgagcaccaccctgggcaacgtgctggtgaccgtgaagagaaacttcgacaagtgcatcagcaaccagatcagacagatggaggaggtgaagatcagcaagaagagcaaggtgggcatcctgcccttcgtggccgagttcgaggagttcgccggcctggccgagagcatcttcaagaacgccgagagaagaggcgacctggacaaggcctacaccaagctgatcagaggcgtgttcgtgaacgtggagaaggtggccaacgagagccagaagacccccagagacgtggtgatgatggagaacttccaccacatcttcgccaccctgagcagactgaagatcagctgcctggaggccgagaagaaggaggccaagcagaagtacaccgaccacctgcagagctacgtgatctacagcctgggccagcccctggagaagctgaaccacttcttcgagggcgtggaggccagagtggcccagggcatcagagaggaggaggtgagctaccagctggccttcaacaagcaggagctgagaaaggtgatcaaggagtaccccggcaaggaggtgaagaagggcctggacaacctgtacaagaaggtggacaagcacctgtgcgaggaggagaacctgctgcaggtggtgtggcacagcatgcaggacgagttcatcagacagtacaagcacttcgagggcctgatcgccagatgctaccccggcagcggcgtgaccatggagttcaccatccaggacatcctggactactgcagcagcatcgcccagagccactag

SEQ ID NO: 81005 - DNA, 2640 bp, Artificial Sequence
  Description of Artificial Sequence: Synthetic coding sequence
atgaccgccatcaagcacgccctgcagagagacatcttcacccccaacgacgagagactgctgagcatcgtgaacgtgtgcaaggccggcaagaagaagaagaactgcttcctgtgcgccaccgtgaccaccgagagacccgtgcaggtgaaggtggtgaaggtgaagaagagcgacaagggcgacttctacaagagacagatcgcctgggccctgagagacctggccgtggtggacgccaaggacgccatcaaggagaaccccgagttcgacctgcacttcgagaagatctacaagtgggtggccagcagcaccgccgagaagaacgccttcatcagctgcatctggaagctgaaccagagatacctgagaaagaagatcgacttcgtgaacgtgagcagccagctgctggaggagagcgtgcccagcggcgagaaccagagcgtgaccggcggcgacgaggaggtggtggacgagtaccaggagctgaacgccagagaggagcaggacatcgagatcatgatggagggctgcgagtacgccatcagcaacgccgaggccttcgccgagaagctgagcagagagctgcaggtgctggacggcgccaacatccagagcatcatggccagcgagaagcaggtgaacatcctgatgaagctgctggacgaggccctgaaggaggtggaccagatcgagctgaagctgagcagctacgaggagatgctgcagagcgtgaaggagcagatggaccagatcagcgagagcaaccacctgatccacctgagcaacaccaacaacgtgaagctgctgagcgagatcgagttcctggtgaaccacatggacctggccaagggccacatcaaggccctgcaggagggcgacctggccagcagcagaggcatcgaggcctgcaccaacgccgccgacgccctgctgcagtgcatgaacgtggccctgagacccggccacgacctgctgctggccgtgaagcagcagcagcagagattcagcgacctgagagagctgttcgccagaagactggccagccacctgaacaacgtgttcgtgcagcagggccacgaccagagcagcaccctggcccagcacagcgtggagctgaccctgcccaaccaccaccccttccacagagacctgctgagatacgccaagctgatggagtggctgaagagcaccgactacggcaagtacgagggcctgaccaagaactacatggactacctgagcagactgtacgagagagagatcaaggacttcttcgaggtggccaagatcaagatgaccggcaccaccaaggagagcaagaagttcggcctgcacggcagcagcggcaagctgaccggcagcaccagcagcctgaacaagctgagcgtgcagagcagcggcaacagaagaagccagagcagcagcctgctggacatgggcaacatgagcgccagcgacctggacgtggccgacagaaccaagttcgacaagatcttcgagcaggtgctgagcgagctggagcccctgtgcctggccgagcaggacttcatcagcaagttcttcaagctgcagcagcaccagagcatgcccggcaccatggccgaggccgaggacctggacggcggcaccctgagcagacagcacaactgcggcacccccctgcccgtgagcagcgagaaggacatgatcagacagatgatgatcaagatcttcagatgcatcgagcccgagctgaacaacctgatcgccctgggcgacaagatcgacagcttcaacagcctgtacatgctggtgaagatgagccaccacgtgtggaccgcccagaacgtggaccccgccagcttcctgagcaccaccctgggcaacgtgctggtgaccgtgaagagaaacttcgacaagtgcatcagcaaccagatcagacagatggaggaggtgaagatcagcaagaagagcaaggtgggcatcctgcccttcgtggccgagttcgaggagttcgccggcctggccgagagcatcttcaagaacgccgagagaagaggcgacctggacaaggcctacaccaagctgatcagaggcgtgttcgtgaacgtggagaaggtggccaacgagagccagaagacccccagagacgtggtgatgatggagaacttccaccacatcttcgccaccctgagcagactgaagatcagctgcctggaggccgagaagaaggaggccaagcagaagtacaccgaccacctgcagagctacgtgatctacagcctgggccagcccctggagaagctgaaccacttcttcgagggcgtggaggccagagtggcccagggcatcagagaggaggaggtgagctaccagctggccttcaacaagcaggagctgagaaaggtgatcaaggagtaccccggcaaggaggtgaagaagggcctggacaacctgtacaagaaggtggacaagcacctgtgcgaggaggagaacctgctgcaggtggtgtggcacagcatgcaggacgagttcatcagacagtacaagcacttcgagggcctgatcgccagatgctaccccggcagcggcgtgaccatggagttcaccatccaggacatcctggactactgcagcagcatcgcccagagccactag

SEQ ID NO: 81006 - DNA, 2685 bp, Artificial Sequence; identical to SEQ ID NO: 81004
  Description of Artificial Sequence: Synthetic coding sequence

SEQ ID NO: 81007 - DNA, 2238 bp, Artificial Sequence
  Description of Artificial Sequence: Synthetic coding sequence
atgaaggagaccgacagagaggccgtggccaccgccgtgcagagagtggccggcatgctgcagagacccgaccagctggacaaggtggagcagtacagaagaagagaggccagaaagaaggccagcgtggaggccagactgaaggccgccatccagagccagctggacggcgtgagaaccggcctgagccagctgcacaacgccctgaacgacgtgaaggacatccagcagagcctggccgacgtgagcaaggactggagacagagcatcaacaccatcgagagcctgaaggacgtgaaggacgccgtggtgcagcacagccagctggccgccgccgtggagaacctgaagaacatcttcagcgtgcccgagatcgtgagagagacccaggacctgatcgagcagggcgccctgctgcaggcccacagaaagctgatggacctggagtgcagcagagacggcctgatgtacgagcagtacagaatggacagcggcaacaccagagacatgaccctgatccacggctacttcggcagcacccagggcctgagcgacgagctggccaagcagctgtggatggtgctgcagagaagcctggtgaccgtgagaagagaccccaccctgctggtgagcgtggtgagaatcatcgagagagaggagaagatcgacagaagaatcctggacagaaagaagcagaccggcttcgtgccccccggcagacccaagaactggaaggagaagatgttcaccatcctggagagaaccgtgaccaccagaatcgagggcacccaggccgacaccagagagagcgacaagatgtggctggtgagacacctggagatcatcagaaagtacgtgctggacgacctgatcgtggccaagaacctgatggtgcagtgcttccccccccactacgagatcttcaagaacctgctgaacatgtaccaccaggccctgagcaccagaatgcaggacctggccagcgaggacctggaggccaacgagatcgtgagcctgctgacctgggtgctgaacacctacaccagcaccgagatgatgagaaacgtggagctggcccccgaggtggacgtgggcaccctggagcccctgctgagcccccacgtggtgagcgagctgctggacacctacatgagcaccctgaccagcaacatcatcgcctggctgagaaaggccctggagaccgacaagaaggactgggtgaaggagaccgagcccgaggccgaccaggacggctactaccagaccaccctgcccgccatcgtgttccagatgttcgagcagaacctgcaggtggccgcccagatcagcgaggacctgaagaccaaggtgctggtgctgtgcctgcagcagatgaacagcttcctgagcagatacaaggacgaggcccagctgtacaaggaggagcacctgagaaacagacagcacccccactgctacgtgcagtacatgatcgccatcatcaacaactgccagaccttcaaggagagcatcgtgagcctgaagagaaagtacctgaagaacgaggtggaggagggcgtgagccccagccagcccagcatggacggcatcctggacgccatcgccaaggagggctgcagcggcctgctggaggaggtgttcctggacctggagcagcacctgaacgagctgatgaccaagaagtggctgctgggcagcaacgccgtggacatcatctgcgtgaccgtggaggactacttcaacgacttcgccaagatcaagaagccctacaagaagagaatgaccgccgaggcccacagaagagtggtggtggagtacctgagagccgtgatgcagaagagaatcagcttcagaagccccgaggagagaaaggagggcgccgagaagatggtgagagaggccgagcagctgagattcctgttcagaaagctggccagcggcttcggcgaggacgtggacggctactgcgacaccatcgtggccgtggccgaggtgatcaagctgaccgaccccagcctgctgtacctggaggtgagcaccctggtgagcaagtaccccgacatcagagacgaccacatcggcgccctgctggccgtgagaggcgacgccagcagagacatgaagcagaccatcatggagaccctggagcagggccccgcccaggccagccccagctacgtgcccctgttcaaggacatcgtggtgcccagcctgaacgtggccaagctgctgaagtag

SEQ ID NO: 81008 - DNA, 1923 bp, Artificial Sequence
  Description of Artificial Sequence: Synthetic coding sequence
cagtgcgaggacagcaccagcttcttcaccatgaaggagaccgacagagaggccgtggccaccgccgtgcagagagtggccggcatgctgcagagacccgaccagctggacaaggtggagcagtacagaagaagagaggccagaaagaaggccagcgtggaggccagactgaaggccgccatccagagccagctggacggcgtgagaaccggcctgagccagctgcacaacgccctgaacgacgtgaaggacatccagcagagcctggccgacgtgagcaaggactggagacagagcatcaacaccatcgagagcctgaaggacgtgaaggacgccgtggtgcagcacagccagctggccgccgccgtggagaacctgaagaacatcttcagcgtgcccgagatcgtgagagagacccaggacctgatcgagcagggcgccctgctgcaggcccacagaaagctgatggacctggagtgcagcagagacggcctgatgtacgagcagtacagaatggacagcggcaacaccagagacatgaccctgatccacggctacttcggcagcacccagggcctgagcgacgagctggccaagcagctgtggatggtgctgcagagaagcctggtgaccgtgagaagagaccccaccctgctggtgagcgtggtgagaatcatcgagagagaggagaagatcgacagaagaatcctggacagaaagaagcagaccggcttcgtgccccccggcagacccaagaactggaaggagaagatgttcaccatcctggagagaaccgtgaccaccagaatcgagggcacccaggccgacaccagagagagcgacaagatgtggctggtgagacacctggagatcatcagaaagtacgtgctggacgacctgatcgtggccaagaacctgatggtgcagtgcttccccccccactacgagatcttcaagaacctgctgaacatgtaccaccaggccctgagcaccagaatgcaggacctggccagcgaggacctggaggccaacgagatcgtgagcctgctgacctgggtgctgaacacctacaccagatacaaggacgaggcccagctgtacaaggaggagcacctgagaaacagacagcacccccactgctacgtgcagtacatgatcgccatcatcaacaactgccagaccttcaaggagagcatcgtgagcctgaagagaaagtacctgaagaacgaggtggaggagggcgtgagccccagccagcccagcatggacggcatcctggacgccatcgccaaggagggctgcagcggcctgctggaggaggtgttcctggacctggagcagcacctgaacgagctgatgaccaagaagtggctgctgggcagcaacgccgtggacatcatctgcgtgaccgtggaggactacttcaacgacttcgccaagatcaagaagccctacaagaagagaatgaccgccgaggcccacagaagagtggtggtggagtacctgagagccgtgatgcagaagagaatcagcttcagaagccccgaggagagaaaggagggcgccgagaagatggtgagagaggccgagcagctgagattcctgttcagaaagctggccagcggcttcggcgaggacgtggacggctactgcgacaccatcgtggccgtggccgaggtgatcaagctgaccgaccccagcctgctgtacctggaggtgagcaccctggtgagcaagtaccccgacatcagagacgaccacatcggcgccctgctggccgtgagaggcgacgccagcagagacatgaagcagaccatcatggagaccctggagcagggccccgcccaggccagccccagctacgtgcccctgttcaaggacatcgtggtgcccagcctgaacgtggccaagctgctgaagtag

SEQ ID NO: 81009 - DNA, 210 bp, Artificial Sequence
  Description of Artificial Sequence: Synthetic coding sequence
atgaaggagaccgacagagaggccgtggccaccgccgtgcagagagtggccggcatgctgcagagacccgaccagctggacaaggtggagcagtacagaagaagagaggccagaaagaaggccagcgtggaggccagactgaaggccgccatccagagccagctggacggcgtgagaaccggcctgagccagctgcacaacgccctgtag

SEQ ID NO: 81010 - DNA, 2238 bp, Artificial Sequence; identical to SEQ ID NO: 81007
  Description of Artificial Sequence: Synthetic coding sequence

SEQ ID NO: 81011 - DNA, 2034 bp, Artificial Sequence
  Description of Artificial Sequence: Synthetic coding sequence
atggacagcgccgccaaggacgagatgcagcccgccctgagccccggcagcagcttccccggccccgagtggcccgagcaggagagagccgagcagctggccagaggcgccgccctgaagtgggccagcggcatcttctacagacccgagcagctggccagactgggccagtacagaagcagagaggtgcagagaacctgcagcctggagagcagactgaagagcgtgatgcagagctacctggagggcgtgcagaccgtgcccgccgccgtgagccacacccagaccctgatcgacggccagcagttcctggaggcctacgtgagcctgagagagctggagcagctgagagaggacacctgggcccccctgggcggcctggagctgcccgtgttccagggcctggacctgctgttcgaggccctgggccaggccgtggaggccgccgccggcgccgccggcaagctggccagagaggaccccgccctgctggtggccgccgtgagagtggccgaggtggagaccggcagaaccacccccctgggccaggtgcccagagactggagacagagatgcctgagagccctgcaggagggcctggagcaggcccacttcggcagccccctgctgcccgcccccggcgccctgcccggctggctggaggccctgagagtggccctgcccgtggagctggccaccgccgaggccctggtggccccctgctgccccccccagtacaacgtggtgcagctgtgggcccacaccctgcacagcggcctgagaagaagcctgcagaacctgctggccggccccgagctggaggccgccgacgccttcgccctgctgcactgggccctgcacgtgtacctgggccaggagatgatgggcagcctggagctgggccccgaggccgacgtgagccagctggagcccctgctgaccctggagaacatcgagcagctggaggccaccttcgtggccaacatccagatcctggaggagaacatcagagtggccagcctggtgagcgagagcctgcagcagagagtgcacggcatggccctgagcgagctgggcaccttcctgagaagcttcagcgacgccctgatcagattcagcagagaccacttcagaggcaagagcatggccccccactacgtgccctacctgctggccgccctgaaccacaagagcgccctgagcagcagcgtgagcgtgctgcagctggacggcgcccccagcggcgccctggcccccgtggaggccgccctggacgagctgcagagaagaatctacagactggtgctggaggccctgcaggccgagctgcagcccctgttcgccgacctgcccagcagacagtggctgagcagccccgagctgctgcagagcgtgtgcgagagaaccggcagattctgcagagacttctggagagtgagaaaccccaccgtgcagctgctgctggccgaggccgagagagccgtggtgctgcagtacctgagcgccctgatgcagggcagactggtgtgcagaggcgccgacgagagaacccaggccgccgagagactgagacacgacgccgcccagctgcagcagctgttcctgagcctggtgagagccagctgggccggcagaagagccagagtgagcgtggccggctgggagagaggcctggccagagaccccacccccacctgcagcggccccggcggcgagagagccctgagagccggcgccgccagacccgagggcgccgccaagccccccagacccagagccgccggccccggcggcggctggcccgccgccaccatcagcagaagagagagaggccccagactgagacccctgggccccgccagaggcctggtgcccggcgccgcccccggcagagcccagctgcccgccggctgcgccgccgccgtggcccccagagagccccccagacccctgcagcccagcgccagagccagagcccccgccagctgcctgcccagcggcagctgcgccagagccctgctgctggccgagtag

SEQ ID NO: 81012 - DNA, 2241 bp, Artificial Sequence
  Description of Artificial Sequence: Synthetic coding sequence
atggacagcgccgccaaggacgagatgcagcccgccctgagccccggccccgagtggcccgagcaggagagagccgagcagctggccagaggcgccgccctgaagtgggccagcggcatcttctacagacccgagcagctggccagactgggccagtacagaagcagagaggtgcagagaacctgcagcctggagagcagactgaagagcgtgatgcagagctacctggagggcgtgcagaccggcgtgtggcagctggcccaggccatcgaggtggtgcagggcaccagagaggccctgagccaggccagaggcctgctgcagggcatgagccaggccctgcagaccctggagcccctgagagagagagtggcccagcacaagcagctgcaggccctgagccacctgctgcccagactgagagccgtgcccgccgccgtgagccacacccagaccctgatcgacggccagcagttcctggaggcctacgtgagcctgagagagctggagcagctgagagaggacacctgggcccccctgggcggcctggagctgcccgtgttccagggcctggacctgctgttcgaggccctgggccaggccgtggaggccgccgccggcgccgccggcaagctggccagagaggaccccgccctgctggtggccgccgtgagagtggccgaggtggagaccggcagaaccacccccctgggccaggtgcccagagactggagacagagatgcctgagagccctgcaggagggcctggagcaggcccacttcggcagccccctgctgcccgcccccggcgccctgcccggctggctggaggccctgagagtggccctgcccgtggagctggccaccgccgaggccctggtggccccctgctgccccccccagtacaacgtggtgcagctgtgggcccacaccctgcacagcggcctgagaagaagcctgcagaacctgctggccggccccgagctggaggccgccgacgccttcgccctgctgcactgggccctgcacgtgtacctgggccaggagatgatgggcagcctggagctgggccccgaggccgacgtgagccagctggagcccctgctgaccctggagaacatcgagcagctggaggccaccttcgtggccaacatccaggccagcgtgagccagtggctgcagaacgccctggacggcgaggtggccgagtggggcagagagcacggccccaacaccgaccccagcggcagctactacagccccatgcccgccatcgtgctgcagatcctggaggagaacatcagagtggccagcctggtgagcgagagcctgcagcagagagtgcacggcatggccctgagcgagctgggcaccttcctgagaagcttcagcgacgccctgatcagattcagcagagaccacttcagaggcaagagcatggccccccactacgtgccctacctgctggccgccctgaaccacaagagcgccctgagcagcagcgtgagcgtgctgcagctggacggcgcccccagcggcgccctggcccccgtggaggccgccctggacgagctgcagagaagaatctacagactggtgctggaggccctgcaggccgagctgcagcccctgttcgccgacctgcccagcagacagtggctgagcagccccgagctgctgcagagcgtgtgcgagagaaccggcagattctgcagagacttctggagagtgagaaaccccaccgtgcagctgctgctggccgaggccgagagagccgtggtgctgcagtacctgagcgccctgatgcagggcagactggtgtgcagaggcgccgacgagagaacccaggccgccgagagactgagacacgacgccgcccagctgcagcagctgttcctgagcctgggcctggaggagaacgcccactgcgcccccgtgctgctggccctgagagagctgctgaacctgagagaccccgccctgctgggcctggaggtggccggcctgagacagcagttccccgacgtgagcgaggaccacgtgagcgccctgctgggcctgagaggcgacctgagcagagagcagcacctggccgccctgagcagcctgcaggccgccctgccccccagccccagagccagcagaagagtgctgttcagcctggtgcccgcccccgccctggcccccgccagctgcctgcccagcggcagctgcgccagagccctgctgctggccgagtag

SEQ ID NO: 81013 - DNA, 2040 bp, Artificial Sequence
  Description of Artificial Sequence: Synthetic coding sequence
atggacagcgccgccaaggacgagatgcagcccgccctgagccccggccccgagtggcccgagcaggagagagccgagcagctggccagaggcgccgccctgaagtgggccagcggcatcttctacagacccgagcagctggccagactgggccagtacagaagcagagaggtgcagagaacctgcagcctggagagcagactgaagagcgtgatgcagagctacctggagggcgtgcagaccgtgcccgccgccgtgagccacacccagaccctgatcgacggccagcagttcctggaggcctacgtgagcctgagagagctggagcagctgagagaggacacctgggcccccctgggcggcctggagctgcccgtgttccagggcctggacctgctgttcgaggccctgggccaggccgtggaggccgccgccggcgccgccggcaagctggccagagaggaccccgccctgctggtggccgccgtgagagtggccgaggtggagaccggcagaaccacccccctgggccaggtgcccagagactggagacagagatgcctgagagccctgcaggagggcctggagcaggcccacttcggcagccccctgctgcccgcccccggcgccctgcccggctggctggaggccctgagagtggccctgcccgtggagctggccaccgccgaggccctggtggccccctgctgccccccccagtacaacgtggtgcagctgtgggcccacaccctgcacagcggcctgagaagaagcctgcagaacctgctggccggccccgagctggaggccgccgacgccttcgccctgctgcactgggccctgcacgtgtacctgggccaggagatgatgggcagcctggagctgggccccgaggccgacgtgagccagctggagcccctgctgaccctggagaacatcgagcagctggaggccaccttcgtggccaacatccagatcctggaggagaacatcagagtggccagcctggtgagcgagagcctgcagcagagagtgcacggcatggccctgagcgagctgggcaccttcctgagaagcttcagcgacgccctgatcagattcagcagagaccacttcagaggcaagagcatggccccccactacgtgccctacctgctggccgccctgaaccacaagagcgccctgagcagcagcgtgagcgtgctgcagctggacggcgcccccagcggcgccctggcccccgtggaggccgccctggacgagctgcagagaagaatctacagactggtgctggaggccctgcaggccgagctgcagcccctgttcgccgacctgcccagcagacagtggctgagcagccccgagctgctgcagagcgtgtgcgagagaaccggcagattctgcagagacttctggagagtgagaaaccccaccgtgcagctgctgctggccgaggccgagagagccgtggtgctgcagtacctgagcgccctgatgcagggcagactggtgtgcagaggcgccgacgagagaacccaggccgccgagagactgagacacgacgccgcccagctgcagcagctgttcctgagcctggtgagagccagctgggccggcagaagagccagagtgagcgtggccggctgggagagaggcctggccagagaccccacccccacctgcagcggccccggcggcgagagagccctgagagccggcgccgccagacccgagggcgccgccaagccccccagacccagagccgccggccccggcggcggctggcccgccgccaccatcagcagaagagagagaggccccagactgagacccctgggccccgccagaggcctggtgcccggcgccgcccccggcagagcccagctgcccgccggctgcgccgccgccgtggcccccagagagccccccagacccctgcagcccagcgccagagccagagccagagccggcctgctgcccgccctgggcgtgctgagacccagccccgccgccagaagaatcaaccacggctgcagatag

SEQ ID NO: 81014 - DNA, 2925 bp, Artificial Sequence
  Description of Artificial Sequence: Synthetic coding sequence
atggccgccgaggccgccggcggcaagtacagaagcaccgtgagcaagagcaaggaccccagcggcctgctgatcagcgtgatcagaaccctgagcaccagcgacgacgtggaggacagagagaacgagaagggcagactggaggaggcctacgagaagtgcgacagagacctggacgagctgatcgtgcagcactacaccgagctgaccaccgccatcagaacctaccagagcatcaccgagagaatcaccaacagcagaaacaagatcaagcaggtgaaggagaacctgctgagctgcaagatgctgctgcactgcaagagagacgagctgagaaagctgtggatcgagggcatcgagcacaagcacgtgctgaacctgctggacgagatcgagaacatcaagcaggtgccccagaagctggagcagtgcatggccagcaagcactacctgagcgccaccgacatgctggtgagcgccgtggagagcctggagggccccctgctgcaggtggagggcctgagcgacctgagactggagctgcacagcaagaagatgaacctgcacctggtgctgatcgacgagctgcacagacacctgtacatcaagagcaccagcagagtggtgcagagaaacaaggagaagggcaagatcagcagcctggtgaaggacgccagcgtgcccctgatcgacgtgaccaacctgcccacccccagaaagttcctggacaccagccactacagcaccgccggcagcagcagcgtgagagagatcaacctgcaggacatcaaggaggacctggagctggaccccgaggagaacagcaccctgttcatgggcatcctgatcaagggcctggccaagctgaagaagatccccgagaccgtgaaggccatcatcgagagactggagcaggagctgaagcagatcgtgaagagaagcaccacccaggtggccgacagcggctaccagagaggcgagaacgtgaccgtggagaaccagcccagactgctgctggagctgctggagctgctgttcgacaagttcaacgccgtggccgccgcccacagcgtggtgctgggctacctgcaggacaccgtggtgacccccctgacccagcaggaggacatcaagctgtacgacatggccgacgtgtgggtgaagatccaggacgtgctgcagatgctgctgaccgagtacctggacatgaagaacaccagaaccgccagcgagcccagcgcccagctgagctacgccagcaccggcagagagttcgccgccttcttcgccaagaagaagccccagagacccaagaacagcctgttcaagttcgagagcagcagccacgccatcagcatgagcgcctacctgagagagcagagaagagagctgtacagcagaagcggcgagctgcagggcggccccgacgacaacctgatcgagggcggcggcaccaagttcgtgtgcaagcccggcgccagaaacatcaccgtgatcttccaccccctgctgagattcatccaggagatcgagcacgccctgggcctgggccccgccaagcagtgccccctgagagagttcctgaccgtgtacatcaagaacatcttcctgaaccaggtgctggccgagatcaacaaggagatcgagggcgtgaccaagaccagcgaccccctgaagatcctggccaacgccgacaccatgaaggtgctgggcgtgcagagacccctgctgcagagcaccatcatcgtggagaagaccgtgcaggacctgctgaacctgatgcacgacctgagcgcctacagcgaccagttcctgaacatggtgtgcgtgaagctgcaggagtacaaggacacctgcaccgccgcctacagaggcatcgtgcagagcgaggagaagctggtgatcagcgccagctgggccaaggacgacgacatcagcagactgctgaagagcctgcccaactggatgaacatggcccagcccaagcagctgagacccaagagagaggaggaggaggacttcatcagagccgccttcggcaaggagagcgaggtgctgatcggcaacctgggcgacaagctgatccccccccaggacatcctgagagacgtgagcgacctgaaggccctggccaacatgcacgagagcctggagtggctggccagcagaaccaagagcgccttcagcaacctgagcaccagccagatgctgagccccgcccaggacagccacaccaacaccgacctgccccccgtgagcgagcagatcatgcagaccctgagcgagctggccaagagcttccaggacatggccgacagatgcctgctggtgctgcacctggaggtgagagtgcactgcttccactacctgatccccctggccaaggagggcaactacgccatcgtggccaacgtggagagcatggactacgaccccctggtggtgaagctgaacaaggacatcagcgccatcgaggaggccatgagcgccagcctgcagcagcacaagttccagtacatcttcgagggcctgggccacctgatcagctgcatcctgatcaacggcgcccagtacttcagaagaatcagcgagagcggcatcaagaagatgtgcagaaacatcttcgtgctgcagcagaacctgaccaacatcaccatgagcagagaggccgacctggacttcgccagacagtactacgagatgctgtacaacaccgccgacgagctgctgaacctggtggtggaccagggcgtgaagtacaccgagctggagtacatccacgccctgaccctgctgcacagaagccagaccggcgtgggcgagctgaccacccagaacaccagactgcagagactgaaggagatcatctgcgagcaggccgccatcaagcaggccaccaaggacaagaagatcaccaccgtgtag

SEQ ID NO: 81015 - DNA, 1422 bp, Artificial Sequence
  Description of Artificial Sequence: Synthetic coding sequence
atggccgccgaggccgccggcggcaagtacagaagcaccgtgagcaagagcaaggaccccagcggcctgctgatcagcgtgatcagaaccctgagcaccagcgacgacgtggaggacagagagaacgagaagggcagactggaggaggcctacgagaagtgcgacagagacctggacgagctgatcgtgcagcactacaccgagctgaccaccgccatcagaacctaccagagcatcaccgagagaatcaccaacagcagaaacaagatcaagcaggtgaaggagaacctgctgagctgcaagatgctgctgcactgcaagagagacgagctgagaaagctgtggatcgagggcatcgagcacaagcacgtgctgaacctgctggacgagatcgagaacatcaagcaggtgccccagaagctggagcagtgcatggccagcaagcactacctgagcgccaccgacatgctggtgagcgccgtggagagcctggagggccccctgctgcaggtggagggcctgagcgacctgagactggagctgcacagcaagaagatgaacctgcacctggtgctgatcgacgagctgcacagacacctgtacatcaagagcaccagcagagtggtgcagagaaacaaggagaagggcaagatcagcagcctggtgaaggacgccagcgtgcccctgatcgacgtgaccaacctgcccacccccagaaagttcctggacaccagccactacagcaccgccggcagcagcagcgtgagagagatcaacctgcaggacatcaaggaggacctggagctggaccccgaggagaacagcaccctgttcatgggcatcctgatcaagggcctggccaagctgaagaagatccccgagaccgtgaaggccatcatcgagagactggagcaggagctgaagcagatcgtgaagagaagcaccacccaggtggccgacagcggctaccagagaggcgagaacgtgaccgtggagaaccagcccagactgctgctggagctgctggagctgctgttcgacaagttcaacgccgtggccgccgcccacagcgtggtgctgggctacctgcaggacaccgtggtgacccccctgacccagcaggaggacatcaagctgtacgacatggccgacgtgtgggtgaagatccaggacgtgctgcagatgctgctgaccgagtacctggacatgaagaacaccagaaccgccagcgagcccagcgcccagctgagctacgccagcaccggcagagagttcgccgccttcttcgccaagaagaagccccagagacccaagaacagcctgttcaagttcgagagcagcagccacgccatcagcatgagcgcctacctgagagagcagagaagagagctgtacagcagaagcggcgagctgcagggctag

SEQ ID NO: 81016 - DNA, 2622 bp, Artificial Sequence
  Description of Artificial Sequence: Synthetic coding sequence
atgctgctgcactgcaagagagacgagctgagaaagctgtggatcgagggcatcgagcacaagcacgtgctgaacctgctggacgagatcgagaacatcaagcaggtgccccagaagctggagcagtgcatggccagcaagcactacctgagcgccaccgacatgctggtgagcgccgtggagagcctggagggccccctgctgcaggtggagggcctgagcgacctgagactggagctgcacagcaagaagatgaacctgcacctggtgctgatcgacgagctgcacagacacctgtacatcaagagcaccagcagagtggtgcagagaaacaaggagaagggcaagatcagcagcctggtgaaggacgccagcgtgcccctgatcgacgtgaccaacctgcccacccccagaaagttcctggacaccagccactacagcaccgccggcagcagcagcgtgagagagatcaacctgcaggacatcaaggaggacctggagctggaccccgaggagaacagcaccctgttcatgggcatcctgatcaagggcctggccaagctgaagaagatccccgagaccgtgaaggccatcatcgagagactggagcaggagctgaagcagatcgtgaagagaagcaccacccaggtggccgacagcggctaccagagaggcgagaacgtgaccgtggagaaccagcccagactgctgctggagctgctggagctgctgttcgacaagttcaacgccgtggccgccgcccacagcgtggtgctgggctacctgcaggacaccgtggtgacccccctgacccagcaggaggacatcaagctgtacgacatggccgacgtgtgggtgaagatccaggacgtgctgcagatgctgctgaccgagtacctggacatgaagaacaccagaaccgccagcgagcccagcgcccagctgagctacgccagcaccggcagagagttcgccgccttcttcgccaagaagaagccccagagacccaagaacagcctgttcaagttcgagagcagcagccacgccatcagcatgagcgcctacctgagagagcagagaagagagctgtacagcagaagcggcgagctgcagggcggccccgacgacaacctgatcgagggcggcggcaccaagttcgtgtgcaagcccggcgccagaaacatcaccgtgatcttccaccccctgctgagattcatccaggagatcgagcacgccctgggcctgggccccgccaagcagtgccccctgagagagttcctgaccgtgtacatcaagaacatcttcctgaaccaggtgctggccgagatcaacaaggagatcgagggcgtgaccaagaccagcgaccccctgaagatcctggccaacgccgacaccatgaaggtgctgggcgtgcagagacccctgctgcagagcaccatcatcgtggagaagaccgtgcaggacctgctgaacctgatgcacgacctgagcgcctacagcgaccagttcctgaacatggtgtgcgtgaagctgcaggagtacaaggacacctgcaccgccgcctacagaggcatcgtgcagagcgaggagaagctggtgatcagcgccagctgggccaaggacgacgacatcagcagactgctgaagagcctgcccaactggatgaacatggcccagcccaagcagctgagacccaagagagaggaggaggaggacttcatcagagccgccttcggcaaggagagcgaggtgctgatcggcaacctgggcgacaagctgatccccccccaggacatcctgagagacgtgagcgacctgaaggccctggccaacatgcacgagagcctggagtggctggccagcagaaccaagagcgccttcagcaacctgagcaccagccagatgctgagccccgcccaggacagccacaccaacaccgacctgccccccgtgagcgagcagatcatgcagaccctgagcgagctggccaagagcttccaggacatggccgacagatgcctgctggtgctgcacctggaggtgagagtgcactgcttccactacctgatccccctggccaaggagggcaactacgccatcgtggccaacgtggagagcatggactacgaccccctggtggtgaagctgaacaaggacatcagcgccatcgaggaggccatgagcgccagcctgcagcagcacaagttccagtacatcttcgagggcctgggccacctgatcagctgcatcctgatcaacggcgcccagtacttcagaagaatcagcgagagcggcatcaagaagatgtgcagaaacatcttcgtgctgcagcagaacctgaccaacatcaccatgagcagagaggccgacctggacttcgccagacagtactacgagatgctgtacaacaccgccgacgagctgctgaacctggtggtggaccagggcgtgaagtacaccgagctggagtacatccacgccctgaccctgctgcacagaagccagaccggcgtgggcgagctgaccacccagaacaccagactgcagagactgaaggagatcatctgcgagcaggccgccatcaagcaggccaccaaggacaagaagatcaccaccgtgtag

SEQ ID NO: 81017 - DNA, 789 bp, Artificial Sequence
  Description of Artificial Sequence: Synthetic coding sequence
atgcacgagagcctggagtggctggccagcagaaccaagagcgccttcagcaacctgagcaccagccagatgctgagccccgcccaggacagccacaccaacaccgacctgccccccgtgagcgagcagatcatgcagaccctgagcgagctggccaagagcttccaggacatggccgacagatgcctgctggtgctgcacctggaggtgagagtgcactgcttccactacctgatccccctggccaaggagggcaactacgccatcgtggccaacgtggagagcatggactacgaccccctggtggtgaagctgaacaaggacatcagcgccatcgaggaggccatgagcgccagcctgcagcagcacaagttccagtacatcttcgagggcctgggccacctgatcagctgcatcctgatcaacggcgcccagtacttcagaagaatcagcgagagcggcatcaagaagatgtgcagaaacatcttcgtgctgcagcagaacctgaccaacatcaccatgagcagagaggccgacctggacttcgccagacagtactacgagatgctgtacaacaccgccgacgagctgctgaacctggtggtggaccagggcgtgaagtacaccgagctggagtacatccacgccctgaccctgctgcacagaagccagaccggcgtgggcgagctgaccacccagaacaccagactgcagagactgaaggagatcatctgcgagcaggccgccatcaagcaggccaccaaggacaagaagatcaccaccgtgtag

SEQ ID NO: 81018 - DNA, 1755 bp, Artificial Sequence
  Description of Artificial Sequence: Synthetic coding sequence
atggccaacctggtgaccgccagcaagaccaagatgagcaagggcgaggaccccaacaaccccagaagcatcaagagaatcagccagggcggcagagacaaccacctggccatcgccaagtgcgacctgacccagctgaagaagaagcagagcgaggtgagcaacggcagcagagagaccatcagcatgaagacctgctgccagcacggcgacagaggctactggagcaccggctactactggagaggcggccccgacgacaacctgatcgagggcggcggcaccaagttcgtgtgcaagcccggcgccagaaacatcaccgtgatcttccaccccctgctgagattcatccaggagatcgagcacgccctgggcctgggccccgccaagcagtgccccctgagagagttcctgaccgtgtacatcaagaacatcttcctgaaccaggtgctggccgagatcaacaaggagatcgagggcgtgaccaagaccagcgaccccctgaagatcctggccaacgccgacaccatgaaggtgctgggcgtgcagagacccctgctgcagagcaccatcatcgtggagaagaccgtgcaggacctgctgaacctgatgcacgacctgagcgcctacagcgaccagttcctgaacatggtgtgcgtgaagctgcaggagtacaaggacacctgcaccgccgcctacagaggcatcgtgcagagcgaggagaagctggtgatcagcgccagctgggccaaggacgacgacatcagcagactgctgaagagcctgcccaactggatgaacatggcccagcccaagcagctgagacccaagagagaggaggaggaggacttcatcagagccgccttcggcaaggagagcgaggtgctgatcggcaacctgggcgacaagctgatccccccccaggacatcctgagagacgtgagcgacctgaaggccctggccaacatgcacgagagcctggagtggctggccagcagaaccaagagcgccttcagcaacctgagcaccagccagatgctgagccccgcccaggacagccacaccaacaccgacctgccccccgtgagcgagcagatcatgcagaccctgagcgagctggccaagagcttccaggacatggccgacagatgcctgctggtgctgcacctggaggtgagagtgcactgcttccactacctgatccccctggccaaggagggcaactacgccatcgtggccaacgtggagagcatggactacgaccccctggtggtgaagctgaacaaggacatcagcgccatcgaggaggccatgagcgccagcctgcagcagcacaagttccagtacatcttcgagggcctgggccacctgatcagctgcatcctgatcaacggcgcccagtacttcagaagaatcagcgagagcggcatcaagaagatgtgcagaaacatcttcgtgctgcagcagaacctgaccaacatcaccatgagcagagaggccgacctggacttcgccagacagtactacgagatgctgtacaacaccgccgacgagctgctgaacctggtggtggaccagggcgtgaagtacaccgagctggagtacatccacgccctgaccctgctgcacagaagccagaccggcgtgggcgagctgaccacccagaacaccagactgcagagactgaaggagatcatctgcgagcaggccgccatcaagcaggccaccaaggacaagaagatcaccaccgtgtag

SEQ ID NO: 81019 - DNA, 1782 bp, Artificial Sequence
  Description of Artificial Sequence: Synthetic coding sequence
atggccgacgtgtgggtgaagatccaggacgtgctgcagatgctgctgaccgagtacctggacatgaagaacaccagaaccgccagcgagcccagcgcccagctgagctacgccagcaccggcagagagttcgccgccttcttcgccaagaagaagccccagagacccaagaacagcctgttcaagttcgagagcagcagccacgccatcagcatgagcgcctacctgagagagcagagaagagagctgtacagcagaagcggcgagctgcagggcggccccgacgacaacctgatcgagggcggcggcaccaagttcgtgtgcaagcccggcgccagaaacatcaccgtgatcttccaccccctgctgagattcatccaggagatcgagcacgccctgggcctgggccccgccaagcagtgccccctgagagagttcctgaccgtgtacatcaagaacatcttcctgaaccaggtgctggccgagatcaacaaggagatcgagggcgtgaccaagaccagcgaccccctgaagatcctggccaacgccgacaccatgaaggtgctgggcgtgcagagacccctgctgcagagcaccatcatcgtggagaagaccgtgcaggacctgctgaacctgatgcacgacctgagcgcctacagcgaccagttcctgaacatggtgtgcgtgaagctgcaggagtacaaggacacctgcaccgccgcctacagaggcatcgtgcagagcgaggagaagctggtgatcagcgccagctgggccaaggacgacgacatcagcagactgctgaagagcctgcccaactggatgaacatggcccagcccaagcagctgagacccaagagagaggaggaggaggacttcatcagagccgccttcggcaaggagagcgaggtgctgatcggcaacctgggcgacaagctgatccccccccaggacatcctgagagacgtgagcgacctgaaggccctggccaacatgcacgagagcctggagtggctggccagcagaaccaagagcgccttcagcaacctgagcaccagccagatgctgagccccgcccaggacagccacaccaacaccgacctgccccccgtgagcgagcagatcatgcagaccctgagcgagctggccaagagcttccaggacatggccgacagatgcctgctggtgctgcacctggaggtgagagtgcactgcttccactacctgatccccctggccaaggagggcaactacgccatcgtggccaacgtggagagcatggactacgaccccctggtggtgaagctgaacaaggacatcagcgccatcgaggaggccatgagcgccagcctgcagcagcacaagttccagtacatcttcgagggcctgggccacctgatcagctgcatcctgatcaacggcgcccagtacttcagaagaatcagcgagagcggcatcaagaagatgtgcagaaacatcttcgtgctgcagcagaacctgaccaacatcaccatgagcagagaggccgacctggacttcgccagacagtactacgagatgctgtacaacaccgccgacgagctgctgaacctggtggtggaccagggcgtgaagtacaccgagctggagtacatccacgccctgaccctgctgcacagaagccagaccggcgtgggcgagctgaccacccagaacaccagactgcagagactgaaggagatcatctgcgagcaggccgccatcaagcaggccaccaaggacaagaagatcaccaccgtgtag

SEQ ID NO: 81020 - DNA, 1932 bp, Artificial Sequence
  Description of Artificial Sequence: Synthetic coding sequence
atggccaccaccgccgagctgttcgaggagcccttcgtggccgacgagtacatcgagagactggtgtggagaacccccggcggcggcagcagaggcggccccgaggccttcgaccccaagagactgctggaggagttcgtgaaccacatccaggagctgcagatcatggacgagagaatccagagaaaggtggagaagctggagcagcagtgccagaaggaggccaaggagttcgccaagaaggtgcaggagctgcagaagagcaaccagatcaaggaggccgccgacatcatccagaagctgcacctgatcgcccaggagctgcccttcgacagattcagcgaggtgaagagcaagatcgccagcaagtaccacgacctggagtgccagctgatccaggagttcaccagcgcccagagaagaggcgagatcagcagaatgagagaggtggccgccgtgctgctgcacttcaagggctacagccactgcgtggacgtgtacatcaagcagtgccaggagggcgcctacctgagaaacgacatcttcgaggacgccggcatcctgtgccagagagtgaacaagcaggtgggcgacatcttcagcaaccccgagaccgtgctggccaagctgatccagaacgtgttcgagatcaagctgcagagcttcgtgaaggagcagctggaggagtgcagaaagagcgacgccgagcagtacctgaagaacctgtacgacctgtacaccagaaccaccaacctgagcagcaagctgatggagttcaacctgggcaccgacaagcagaccttcctgagcaagctgatcaagagcatcttcatcagctacctggagaactacatcgaggtggagaccggctacctgaagagcagaagcgccatgatcctgcagagatactacgacagcaagaaccaccagaagagaagcatcggcaccggcggcatccaggacctgaaggagagaatcagacagagaaccaacctgcccctgggccccagcatcgacacccacggcgagaccttcctgagccaggaggtggtggtgaacctgctgcaggagaccaagcaggccttcgagagatgccacagactgagcgaccccagcgacctgcccagaaacgccttcagaatcttcaccatcctggtggagttcctgtgcatcgagcacatcgactacgccctggagaccggcctggccggcatccccagcagcgacagcagaaacgccaacctgtacttcctggacgtggtgcagcaggccaacaccatcttccacctgttcgacaagcagttcaacgaccacctgatgcccctgatcagcagcagccccaagctgagcgagtgcctgcagaagaagaaggagatcatcgagcagatggagatgaagctggacaccggcatcgacagaaccctgaactgcatgatcggccagatgaagcacatcctggccgccgagcagaagaagaccgacttcaagcccgaggacgagaacaacgtgctgatccagtacaccaacgcctgcgtgaaggtgtgcgcctacgtgagaaagcaggtggagaagatcaagaacagcatggacggcaagaacgtggacaccgtgctgatggagctgggcgtgagattccacagactgatctacgagcacctgcagcagtacagctacagctgcatgggcggcatgctggccatctgcgacgtggccgagtacagaaagtgcgccaaggacttcaagatccccatggtgctgcacctgttcgacaccctgcacgccctgtgcaacctgctggtggtggcccccgacaacctgaagcaggtgtgcagcggcgagcagctggccaacctggacaagaacatcctgcacagcttcgtgcagctgagagccgactacagaagcgccagactggccagacacttcagctag

SEQ ID NO: 81021 - DNA, 2127 bp, Artificial Sequence
  Description of Artificial Sequence: Synthetic coding sequence
atggccaccaccgccgagctgttcgaggagcccttcgtggccgacgagtacatcgagagactggtgtggagaacccccggcggcggcagcagaggcggccccgaggccttcgaccccaagagactgctggaggagttcgtgaaccacatccaggagctgcagatcatggacgagagaatccagagaaaggtggagaagctggagcagcagtgccagaaggaggccaaggagttcgccaagaaggtgcaggagctgcagaagagcaaccaggtggccttccagcacttccaggagctggacgagcacatcagctacgtggccaccaaggtgtgccacctgggcgaccagctggagggcgtgaacacccccagacagagagccgtggaggcccagaagctgatgaagtacttcaacgagttcctggacggcgagctgaagagcgacgtgttcaccaacagcgagaagatcaaggaggccgccgacatcatccagaagctgcacctgatcgcccaggagctgcccttcgacagattcagcgaggtgaagagcaagatcgccagcaagtaccacgacctggagtgccagctgatccaggagttcaccagcgcccagagaagaggcgagatcagcagaatgagagaggtggccgccgtgctgctgcacttcaagggctacagccactgcgtggacgtgtacatcaagcagtgccaggagggcgcctacctgagaaacgacatcttcgaggacgccggcatcctgtgccagagagtgaacaagcaggtgggcgacatcttcagcaaccccgagaccgtgctggccaagctgatccagaacgtgttcgagatcaagctgcagagcttcgtgaaggagcagctggaggagtgcagaaagagcgacgccgagcagtacctgaagaacctgtacgacctgtacaccagaaccaccaacctgagcagcaagctgatggagttcaacctgggcaccgacaagcagaccttcctgagcaagctgatcaagagcatcttcatcagctacctggagaactacatcgaggtggagaccggctacctgaagagcagaagcgccatgatcctgcagagatactacgacagcaagaaccaccagaagagaagcatcggcaccggcggcatccaggacctgaaggagagaatcagacagagaaccaacctgcccctgggccccagcatcgacacccacggcgagaccttcctgagccaggaggtggtggtgaacctgctgcaggagaccaagcaggccttcgagagatgccacagactgagcgaccccagcgacctgcccagaaacgccttcagaatcttcaccatcctggtggagttcctgtgcatcgagcacatcgactacgccctggagaccggcctggccggcatccccagcagcgacagcagaaacgccaacctgtacttcctggacgtggtgcagcaggccaacaccatcttccacctgttcgacaagcagttcaacgaccacctgatgcccctgatcagcagcagccccaagctgagcgagtgcctgcagaagaagaaggagatcatcgagcagatggagatgaagctggacaccggcatcgacagaaccctgaactgcatgatcggccagatgaagcacatcctggccgccgagcagaagaagaccgacttcaagcccgaggacgagaacaacgtgctgatccagtacaccaacgcctgcgtgaaggtgtgcgcctacgtgagaaagcaggtggagaagatcaagaacagcatggacggcaagaacgtggacaccgtgctgatggagctgggcgtgagattccacagactgatctacgagcacctgcagcagtacagctacagctgcatgggcggcatgctggccatctgcgacgtggccgagtacagaaagtgcgccaaggacttcaagatccccatggtgctgcacctgttcgacaccctgcacgccctgtgcaacctgctggtggtggcccccgacaacctgaagcaggtgtgcagcggcgagcagctggccaacctggacaagaacatcctgcacagcttcgtgcagctgagagccgactacagaagcgccagactggccagacacttcagctag

SEQ ID NO: 81022 - DNA, 2415 bp, Artificial Sequence
  Description of Artificial Sequence: Synthetic coding sequence
atggccgagaacagcgagagcctgggcaccgtgcccgagcacgagagaatcctgcaggagatcgagagcaccgacaccgcctgcgtgggccccaccctgagaagcgtgtacgacgaccagcccaacgcccacaagaagttcatggagaagctggacgcctgcatcagaaaccacgacaaggagatcgagaagatgtgcaacttccaccaccagggcttcgtggacgccatcaccgagctgctgaaggtgagaaccgacgccgagaagctgaaggtgcaggtgaccgacaccaacagaagattccaggacgccggcaaggaggtgatcgtgcacaccgaggacatcatcagatgcagaatccagcagagaaacatcaccaccgtggtggagaagctgcagctgtgcctgcccgtgctggagatgtacagcaagctgaaggagcagatgagcgccaagagatactacagcgccctgaagaccatggagcagctggagaacgtgtacttcccctgggtgagccagtacagattctgccagctgatgatcgagaacctgcccaagctgagagaggacatcaaggagatcagcatgagcgacctgaaggacttcctggagagcatcagaaagcacagcgacaagatcggcgagaccgccatgaagcaggcccagcaccagaagaccttcagcgtgagcctgcagaagcagaacaagatgaagttcggcaagaacatgtacatcaacagagacagaatccccgaggagagaaacgagaccgtgctgaagcacagcctggaggaggaggacgagaacgaggaggagatcctgaccgtgcaggacctggtggacttcagccccgtgtacagatgcctgcacatctacagcgtgctgggcgacgaggagaccttcgagaactactacagaaagcagagaaagaagcaggccagactggtgctgcagccccagagcaacatgcacgagaccgtggacggctacagaagatacttcacccagatcgtgggcttcttcgtggtggaggaccacatcctgcacgtgacccagggcctggtgaccagagcctacaccgacgagctgtggaacatggccctgagcaagatcatcgccgtgctgagagcccacagcagctactgcaccgaccccgacctggtgctggagctgaagaacctgaccgtgatcttcgccgacaccctgcagggctacggcttccccgtgaacagactgttcgacctgctgttcgagatcagagaccagtacaacgagaccctgctgaagaagtgggccggcgtgttcagagacatcttcgaggaggacaactacagccccatccccgtggtgaacgaggaggagtacaagatcgtgatcagcaagttccccttccaggaccccgacctggagaagcagagcttccccaagaagttccccatgagccagagcgtgccccacatctacatccaggtgaaggagttcatctacgccagcctgaagttcagcgagagcctgcacagaagcagcaccgagatcgacgacatgctgagaaagagcaccaacctgctgctgaccagaaccctgagcagctgcctgctgaacctgatcagaaagccccacatcggcctgaccgagctggtgcagatcatcatcaacaccacccacctggagcaggcctgcaagtacctggaggacttcatcaccaacatcaccaacatcagccaggagaccgtgcacaccaccagactgtacggcctgagcaccttcaaggacgccagacacgccgccgagggcgagatctacaccaagctgaaccagaagatcgacgagttcgtgcagctggccgactacgactggaccatgagcgagcccgacggcagagccagcggctacctgatggacctgatcaacttcctgagaagcatcttccaggtgttcacccacctgcccggcaaggtggcccagaccgcctgcatgagcgcctgccagcacctgagcaccagcctgatgcagatgctgctggacagcgagctgaagcagatcagcatgggcgccgtgcagcagttcaacctggacgtgatccagtgcgagctgttcgccagcagcgagcccgtgcccggcttccagggcgacaccctgcagctggccttcatcgacctgagacagctgctggacctgttcatggtgtgggactggagcacctacctggccgactacggccagcccgccagcaagtacctgagagtgaaccccaacaccgccctgaccctgctggagaagatgaaggacaccagcaagaagaacaacatcttcgcccagttcagaaagaacgacagagacaagcagaagctgatcgagaccgtggtgaagcagctgagaagcctggtgaacggcatgagccagcacatgtag

SEQ ID NO: 81023 - DNA, 462 bp, Artificial Sequence
  Description of Artificial Sequence: Synthetic coding sequence
atggccgagaacagcgagagcctgggcaccgtgcccgagcacgagagaatcctgcaggagatcgagagcaccgacaccgcctgcgtgggccccaccctgagaagcgtgtacgacgaccagcccaacgcccacaagaagttcatggagaagctggacgcctgcatcagaaaccacgacaaggagatcgagaagatgtgcaacttccaccaccagggcttcgtggacgccatcaccgagctgctgaaggtgagaaccgacgccgagaagctgaaggtgcaggtgaccgacaccaacagaagattccaggacgccggcaaggaggtgatcgtgcacaccgaggacatcatcagatgcagaatccagcagagaaacatcaccaccgtggtggagaagctgcagctgtgcctgcccgtgctggagatgtacagcaagctgaaggagcagatgagcgccaagagatag

SEQ ID NO: 81024 - DNA, 2463 bp, Artificial Sequence
  Description of Artificial Sequence: Synthetic coding sequence
atgtgctgcgtgggcggcgccggcagctgcagcgacaccggcaagctgggcgcctgcagagccatgctggaggaggagaccgaccagacctacgagaacgtgctggccgagatccagagcttcgagctgcccgtggaggccaccctgagaagcgtgtacgacgaccagcccaacgcccacaagaagttcatggagaagctggacgcctgcatcagaaaccacgacaaggagatcgagaagatgtgcaacttccaccaccagggcttcgtggacgccatcaccgagctgctgaaggtgagaaccgacgccgagaagctgaaggtgcaggtgaccgacaccaacagaagattccaggacgccggcaaggaggtgatcgtgcacaccgaggacatcatcagatgcagaatccagcagagaaacatcaccaccgtggtggagaagctgcagctgtgcctgcccgtgctggagatgtacagcaagctgaaggagcagatgagcgccaagagatactacagcgccctgaagaccatggagcagctggagaacgtgtacttcccctgggtgagccagtacagattctgccagctgatgatcgagaacctgcccaagctgagagaggacatcaaggagatcagcatgagcgacctgaaggacttcctggagagcatcagaaagcacagcgacaagatcggcgagaccgccatgaagcaggcccagcaccagaagaccttcagcgtgagcctgcagaagcagaacaagatgaagttcggcaagaacatgtacatcaacagagacagaatccccgaggagagaaacgagaccgtgctgaagcacagcctggaggaggaggacgagaacgaggaggagatcctgaccgtgcaggacctggtggacttcagccccgtgtacagatgcctgcacatctacagcgtgctgggcgacgaggagaccttcgagaactactacagaaagcagagaaagaagcaggccagactggtgctgcagccccagagcaacatgcacgagaccgtggacggctacagaagatacttcacccagatcgtgggcttcttcgtggtggaggaccacatcctgcacgtgacccagggcctggtgaccagagcctacaccgacgagctgtggaacatggccctgagcaagatcatcgccgtgctgagagcccacagcagctactgcaccgaccccgacctggtgctggagctgaagaacctgaccgtgatcttcgccgacaccctgcagggctacggcttccccgtgaacagactgttcgacctgctgttcgagatcagagaccagtacaacgagaccctgctgaagaagtgggccggcgtgttcagagacatcttcgaggaggacaactacagccccatccccgtggtgaacgaggaggagtacaagatcgtgatcagcaagttccccttccaggaccccgacctggagaagcagagcttccccaagaagttccccatgagccagagcgtgccccacatctacatccaggtgaaggagttcatctacgccagcctgaagttcagcgagagcctgcacagaagcagcaccgagatcgacgacatgctgagaaagagcaccaacctgctgctgaccagaaccctgagcagctgcctgctgaacctgatcagaaagccccacatcggcctgaccgagctggtgcagatcatcatcaacaccacccacctggagcaggcctgcaagtacctggaggacttcatcaccaacatcaccaacatcagccaggagaccgtgcacaccaccagactgtacggcctgagcaccttcaaggacgccagacacgccgccgagggcgagatctacaccaagctgaaccagaagatcgacgagttcgtgcagctggccgactacgactggaccatgagcgagcccgacggcagagccagcggctacctgatggacctgatcaacttcctgagaagcatcttccaggtgttcacccacctgcccggcaaggtggcccagaccgcctgcatgagcgcctgccagcacctgagcaccagcctgatgcagatgctgctggacagcgagctgaagcagatcagcatgggcgccgtgcagcagttcaacctggacgtgatccagtgcgagctgttcgccagcagcgagcccgtgcccggcttccagggcgacaccctgcagctggccttcatcgacctgagacagctgctggacctgttcatggtgtgggactggagcacctacctggccgactacggccagcccgccagcaagtacctgagagtgaaccccaacaccgccctgaccctgctggagaagatgaaggacaccagcaagaagaacaacatcttcgcccagttcagaaagaacgacagagacaagcagaagctgatcgagaccgtggtgaagcagctgagaagcctggtgaacggcatgagccagcacatgtag

SEQ ID NO: 81025 - DNA, 2400 bp, Artificial Sequence
  Description of Artificial Sequence: Synthetic coding sequence
atgctggaggaggagaccgaccagacctacgagaacgtgctggccgagatccagagcttcgagctgcccgtggaggccaccctgagaagcgtgtacgacgaccagcccaacgcccacaagaagttcatggagaagctggacgcctgcatcagaaaccacgacaaggagatcgagaagatgtgcaacttccaccaccagggcttcgtggacgccatcaccgagctgctgaaggtgagaaccgacgccgagaagctgaaggtgcaggtgaccgacaccaacagaagattccaggacgccggcaaggaggtgatcgtgcacaccgaggacatcatcagatgcagaatccagcagagaaacatcaccaccgtggtggagaagctgcagctgtgcctgcccgtgctggagatgtacagcaagctgaaggagcagatgagcgccaagagatactacagcgccctgaagaccatggagcagctggagaacgtgtacttcccctgggtgagccagtacagattctgccagctgatgatcgagaacctgcccaagctgagagaggacatcaaggagatcagcatgagcgacctgaaggacttcctggagagcatcagaaagcacagcgacaagatcggcgagaccgccatgaagcaggcccagcaccagaagaccttcagcgtgagcctgcagaagcagaacaagatgaagttcggcaagaacatgtacatcaacagagacagaatccccgaggagagaaacgagaccgtgctgaagcacagcctggaggaggaggacgagaacgaggaggagatcctgaccgtgcaggacctggtggacttcagccccgtgtacagatgcctgcacatctacagcgtgctgggcgacgaggagaccttcgagaactactacagaaagcagagaaagaagcaggccagactggtgctgcagccccagagcaacatgcacgagaccgtggacggctacagaagatacttcacccagatcgtgggcttcttcgtggtggaggaccacatcctgcacgtgacccagggcctggtgaccagagcctacaccgacgagctgtggaacatggccctgagcaagatcatcgccgtgctgagagcccacagcagctactgcaccgaccccgacctggtgctggagctgaagaacctgaccgtgatcttcgccgacaccctgcagggctacggcttccccgtgaacagactgttcgacctgctgttcgagatcagagaccagtacaacgagaccctgctgaagaagtgggccggcgtgttcagagacatcttcgaggaggacaactacagccccatccccgtggtgaacgaggaggagtacaagatcgtgatcagcaagttccccttccaggaccccgacctggagaagcagagcttccccaagaagttccccatgagccagagcgtgccccacatctacatccaggtgaaggagttcatctacgccagcctgaagttcagcgagagcctgcacagaagcagcaccgagatcgacgacatgctgagaaagagcaccaacctgctgctgaccagaaccctgagcagctgcctgctgaacctgatcagaaagccccacatcggcctgaccgagctggtgcagatcatcatcaacaccacccacctggagcaggcctgcaagtacctggaggacttcatcaccaacatcaccaacatcagccaggagaccgtgcacaccaccagactgtacggcctgagcaccttcaaggacgccagacacgccgccgagggcgagatctacaccaagctgaaccagaagatcgacgagttcgtgcagctggccgactacgactggaccatgagcgagcccgacggcagagccagcggctacctgatggacctgatcaacttcctgagaagcatcttccaggtgttcacccacctgcccggcaaggtggcccagaccgcctgcatgagcgcctgccagcacctgagcaccagcctgatgcagatgctgctggacagcgagctgaagcagatcagcatgggcgccgtgcagcagttcaacctggacgtgatccagtgcgagctgttcgccagcagcgagcccgtgcccggcttccagggcgacaccctgcagctggccttcatcgacctgagacagctgctggacctgttcatggtgtgggactggagcacctacctggccgactacggccagcccgccagcaagtacctgagagtgaaccccaacaccgccctgaccctgctggagaagatgaaggacaccagcaagaagaacaacatcttcgcccagttcagaaagaacgacagagacaagcagaagctgatcgagaccgtggtgaagcagctgagaagcctggtgaacggcatgagccagcacatgtag

SEQ ID NO: 81026 - DNA, 2106 bp, Artificial Sequence
  Description of Artificial Sequence: Synthetic coding sequence
atggccgagaacagcgagagcctgggcaccgtgcccgagcacgagagaatcctgcaggagatcgagagcaccgacaccgcctgcgtgggccccaccctgagaagcgtgtacgacgaccagcccaacgcccacaagaagttcatggagaagctggacgcctgcatcagaaaccacgacaaggagatcgagaagatgtgcaacttccaccaccagggcttcgtggacgccatcaccgagctgctgaaggtgagaaccgacgccgagaagctgaaggtgcaggtgaccgacaccaacagaagattccaggacgccggcaaggaggtgatcgtgcacaccgaggacatcatcagatgcagaatccagcagagaaacatcaccaccgtggtggagaagctgcagctgtgcctgcccgtgctggagatgtacagcaagctgaaggagcagatgagcgccaagagatactacagcgccctgaagaccatggagcagctggagaacgtgtacttcccctgggtgagccagtacagattctgccagctgatgatcgagaacctgcccaagctgagagaggacatcaaggagatcagcatgagcgacctgaaggacttcctggagagcatcagaaagcacagcgacaagatcggcgagaccgccatgaagcaggcccagcaccagaagaccttcagcgtgagcctgcagaagcagaacaagatgaagttcggcaagaacatgtacatcaacagagacagaatccccgaggagagaaacgagaccgtgctgaagcacagcctggaggaggaggacgagaacgaggaggagggcgacgaggagaccttcgagaactactacagaaagcagagaaagaagcaggccagactggtgctgcagccccagagcaacatgggctacggcttccccgtgaacagactgttcgacctgctgttcgagatcagagaccagtacaacgagaccctgctgaagaagtgggccggcgtgttcagagacatcttcgaggaggacaactacagccccatccccgtggtgaacgaggaggagtacaagatcgtgatcagcaagttccccttccaggaccccgacctggagaagcagagcttccccaagaagttccccatgagccagagcgtgccccacatctacatccaggtgaaggagttcatctacgccagcctgaagttcagcgagagcctgcacagaagcagcaccgagatcgacgacatgctgagaaagagcaccaacctgctgctgaccagaaccctgagcagctgcctgctgaacctgatcagaaagccccacatcggcctgaccgagctggtgcagatcatcatcaacaccacccacctggagcaggcctgcaagtacctggaggacttcatcaccaacatcaccaacatcagccaggagaccgtgcacaccaccagactgtacggcctgagcaccttcaaggacgccagacacgccgccgagggcgagatctacaccaagctgaaccagaagatcgacgagttcgtgcagctggccgactacgactggaccatgagcgagcccgacggcagagccagcggctacctgatggacctgatcaacttcctgagaagcatcttccaggtgttcacccacctgcccggcaaggtggcccagaccgcctgcatgagcgcctgccagcacctgagcaccagcctgatgcagatgctgctggacagcgagctgaagcagatcagcatgggcgccgtgcagcagttcaacctggacgtgatccagtgcgagctgttcgccagcagcgagcccgtgcccggcttccagggcgacaccctgcagctggccttcatcgacctgagacagctgctggacctgttcatggtgtgggactggagcacctacctggccgactacggccagcccgccagcaagtacctgagagtgaaccccaacaccgccctgaccctgctggagaagatgaaggacaccagcaagaagaacaacatcttcgcccagttcagaaagaacgacagagacaagcagaagctgatcgagaccgtggtgaagcagctgagaagcctggtgaacggcatgagccagcacatgtag

SEQ ID NO: 81027 - DNA, 219 bp, Artificial Sequence
  Description of Artificial Sequence: Synthetic coding sequence
ggcaaggtggcccagaccgcctgcatgagcgcctgccagcacctgagcaccagcctgatgcagatgctgctggacagcgagctgaagcagatcagcatgggcgccgtgcagcagttcaacctggacgtgatccagtgcgagctgttcgccagcagcgagcccgtgcccggcttccagggcgacaccctgcagctggccttcatcgacctgagacagtag

SEQ ID NO: 81028 - DNA, 2436 bp, Artificial Sequence
  Description of Artificial Sequence: Synthetic coding sequence
atggagagaggcaagatggccgaggccgagagcctggagaccgccgccgagcacgagagaatcctgagagagatcgagagcaccgacaccgcctgcatcggccccaccctgagaagcgtgtacgacggcgaggagcacggcagattcatggagaagctggagaccagaatcagaaaccacgacagagagatcgagaagatgtgcaacttccactaccagggcttcgtggacagcatcaccgagctgctgaaggtgagaggcgaggcccagaagctgaagaaccaggtgaccgacaccaacagaaagctgcagcacgagggcaaggagctggtgatcgccatggaggagctgaagcagtgcagactgcagcagagaaacatcagcgccaccgtggacaagctgatgctgtgcctgcccgtgctggagatgtacagcaagctgagagaccagatgaagaccaagagacactaccccgccctgaagaccctggagcacctggagcacacctacctgccccaggtgagccactacagattctgcaaggtgatggtggacaacatccccaagctgagagaggagatcaaggacgtgagcatgagcgacctgaaggacttcctggagagcatcagaaagcacagcgacaagatcggcgagaccgccatgaagcaggcccagcagcagagaaacctggacaacatcgtgctgcagcagcccagaatcggcagcaagagaaagagcaagaaggacgcctacatcatcttcgacaccgagatcgagagcaccagccccaagagcgagcaggacagcggcatcctggacgtggaggacgaggaggacgacgaggaggtgcccggcgcccaggacctggtggacttcagccccgtgtacagatgcctgcacatctacagcgtgctgggcgccagagagaccttcgagaactactacagaaagcagagaagaaagcaggccagactggtgctgcagccccccagcaacatgcacgagaccctggacggctacagaaagtacttcaaccagatcgtgggcttcttcgtggtggaggaccacatcctgcacaccacccagggcctggtgaacagagcctacatcgacgagctgtgggagatggccctgagcaagaccatcgccgccctgagaacccacagcagctactgcagcgaccccaacctggtgctggacctgaagaacctgatcgtgctgttcgccgacaccctgcaggtgtacggcttccccgtgaaccagctgttcgacatgctgctggagatcagagaccagtacagcgagaccctgctgaagaagtgggccggcatcttcagaaacatcctggacagcgacaactacagccccatccccgtgaccagcgaggagatgtacaagaaggtggtgggccagttccccttccaggacatcgagctggagaagcagcccttccccaagaagttccccttcagcgagttcgtgcccaaggtgtacaaccagatcaaggagttcatctacgcctgcctgaagttcagcgaggacctgcacctgagcagcaccgaggtggacgacatgatcagaaagagcaccaacctgctgctgaccagaaccctgagcaacagcctgcagaacgtgatcaagagaaagaacatcggcctgaccgagctggtgcagatcatcatcaacaccacccacctggagaagagctgcaagtacctggaggagttcatcaccaacatcaccaacgtgctgcccgagaccgtgcacaccaccaagctgtacggcaccaccaccttcaaggacgccagacacgccgccgaggaggagatctacaccaacctgaaccagaagatcgaccagttcctgcagctggccgactacgactggatgaccggcgacctgggcaacaaggccagcgactacctggtggacctgatcgccttcctgagaagcaccttcgccgtgttcacccacctgcccggcaaggtggcccagaccgcctgcatgagcgcctgcaagcacctggccaccagcctgatgcagctgctgctggaggccgaggtgagacagctgaccctgggcgccctgcagcagttcaacctggacgtgagagagtgcgagcagttcgccagaagcggccccgtgcccggcttccaggaggacaccctgcagctggccttcatcgacctgagacagctgctggacctgttcatccagtgggactggagcacctacctggccgactacggccagcccaactgcaagtacctgagagtgaaccccgtgaccgccctgaccctgctggagaagatgaaggacaccagcagaaagaacaacatgttcgcccagttcagaaagaacgagagagacaagcagaagctgatcgacaccgtggccaagcagctgagaggcctgatcagcagccaccacagctag

SEQ ID NO: 81029 - DNA, 2016 bp, Artificial Sequence
  Description of Artificial Sequence: Synthetic coding sequence
atggagagaggcaagatggccgaggccgagagcctggagaccgccgccgagcacgagagaatcctgagagagatcgagagcaccgacaccgcctgcatcggccccaccctgagaagcgtgtacgacggcgaggagcacggcagattcatggagaagctggagaccagaatcagaaaccacgacagagagatcgagaagatgtgcaacttccactaccagggcttcgtggacagcatcaccgagctgctgaaggtgagaggcgaggcccagaagctgaagaaccaggtgaccgacaccaacagaaagctgcagcacgagggcaaggagctggtgatcgccatggaggagctgaagcagtgcagactgcagcagagaaacatcagcgccaccgtggacaagctgatgctgtgcctgcccgtgctggagatgtacagcaagctgagagaccagatgaagaccaagagacactaccccgccctgaagaccctggagcacctggagcacacctacctgccccaggtgagccactacagattctgcaaggtgatggtggacaacatccccaagctgagagaggagatcaaggacgtgagcatgagcgacctgaaggacttcctggagagcatcagaaagcacagcgacaagatcggcgagaccgccatgaagcaggcccagcagcagagaaacctggacaacatcgtgctgcagcagcccagaatcggcagcaagagaaagagcaagaaggacgcctacatcatcttcgacaccgagatcgagagcaccagccccaagagcgagcaggacagcggcatcctggacgtggaggacgaggaggacgacgaggaggtgcccggcgcccaggacctggtggacttcagccccgtgtacagatgcctgcacatctacagcgtgctgggcgccagagagaccttcgagaactactacagaaagcagagaagaaagcaggccagactggtgctgcagccccccagcaacatgcacgagaccctggacggctacagaaagtacttcaaccagatcgtgggcttcttcgtggtggaggaccacatcctgcacaccacccagggcctggtgaacagagcctacatcgacgagctgtgggagatggccctgagcaagaccatcgccgccctgagaacccacagcagctactgcagcgaccccaacctggtgctggacctgaagaacctgatcgtgctgttcgccgacaccctgcaggtgtacggcttccccgtgaaccagctgttcgacatgctgctggagatcagagaccagtacagcgagaccctgctgaagaagtgggccggcatcttcagaaacatcctggacagcgacaactacagccccatccccgtgaccagcgaggagatgtacaagaaggtggtgggccagttccccttccaggacatcgagctggagaagcagcccttccccaagaagttccccttcagcgagttcgtgcccaaggtgtacaaccagatcaaggagttcatctacgcctgcctgaagttcagcgaggacctgcacctgagcagcaccgaggtggacgacatgatcagaaagagcaccaacctgctgctgaccagaaccctgagcaacagcctgcagaacgtgatcaagagaaagaacatcggcctgaccgagctggtgcagatcatcatcaacaccacccacctggagaagagctgcaagtacctggaggagttcatcaccaacatcaccaacgtgctgcccgagaccgtgcacaccaccaagctgtacggcaccaccaccttcaaggacgccagacacgccgccgaggaggagatctacaccaacctgaaccagaagatcgaccagttcctgcagctggccgactacgactggatgaccggcgacctgggcaacaaggccagcgactacctggtggacctgatcgccttcctgagaagcaccttcgccgtgttcacccacctgcccgtgagcggcagctgctacttcgtgctgtacatctag

SEQ ID NO: 81030 - DNA, 5970 bp, Artificial Sequence
  Description of Artificial Sequence: Synthetic coding sequence
atgaccaaggtgccccccgccttcgacttcagcttcctgaacgacgaggaggccagaaagatcctgcaggtgctggagagaaacgaggagctgcagagagccgagaaggacagaatcagcaagctgcagaagaccaagagagacatcagatggctgcagggcgtgaccggcgagtggttcgaggagatccagagaaagaagttctgcaacgagaccgacgtgagccagatgctgaagcagcccctgacctacagactgagcaaggagatggccaagaacgaccccatcgagctgcccaccagcagaagcaagaacgtgaccaaccagaagaagcccacccccttcagcagcagaatgagcttcagaagcagcttcgccagcctgttcagcttcagaaagagcggcaaggagaccagcaagctgcccagcctgggccagaagggctgcgacggccacgccggcccccccatgcccgtgagaggcgccgccgtgcaggccaagatctacaacagccccctggagaaccacctggtggacagcaccttcgtgcccaagcccgccgtgatgagagaggagagcggcatgccccccccctgggacgccagcctgctggagaacgagttcttccaggtgctggacgacctggacagcaagctggcccaggagcagagcgccagcagcgtgaacaccagaacccccctgaactacggcagcagaacccagttcggccacttctacagcagcggcaacagacacggcaacatcaccgagagacacaagaagcactacaacgagaccagcaacatgagcatctacgacatcctgagacccggcacccccagagagggcttcaagaccttcagccccagaaccagcaccatctacgacatgtacagaaccagagagcccagagtgttcaaggaggactacgtgcagaagaacaccttcggcagcaccagcctgtgcttcgacagcagacagagaagcgccctgcccgccaccggccacttcaccgccagaagcctgcacttccccgccaccacccagagcaagagcggcttcatcccccccagacaccagcagagccccaagagaacccccctgagcagcatcatctggaacagaagcgacagcagcagagacagagagaaccaggaggagttcctgagagcccccagccccatggagatcgaccccgccgacaagtacgtgtaccccagaggcttccaggagaacaagagatacgagagctaccacagccagaacgtgtaccagagagtgagcctgaacgcccccatggagaacgccatgagccccgacaccttcgagaacagcgagaacatgcccttctaccaccagagcaacaccttcaccagaagcttcttcagcaacaccttcggcagaagcggcgagcagagaagattcggccagggccccttctggggccaggagaagggccacagcttctggagcgacttccacagaagcagaaagagcttcagcagcagcgacagagacttcgagatgatcagcatggaggccaacagcgtgagcgccatccacggccacaacgtgagcagcgagcactgggagagcttcagcagcggctacggcaccgacgtgagcagaggccaggaggagccccacccctggcagttcgacttccagagaagcaccctggacagcatggtggtgagccacggcaacgagacccagctgaccccccacttcggcacccccaacgtgtgcagcatgaccggcagcagctaccacgtgaagagcagcgagctggtgagccagcaggacagcagccccgtggaggtgcacatcaacaaggaggccagcagcttcggcatcgcccagaccctggccagcagcttcaagaccagcttcagccagatcagcgacgacagaagaaacccccagagccccaacctgcagaaccccaccgtgaccctgcagaagatcttccccaacaagcccgccagccaccccatgagaagccacaccgaggtgaccgtgaccagcagcaacagcgtggacagcctgcccctggccaagagccagcccaacatcctggtgaccgaggtgaacaacgagaaggacctgaacgagagcatcagcgaggaggacaagcagctgagcaagatggaccagaccaacaaggccggcgagatcccccagcccgtgagccagaccggcatcagcaacagcctgcccgacttccagaaccccctgagccaggacagcgccaagagcaacggcttcggcttcaacgccagcaccatcatcagcagcaagaagagccccagagtgttcagcagaaaggacaccagcaagatgtacatcccccacaccgacaagagcaacgacatcaagcaggacaagagattcaccgagaacagaaagctgggcagcaccgccagcctgcccttcatccaggagcacagaaccccccccagcttccccagaaccgaccagggctgccaccaggagctgaccgtgaacaacgaggacatcagcagaatcatcaccaacaaccactggagcagcgccctgaccgacacccagaacgcccagtacagcaagtgcaagctgacccccggccacaagaccagctgcgacagcctggacctgagcagcgccgccctgcccgacagcagccccagcaagaacagcagcctggacgcccccgtggtgcccagcaccaccgtgttcagcagaagaagccccagcgacaaggaccccagcctgggcgagagagaggagaaggacaacgccggcaagaaccagaagaaccagttcatcgtgagccacagcgagaaccaggagagaaacgacagccccgtgcccacccacgacgaggtggtggacgtgaagtgccacagccacagccccttcagaaacgagagaggcaagggcaagatcagacaccacatcagctgcatcgagaagctgagcaagaccgagagcatcagcgtgcccaccagcgaccacagaagcctgatcgaggccaaccagagcaacagcaaggtgagcgagctggacaccatctactgcaccctgcccagaaagagcagcagcttcctgatccacggcagacagagcggcagcaagatcatggccgccagcctgagaaacggccccccccccttccagatcaagaacaacgtggaggacgccatgggcaactacatgctgaacaagttcagccccagcagccccgagagcgccaacgagtgcagcaaggtgctgagcgacagcgccctggaggcccccgaggccaccgagagaatgaccaacgtgaagagcagcggcagcaccagcgtgagaaagggccccctgcccttcctgatcaacagagccatgagctgccccagcggcgagccccacgccagcaccggcagagagggcagaaagaagcccctgaccagcggcatggacgccagcgagctgacccccagagcctgggagagaatcatcagccccgtggagagcgacagcagcgtgagagactgcagcctgaccaagagacagcaccagaaggagaacttccaggagtacaccgagaaggagggcaagatggccgccagcagaagaagcgtgttcgccctgagcaacgaggaccccctgcccttctgcagcgacctgagcggcaaggagagaggcaagaccctgcacaaggtgaagaccaccagcaccttcagcgtgagcggcgacgaggacaacgtgaagtgcctggaggtggtgagcatctactacaccctgcccagaaagcccagcaagaagttctgcaacctgctgcagcagtacacccagaacaccaacctgctgatcgagagcccccaggtggagaccgagaccttccccaacgccctggagaaggacaagcagaactacagcaccagagagcagagcggcacccccagctgcgagaacctgaagatgagcgtgaacagcgaccagaccctgaccaccgagaacatgaccgccttcagactgagcaacagaggccccctggcccccaccctgcaggagatggccagcgtggaggccgccgtgagcctgcccgaggaggagagcaaggccagagagatcttcagcgacaacctggccaagacccccctgggcgacagcgagaacaagaaggagagaggcaagaagctgcagagcgagaccctgcacaccagcctgatgctgcagagaaagaacgtgagcgaggagaagagcgagaactgccagcagagcatcaacagcagcaacagcggccccagcagcctgcccgccctgagcgaggtgaacatcggcaacagccagaccagaagaagcagctgggagtgcaccggcagcggcagagccatccccttcaccggcagcggcaagtgcccccagaaggaccacaccagcaccgccgtgggcgacggcagcagcggcagccagcccagagagggcagaggcgacatcggcaccaactgccagaagatgaccaacaagaccctgagccacagcgagagccaggtgttcgccctgacccccgccctgcacaagctgcagctgggcgaggagacccagagcgacgagcccaacctggagagcctgcagagcgagcccagagagctgccccagagaagccaggaggccaacatgaccgagagcagaaaggccgaggacgagatgcagaagagcgcctgggaccagcccagcctgcccgagggcaacaagaacaagaccaacctggacgacctggtgaagggcgagaacagaagcagcgtgaagcacagactggccgccatgagcaaggccagcagaaagttccccgccaaggacgtgagccccagaagacacgtggccaccatcttcccccagagcggcagcagaagcggcttcgaccacctgagcctgggcaccgtggagtgcaaccccctgttccccgagcccacccccaagagcgccgagagcatcggcgagagcagactgagcgagaacggcaagcacgtgaagaagagcgagaacctgctgcccatcaccgtgctgcccaacagagagcccagcacccacgtgagcaaccagaagagcaacagcatcagccagagacaccagaacgagttcaagaacgtgagcgagagccccagcaagcacgagaacagcaaggacgtgaccgccgcccagaacctggtgagagagagcggcgcccccagccccatcaccttcaccagcctgagagaggccgagttcagcgacaaccagagaagactgagcccccccttccccctggagcccgcccagaagagcagagtgagcagccccctggccagcttcctgcagcagcagagaagcgccagcagcctggagtgggagcccgagccccacctgtacagaagcaagagcctgaagagcatcaacgtgcacggcgacctgctgagaaagagccacccccccaaggtgagagagagacacttcagcgagagcaccagcatcgacaacgccctgagcagactgaccctgggcaacgagttcagcgtgaacaacggctacagcagaagattcagaagcttcagcgagctgcccagctgcgacggcaacgagagctgggcctacagaagcggcaccaagaccggccccagaagcgccatcagcatctacagacccatcgactacggcatcttcggcaaggagcagcagctggccttcctggagaacgtgaagagaagcctgacccagggcagactgtggaagcccagcttcctgaagaaccccggcttcctgaaggacgacctgagaaacccccccaaccccagcgagagcctgagcagcaacagccccagcagccaggtgcccgaggacggcctgagccccagcgagcccctgaacatctacgaggacgaccccgtggacagcaactgcgacaccgacaccaccaccgacgacgagtactacctggacgagaacgacaaggagagcgagctgtag

SEQ ID NO: 81031 - DNA, 5742 bp, Artificial Sequence
  Description of Artificial Sequence: Synthetic coding sequence
atgctgaagcagcccctgacctacagactgagcaaggagatggccaagaacgaccccatcgagctgcccaccagcagaagcaagaacgtgaccaaccagaagaagcccacccccttcagcagcagaatgagcttcagaagcagcttcgccagcctgttcagcttcagaaagagcggcaaggagaccagcaagctgcccagcctgggccagaagggctgcgacggccacgccggcccccccatgcccgtgagaggcgccgccgtgcaggccaagatctacaacagccccctggagaaccacctggtggacagcaccttcgtgcccaagcccgccgtgatgagagaggagagcggcatgccccccccctgggacgccagcctgctggagaacgagttcttccaggtgctggacgacctggacagcaagctggcccaggagcagagcgccagcagcgtgaacaccagaacccccctgaactacggcagcagaacccagttcggccacttctacagcagcggcaacagacacggcaacatcaccgagagacacaagaagcactacaacgagaccagcaacatgagcatctacgacatcctgagacccggcacccccagagagggcttcaagaccttcagccccagaaccagcaccatctacgacatgtacagaaccagagagcccagagtgttcaaggaggactacgtgcagaagaacaccttcggcagcaccagcctgtgcttcgacagcagacagagaagcgccctgcccgccaccggccacttcaccgccagaagcctgcacttccccgccaccacccagagcaagagcggcttcatcccccccagacaccagcagagccccaagagaacccccctgagcagcatcatctggaacagaagcgacagcagcagagacagagagaaccaggaggagttcctgagagcccccagccccatggagatcgaccccgccgacaagtacgtgtaccccagaggcttccaggagaacaagagatacgagagctaccacagccagaacgtgtaccagagagtgagcctgaacgcccccatggagaacgccatgagccccgacaccttcgagaacagcgagaacatgcccttctaccaccagagcaacaccttcaccagaagcttcttcagcaacaccttcggcagaagcggcgagcagagaagattcggccagggccccttctggggccaggagaagggccacagcttctggagcgacttccacagaagcagaaagagcttcagcagcagcgacagagacttcgagatgatcagcatggaggccaacagcgtgagcgccatccacggccacaacgtgagcagcgagcactgggagagcttcagcagcggctacggcaccgacgtgagcagaggccaggaggagccccacccctggcagttcgacttccagagaagcaccctggacagcatggtggtgagccacggcaacgagacccagctgaccccccacttcggcacccccaacgtgtgcagcatgaccggcagcagctaccacgtgaagagcagcgagctggtgagccagcaggacagcagccccgtggaggtgcacatcaacaaggaggccagcagcttcggcatcgcccagaccctggccagcagcttcaagaccagcttcagccagatcagcgacgacagaagaaacccccagagccccaacctgcagaaccccaccgtgaccctgcagaagatcttccccaacaagcccgccagccaccccatgagaagccacaccgaggtgaccgtgaccagcagcaacagcgtggacagcctgcccctggccaagagccagcccaacatcctggtgaccgaggtgaacaacgagaaggacctgaacgagagcatcagcgaggaggacaagcagctgagcaagatggaccagaccaacaaggccggcgagatcccccagcccgtgagccagaccggcatcagcaacagcctgcccgacttccagaaccccctgagccaggacagcgccaagagcaacggcttcggcttcaacgccagcaccatcatcagcagcaagaagagccccagagtgttcagcagaaaggacaccagcaagatgtacatcccccacaccgacaagagcaacgacatcaagcaggacaagagattcaccgagaacagaaagctgggcagcaccgccagcctgcccttcatccaggagcacagaaccccccccagcttccccagaaccgaccagggctgccaccaggagctgaccgtgaacaacgaggacatcagcagaatcatcaccaacaaccactggagcagcgccctgaccgacacccagaacgcccagtacagcaagtgcaagctgacccccggccacaagaccagctgcgacagcctggacctgagcagcgccgccctgcccgacagcagccccagcaagaacagcagcctggacgcccccgtggtgcccagcaccaccgtgttcagcagaagaagccccagcgacaaggaccccagcctgggcgagagagaggagaaggacaacgccggcaagaaccagaagaaccagttcatcgtgagccacagcgagaaccaggagagaaacgacagccccgtgcccacccacgacgaggtggtggacgtgaagtgccacagccacagccccttcagaaacgagagaggcaagggcaagatcagacaccacatcagctgcatcgagaagctgagcaagaccgagagcatcagcgtgcccaccagcgaccacagaagcctgatcgaggccaaccagagcaacagcaaggtgagcgagctggacaccatctactgcaccctgcccagaaagagcagcagcttcctgatccacggcagacagagcggcagcaagatcatggccgccagcctgagaaacggccccccccccttccagatcaagaacaacgtggaggacgccatgggcaactacatgctgaacaagttcagccccagcagccccgagagcgccaacgagtgcagcaaggtgctgagcgacagcgccctggaggcccccgaggccaccgagagaatgaccaacgtgaagagcagcggcagcaccagcgtgagaaagggccccctgcccttcctgatcaacagagccatgagctgccccagcggcgagccccacgccagcaccggcagagagggcagaaagaagcccctgaccagcggcatggacgccagcgagctgacccccagagcctgggagagaatcatcagccccgtggagagcgacagcagcgtgagagactgcagcctgaccaagagacagcaccagaaggagaacttccaggagtacaccgagaaggagggcaagatggccgccagcagaagaagcgtgttcgccctgagcaacgaggaccccctgcccttctgcagcgacctgagcggcaaggagagaggcaagaccctgcacaaggtgaagaccaccagcaccttcagcgtgagcggcgacgaggacaacgtgaagtgcctggaggtggtgagcatctactacaccctgcccagaaagcccagcaagaagttctgcaacctgctgcagcagtacacccagaacaccaacctgctgatcgagagcccccaggtggagaccgagaccttccccaacgccctggagaaggacaagcagaactacagcaccagagagcagagcggcacccccagctgcgagaacctgaagatgagcgtgaacagcgaccagaccctgaccaccgagaacatgaccgccttcagactgagcaacagaggccccctggcccccaccctgcaggagatggccagcgtggaggccgccgtgagcctgcccgaggaggagagcaaggccagagagatcttcagcgacaacctggccaagacccccctgggcgacagcgagaacaagaaggagagaggcaagaagctgcagagcgagaccctgcacaccagcctgatgctgcagagaaagaacgtgagcgaggagaagagcgagaactgccagcagagcatcaacagcagcaacagcggccccagcagcctgcccgccctgagcgaggtgaacatcggcaacagccagaccagaagaagcagctgggagtgcaccggcagcggcagagccatccccttcaccggcagcggcaagtgcccccagaaggaccacaccagcaccgccgtgggcgacggcagcagcggcagccagcccagagagggcagaggcgacatcggcaccaactgccagaagatgaccaacaagaccctgagccacagcgagagccaggtgttcgccctgacccccgccctgcacaagctgcagctgggcgaggagacccagagcgacgagcccaacctggagagcctgcagagcgagcccagagagctgccccagagaagccaggaggccaacatgaccgagagcagaaaggccgaggacgagatgcagaagagcgcctgggaccagcccagcctgcccgagggcaacaagaacaagaccaacctggacgacctggtgaagggcgagaacagaagcagcgtgaagcacagactggccgccatgagcaaggccagcagaaagttccccgccaaggacgtgagccccagaagacacgtggccaccatcttcccccagagcggcagcagaagcggcttcgaccacctgagcctgggcaccgtggagtgcaaccccctgttccccgagcccacccccaagagcgccgagagcatcggcgagagcagactgagcgagaacggcaagcacgtgaagaagagcgagaacctgctgcccatcaccgtgctgcccaacagagagcccagcacccacgtgagcaaccagaagagcaacagcatcagccagagacaccagaacgagttcaagaacgtgagcgagagccccagcaagcacgagaacagcaaggacgtgaccgccgcccagaacctggtgagagagagcggcgcccccagccccatcaccttcaccagcctgagagaggccgagttcagcgacaaccagagaagactgagcccccccttccccctggagcccgcccagaagagcagagtgagcagccccctggccagcttcctgcagcagcagagaagcgccagcagcctggagtgggagcccgagccccacctgtacagaagcaagagcctgaagagcatcaacgtgcacggcgacctgctgagaaagagccacccccccaaggtgagagagagacacttcagcgagagcaccagcatcgacaacgccctgagcagactgaccctgggcaacgagttcagcgtgaacaacggctacagcagaagattcagaagcttcagcgagctgcccagctgcgacggcaacgagagctgggcctacagaagcggcaccaagaccggccccagaagcgccatcagcatctacagacccatcgactacggcatcttcggcaaggagcagcagctggccttcctggagaacgtgaagagaagcctgacccagggcagactgtggaagcccagcttcctgaagaaccccggcttcctgaaggacgacctgagaaacccccccaaccccagcgagagcctgagcagcaacagccccagcagccaggtgcccgaggacggcctgagccccagcgagcccctgaacatctacgaggacgaccccgtggacagcaactgcgacaccgacaccaccaccgacgacgagtactacctggacgagaacgacaaggagagcgagctgtag

SEQ ID NO: 81032 - DNA, 2460 bp, Artificial Sequence
  Description of Artificial Sequence: Synthetic coding sequence
atgcccgtgagaggcgccgccgtgcaggccaagatctacaacagccccctggagaaccacctggtggacagcaccttcgtgcccaagcccgccgtgatgagagaggagagcggcatgccccccccctgggacgccagcctgctggagaacgagttcttccaggtgctggacgacctggacagcaagctggcccaggagcagagcgccagcagcgtgaacaccagaacccccctgaactacggcagcagaacccagttcggccacttctacagcagcggcaacagacacggcaacatcaccgagagacacaagaagcactacaacgagaccagcaacatgagcatctacgacatcctgagacccggcacccccagagagggcttcaagaccttcagccccagaaccagcaccatctacgacatgtacagaaccagagagcccagagtgttcaaggaggactacgtgcagaagaacaccttcggcagcaccagcctgtgcttcgacagcagacagagaagcgccctgcccgccaccggccacttcaccgccagaagcctgcacttccccgccaccacccagagcaagagcggcttcatcccccccagacaccagcagagccccaagagaacccccctgagcagcatcatctggaacagaagcgacagcagcagagacagagagaaccaggaggagttcctgagagcccccagccccatggagatcgaccccgccgacaagtacgtgtaccccagaggcttccaggagaacaagagatacgagagctaccacagccagaacgtgtaccagagagtgagcctgaacgcccccatggagaacgccatgagccccgacaccttcgagaacagcgagaacatgcccttctaccaccagagcaacaccttcaccagaagcttcttcagcaacaccttcggcagaagcggcgagcagagaagattcggccagggccccttctggggccaggagaagggccacagcttctggagcgacttccacagaagcagaaagagcttcagcagcagcgacagagacttcgagatgatcagcatggaggccaacagcgtgagcgccatccacggccacaacgtgagcagcgagcactgggagagcttcagcagcggctacggcaccgacgtgagcagaggccaggaggagccccacccctggcagttcgacttccagagaagcaccctggacagcatggtggtgagccacggcaacgagacccagctgaccccccacttcggcacccccaacgtgtgcagcatgaccggcagcagctaccacgtgaagagcagcgagctggtgagccagcaggacagcagccccgtggaggtgcacatcaacaaggaggccagcagcttcggcatcgcccagaccctggccagcagcttcaagaccagcttcagccagatcagcgacgacagaagaaacccccagagccccaacctgcagaaccccaccgtgaccctgcagaagatcttccccaacaagcccgccagccaccccatgagaagccacaccgaggtgaccgtgaccagcagcaacagcgtggacagcctgcccctggccaagagccagcccaacatcctggtgaccgaggtgaacaacgagaacagcaaggacgtgaccgccgcccagaacctggtgagagagagcggcgcccccagccccatcaccttcaccagcctgagagaggccgagttcagcgacaaccagagaagactgagcccccccttccccctggagcccgcccagaagagcagagtgagcagccccctggccagcttcctgcagcagcagagaagcgccagcagcctggagtgggagcccgagccccacctgtacagaagcaagagcctgaagagcatcaacgtgcacggcgacctgctgagaaagagccacccccccaaggtgagagagagacacttcagcgagagcaccagcatcgacaacgccctgagcagactgaccctgggcaacgagttcagcgtgaacaacggctacagcagaagattcagaagcttcagcgagctgcccagctgcgacggcaacgagagctgggcctacagaagcggcaccaagaccggccccagaagcgccatcagcatctacagacccatcgactacggcatcttcggcaaggagcagcagctggccttcctggagaacgtgaagagaagcctgacccagggcagactgtggaagcccagcttcctgaagaaccccggcttcctgaaggacgacctgagaaacccccccaaccccagcgagagcctgagcagcaacagccccagcagccaggtgcccgaggacggcctgagccccagcgagcccctgaacatctacgaggacgaccccgtggacagcaactgcgacaccgacaccaccaccgacgacgagtactacctggacgagaacgacaaggagagcgagctgtag

SEQ ID NO: 81033 - DNA, 5406 bp, Artificial Sequence
  Description of Artificial Sequence: Synthetic coding sequence
atgagagaggagagcggcatgccccccccctgggacgccagcctgctggagaacgagttcttccaggtgctggacgacctggacagcaagctggcccaggagcagagcgccagcagcgtgaacaccagaacccccctgaactacggcagcagaacccagttcggccacttctacagcagcggcaacagacacggcaacatcaccgagagacacaagaagcactacaacgagaccagcaacatgagcatctacgacatcctgagacccggcacccccagagagggcttcaagaccttcagccccagaaccagcaccatctacgacatgtacagaaccagagagcccagagtgttcaaggaggactacgtgcagaagaacaccttcggcagcaccagcctgtgcttcgacagcagacagagaagcgccctgcccgccaccggccacttcaccgccagaagcctgcacttccccgccaccacccagagcaagagcggcttcatcccccccagacaccagcagagccccaagagaacccccctgagcagcatcatctggaacagaagcgacagcagcagagacagagagaaccaggaggagttcctgagagcccccagccccatggagatcgaccccgccgacaagtacgtgtaccccagaggcttccaggagaacaagagatacgagagctaccacagccagaacgtgtaccagagagtgagcctgaacgcccccatggagaacgccatgagccccgacaccttcgagaacagcgagaacatgcccttctaccaccagagcaacaccttcaccagaagcttcttcagcaacaccttcggcagaagcggcgagcagagaagattcggccagggccccttctggggccaggagaagggccacagcttctggagcgacttccacagaagcagaaagagcttcagcagcagcgacagagacttcgagatgatcagcatggaggccaacagcgtgagcgccatccacggccacaacgtgagcagcgagcactgggagagcttcagcagcggctacggcaccgacgtgagcagaggccaggaggagccccacccctggcagttcgacttccagagaagcaccctggacagcatggtggtgagccacggcaacgagacccagctgaccccccacttcggcacccccaacgtgtgcagcatgaccggcagcagctaccacgtgaagagcagcgagctggtgagccagcaggacagcagccccgtggaggtgcacatcaacaaggaggccagcagcttcggcatcgcccagaccctggccagcagcttcaagaccagcttcagccagatcagcgacgacagaagaaacccccagagccccaacctgcagaaccccaccgtgaccctgcagaagatcttccccaacaagcccgccagccaccccatgagaagccacaccgaggtgaccgtgaccagcagcaacagcgtggacagcctgcccctggccaagagccagcccaacatcctggtgaccgaggtgaacaacgagaaggacctgaacgagagcatcagcgaggaggacaagcagctgagcaagatggaccagaccaacaaggccggcgagatcccccagcccgtgagccagaccggcatcagcaacagcctgcccgacttccagaaccccctgagccaggacagcgccaagagcaacggcttcggcttcaacgccagcaccatcatcagcagcaagaagagccccagagtgttcagcagaaaggacaccagcaagatgtacatcccccacaccgacaagagcaacgacatcaagcaggacaagagattcaccgagaacagaaagctgggcagcaccgccagcctgcccttcatccaggagcacagaaccccccccagcttccccagaaccgaccagggctgccaccaggagctgaccgtgaacaacgaggacatcagcagaatcatcaccaacaaccactggagcagcgccctgaccgacacccagaacgcccagtacagcaagtgcaagctgacccccggccacaagaccagctgcgacagcctggacctgagcagcgccgccctgcccgacagcagccccagcaagaacagcagcctggacgcccccgtggtgcccagcaccaccgtgttcagcagaagaagccccagcgacaaggaccccagcctgggcgagagagaggagaaggacaacgccggcaagaaccagaagaaccagttcatcgtgagccacagcgagaaccaggagagaaacgacagccccgtgcccacccacgacgaggtggtggacgtgaagtgccacagccacagccccttcagaaacgagagaggcaagggcaagatcagacaccacatcagctgcatcgagaagctgagcaagaccgagagcatcagcgtgcccaccagcgaccacagaagcctgatcgaggccaaccagagcaacagcaaggtgagcgagctggacaccatctactgcaccctgcccagaaagagcagcagcttcctgatccacggcagacagagcggcagcaagatcatggccgccagcctgagaaacggccccccccccttccagatcaagaacaacgtggaggacgccatgggcaactacatgctgaacaagttcagccccagcagccccgagagcgccaacgagtgcagcaaggtgctgagcgacagcgccctggaggcccccgaggccaccgagagaatgaccaacgtgaagagcagcggcagcaccagcgtgagaaagggccccctgcccttcctgatcaacagagccatgagctgccccagcggcgagccccacgccagcaccggcagagagggcagaaagaagcccctgaccagcggcatggacgccagcgagctgacccccagagcctgggagagaatcatcagccccgtggagagcgacagcagcgtgagagactgcagcctgaccaagagacagcaccagaaggagaacttccaggagtacaccgagaaggagggcaagatggccgccagcagaagaagcgtgttcgccctgagcaacgaggaccccctgcccttctgcagcgacctgagcggcaaggagagaggcaagaccctgcacaaggtgaagaccaccagcaccttcagcgtgagcggcgacgaggacaacgtgaagtgcctggaggtggtgagcatctactacaccctgcccagaaagcccagcaagaagttctgcaacctgctgcagcagtacacccagaacaccaacctgctgatcgagagcccccaggtggagaccgagaccttccccaacgccctggagaaggacaagcagaactacagcaccagagagcagagcggcacccccagctgcgagaacctgaagatgagcgtgaacagcgaccagaccctgaccaccgagaacatgaccgccttcagactgagcaacagaggccccctggcccccaccctgcaggagatggccagcgtggaggccgccgtgagcctgcccgaggaggagagcaaggccagagagatcttcagcgacaacctggccaagacccccctgggcgacagcgagaacaagaaggagagaggcaagaagctgcagagcgagaccctgcacaccagcctgatgctgcagagaaagaacgtgagcgaggagaagagcgagaactgccagcagagcatcaacagcagcaacagcggccccagcagcctgcccgccctgagcgaggtgaacatcggcaacagccagaccagaagaagcagctgggagtgcaccggcagcggcagagccatccccttcaccggcagcggcaagtgcccccagaaggaccacaccagcaccgccgtgggcgacggcagcagcggcagccagcccagagagggcagaggcgacatcggcaccaactgccagaagatgaccaacaagaccctgagccacagcgagagccaggtgttcgccctgacccccgccctgcacaagctgcagctgggcgaggagacccagagcgacgagcccaacctggagagcctgcagagcgagcccagagagctgccccagagaagccaggaggccaacatgaccgagagcagaaaggccgaggacgagatgcagaagagcgcctgggaccagcccagcctgcccgagggcaacaagaacaagaccaacctggacgacctggtgaagggcgagaacagaagcagcgtgaagcacagactggccgccatgagcaaggccagcagaaagttccccgccaaggacgtgagccccagaagacacgtggccaccatcttcccccagagcggcagcagaagcggcttcgaccacctgagcctgggcaccgtggagtgcaaccccctgttccccgagcccacccccaagagcgccgagagcatcggcgagagcagactgagcgagaacggcaagcacgtgaagaagagcgagaacctgctgcccatcaccgtgctgcccaacagagagcccagcacccacgtgagcaaccagaagagcaacagcatcagccagagacaccagaacgagttcaagaacgtgagcgagagccccagcaagcacgagaacagcaaggacgtgaccgccgcccagaacctggtgagagagagcggcgcccccagccccatcaccttcaccagcctgagagaggccgagttcagcgacaaccagagaagactgagcccccccttccccctggagcccgcccagaagagcagagtgagcagccccctggccagcttcctgcagcagcagagaagcgccagcagcctggagtgggagcccgagccccacctgtacagaagcaagagcctgaagagcatcaacgtgcacggcgacctgctgagaaagagccacccccccaaggtgagagagagacacttcagcgagagcaccagcatcgacaacgccctgagcagactgaccctgggcaacgagttcagcgtgaacaacggctacagcagaagattcagaagcttcagcgagctgcccagctgcgacggcaacgagagctgggcctacagaagcggcaccaagaccggccccagaagcgccatcagcatctacagacccatcgactacggcatcttcggcaaggagcagcagctggccttcctggagaacgtgaagagaagcctgacccagggcagactgtggaagcccagcttcctgaagaaccccggcttcctgaaggacgacctgagaaacccccccaaccccagcgagagcctgagcagcaacagccccagcagccaggtgcccgaggacggcctgagccccagcgagcccctgaacatctacgaggacgaccccgtggacagcaactgcgacaccgacaccaccaccgacgacgagtactacctggacgagaacgacaaggagagcgagctgtag

SEQ ID NO: 81034 - DNA, 5949 bp, Artificial Sequence
  Description of Artificial Sequence: Synthetic coding sequence
atgagcctgagcttcctgaacgacgaggaggccagaaagatcctgcaggtgctggagagaaacgaggagctgcagagagccgagaaggacagaatcagcaagctgcagaagaccaagagagacatcagatggctgcagggcgtgaccggcgagtggttcgaggagatccagagaaagaagttctgcaacgagaccgacgtgagccagatgctgaagcagcccctgacctacagactgagcaaggagatggccaagaacgaccccatcgagctgcccaccagcagaagcaagaacgtgaccaaccagaagaagcccacccccttcagcagcagaatgagcttcagaagcagcttcgccagcctgttcagcttcagaaagagcggcaaggagaccagcaagctgcccagcctgggccagaagggctgcgacggccacgccggcccccccatgcccgtgagaggcgccgccgtgcaggccaagatctacaacagccccctggagaaccacctggtggacagcaccttcgtgcccaagcccgccgtgatgagagaggagagcggcatgccccccccctgggacgccagcctgctggagaacgagttcttccaggtgctggacgacctggacagcaagctggcccaggagcagagcgccagcagcgtgaacaccagaacccccctgaactacggcagcagaacccagttcggccacttctacagcagcggcaacagacacggcaacatcaccgagagacacaagaagcactacaacgagaccagcaacatgagcatctacgacatcctgagacccggcacccccagagagggcttcaagaccttcagccccagaaccagcaccatctacgacatgtacagaaccagagagcccagagtgttcaaggaggactacgtgcagaagaacaccttcggcagcaccagcctgtgcttcgacagcagacagagaagcgccctgcccgccaccggccacttcaccgccagaagcctgcacttccccgccaccacccagagcaagagcggcttcatcccccccagacaccagcagagccccaagagaacccccctgagcagcatcatctggaacagaagcgacagcagcagagacagagagaaccaggaggagttcctgagagcccccagccccatggagatcgaccccgccgacaagtacgtgtaccccagaggcttccaggagaacaagagatacgagagctaccacagccagaacgtgtaccagagagtgagcctgaacgcccccatggagaacgccatgagccccgacaccttcgagaacagcgagaacatgcccttctaccaccagagcaacaccttcaccagaagcttcttcagcaacaccttcggcagaagcggcgagcagagaagattcggccagggccccttctggggccaggagaagggccacagcttctggagcgacttccacagaagcagaaagagcttcagcagcagcgacagagacttcgagatgatcagcatggaggccaacagcgtgagcgccatccacggccacaacgtgagcagcgagcactgggagagcttcagcagcggctacggcaccgacgtgagcagaggccaggaggagccccacccctggcagttcgacttccagagaagcaccctggacagcatggtggtgagccacggcaacgagacccagctgaccccccacttcggcacccccaacgtgtgcagcatgaccggcagcagctaccacgtgaagagcagcgagctggtgagccagcaggacagcagccccgtggaggtgcacatcaacaaggaggccagcagcttcggcatcgcccagaccctggccagcagcttcaagaccagcttcagccagatcagcgacgacagaagaaacccccagagccccaacctgcagaaccccaccgtgaccctgcagaagatcttccccaacaagcccgccagccaccccatgagaagccacaccgaggtgaccgtgaccagcagcaacagcgtggacagcctgcccctggccaagagccagcccaacatcctggtgaccgaggtgaacaacgagaaggacctgaacgagagcatcagcgaggaggacaagcagctgagcaagatggaccagaccaacaaggccggcgagatcccccagcccgtgagccagaccggcatcagcaacagcctgcccgacttccagaaccccctgagccaggacagcgccaagagcaacggcttcggcttcaacgccagcaccatcatcagcagcaagaagagccccagagtgttcagcagaaaggacaccagcaagatgtacatcccccacaccgacaagagcaacgacatcaagcaggacaagagattcaccgagaacagaaagctgggcagcaccgccagcctgcccttcatccaggagcacagaaccccccccagcttccccagaaccgaccagggctgccaccaggagctgaccgtgaacaacgaggacatcagcagaatcatcaccaacaaccactggagcagcgccctgaccgacacccagaacgcccagtacagcaagtgcaagctgacccccggccacaagaccagctgcgacagcctggacctgagcagcgccgccctgcccgacagcagccccagcaagaacagcagcctggacgcccccgtggtgcccagcaccaccgtgttcagcagaagaagccccagcgacaaggaccccagcctgggcgagagagaggagaaggacaacgccggcaagaaccagaagaaccagttcatcgtgagccacagcgagaaccaggagagaaacgacagccccgtgcccacccacgacgaggtggtggacgtgaagtgccacagccacagccccttcagaaacgagagaggcaagggcaagatcagacaccacatcagctgcatcgagaagctgagcaagaccgagagcatcagcgtgcccaccagcgaccacagaagcctgatcgaggccaaccagagcaacagcaaggtgagcgagctggacaccatctactgcaccctgcccagaaagagcagcagcttcctgatccacggcagacagagcggcagcaagatcatggccgccagcctgagaaacggccccccccccttccagatcaagaacaacgtggaggacgccatgggcaactacatgctgaacaagttcagccccagcagccccgagagcgccaacgagtgcagcaaggtgctgagcgacagcgccctggaggcccccgaggccaccgagagaatgaccaacgtgaagagcagcggcagcaccagcgtgagaaagggccccctgcccttcctgatcaacagagccatgagctgccccagcggcgagccccacgccagcaccggcagagagggcagaaagaagcccctgaccagcggcatggacgccagcgagctgacccccagagcctgggagagaatcatcagccccgtggagagcgacagcagcgtgagagactgcagcctgaccaagagacagcaccagaaggagaacttccaggagtacaccgagaaggagggcaagatggccgccagcagaagaagcgtgttcgccctgagcaacgaggaccccctgcccttctgcagcgacctgagcggcaaggagagaggcaagaccctgcacaaggtgaagaccaccagcaccttcagcgtgagcggcgacgaggacaacgtgaagtgcctggaggtggtgagcatctactacaccctgcccagaaagcccagcaagaagttctgcaacctgctgcagcagtacacccagaacaccaacctgctgatcgagagcccccaggtggagaccgagaccttccccaacgccctggagaaggacaagcagaactacagcaccagagagcagagcggcacccccagctgcgagaacctgaagatgagcgtgaacagcgaccagaccctgaccaccgagaacatgaccgccttcagactgagcaacagaggccccctggcccccaccctgcaggagatggccagcgtggaggccgccgtgagcctgcccgaggaggagagcaaggccagagagatcttcagcgacaacctggccaagacccccctgggcgacagcgagaacaagaaggagagaggcaagaagctgcagagcgagaccctgcacaccagcctgatgctgcagagaaagaacgtgagcgaggagaagagcgagaactgccagcagagcatcaacagcagcaacagcggccccagcagcctgcccgccctgagcgaggtgaacatcggcaacagccagaccagaagaagcagctgggagtgcaccggcagcggcagagccatccccttcaccggcagcggcaagtgcccccagaaggaccacaccagcaccgccgtgggcgacggcagcagcggcagccagcccagagagggcagaggcgacatcggcaccaactgccagaagatgaccaacaagaccctgagccacagcgagagccaggtgttcgccctgacccccgccctgcacaagctgcagctgggcgaggagacccagagcgacgagcccaacctggagagcctgcagagcgagcccagagagctgccccagagaagccaggaggccaacatgaccgagagcagaaaggccgaggacgagatgcagaagagcgcctgggaccagcccagcctgcccgagggcaacaagaacaagaccaacctggacgacctggtgaagggcgagaacagaagcagcgtgaagcacagactggccgccatgagcaaggccagcagaaagttccccgccaaggacgtgagccccagaagacacgtggccaccatcttcccccagagcggcagcagaagcggcttcgaccacctgagcctgggcaccgtggagtgcaaccccctgttccccgagcccacccccaagagcgccgagagcatcggcgagagcagactgagcgagaacggcaagcacgtgaagaagagcgagaacctgctgcccatcaccgtgctgcccaacagagagcccagcacccacgtgagcaaccagaagagcaacagcatcagccagagacaccagaacgagttcaagaacgtgagcgagagccccagcaagcacgagaacagcaaggacgtgaccgccgcccagaacctggtgagagagagcggcgcccccagccccatcaccttcaccagcctgagagaggccgagttcagcgacaaccagagaagactgagcccccccttccccctggagcccgcccagaagagcagagtgagcagccccctggccagcttcctgcagcagcagagaagcgccagcagcctggagtgggagcccgagccccacctgtacagaagcaagagcctgaagagcatcaacgtgcacggcgacctgctgagaaagagccacccccccaaggtgagagagagacacttcagcgagagcaccagcatcgacaacgccctgagcagactgaccctgggcaacgagttcagcgtgaacaacggctacagcagaagattcagaagcttcagcgagctgcccagctgcgacggcaacgagagctgggcctacagaagcggcaccaagaccggccccagaagcgccatcagcatctacagacccatcgactacggcatcttcggcaaggagcagcagctggccttcctggagaacgtgaagagaagcctgacccagggcagactgtggaagcccagcttcctgaagaaccccggcttcctgaaggacgacctgagaaacccccccaaccccagcgagagcctgagcagcaacagccccagcagccaggtgcccgaggacggcctgagccccagcgagcccctgaacatctacgaggacgaccccgtggacagcaactgcgacaccgacaccaccaccgacgacgagtactacctggacgagaacgacaaggagagcgagctgtag

SEQ ID NO: 81035 - DNA, 2583 bp, Artificial Sequence
  Description of Artificial Sequence: Synthetic coding sequence
atggccccccccagcaccagagagcccagagtgctgagcgccaccagcgccaccaagagcgacggcgagatggtgctgcccggcttccccgacgccgacagcttcgtgaagttcgccctgggcagcgtggtggccgtgaccaaggccagcggcggcctgccccagttcggcgacgagtacgacttctacagaagcttccccggcttccaggccttctgcgagacccagggcgacagactgctgcagtgcatgagcagagtgatgcagtaccacggctgcagaagcaacatcaaggacagaagcaaggtgaccgagctggaggacaagttcgacctgctggtggacgccaacgacgtgatcctggagagagtgggcatcctgctggacgaggccagcggcgtgaacaagaaccagcagcccgtgctgcccgccggcctgcaggtgcccaagaccgtggtgagcagctggaacagaaaggccgccgagtacggcaagaaggccaagagcgagaccttcagactgctgcacgccaagaacatcatcagaccccagctgaagttcagagagaagatcgacaacagcaacacccccttcctgcccaagatcttcatcaagcccaacgcccagaagcccctgccccaggccctgagcaaggagagaagagagagaccccaggacagacccgaggacctggacgtgccccccgccctggccgacttcatccaccagcagagaacccagcaggtggagcaggacatgttcgcccacccctaccagtacgagctgaaccacttcacccccgccgacgccgtgctgcagaagccccagccccagctgtacagacccatcgaggagaccccctgccacttcatcagcagcctggacgagctggtggagctgaacgagaagctgctgaactgccaggagttcgccgtggacctggagcaccacagctacagaagcttcctgggcctgacctgcctgatgcagatcagcaccagaaccgaggacttcatcatcgacaccctggagctgagaagcgacatgtacatcctgaacgagagcctgaccgaccccgccatcgtgaaggtgttccacggcgccgacagcgacatcgagtggctgcagaaggacttcggcctgtacgtggtgaacatgttcgacacccaccaggccgccagactgctgaacctgggcagacacagcctggaccacctgctgaagctgtactgcaacgtggacagcaacaagcagtaccagctggccgactggagaatcagacccctgcccgaggagatgctgagctacgccagagacgacacccactacctgctgtacatctacgacaagatgagactggagatgtgggagagaggcaacggccagcccgtgcagctgcaggtggtgtggcagagaagcagagacatctgcctgaagaagttcatcaagcccatcttcaccgacgagagctacctggagctgtacagaaagcagaagaagcacctgaacacccagcagctgaccgccttccagctgctgttcgcctggagagacaagaccgccagaagagaggacgagagctacggctacgtgctgcccaaccacatgatgctgaagatcgccgaggagctgcccaaggagccccagggcatcatcgcctgctgcaaccccgtgccccccctggtgagacagcagatcaacgagatgcacctgctgatccagcaggccagagagatgcccctgctgaagagcgaggtggccgccggcgtgaagaagagcggccccctgcccagcgccgagagactggagaacgtgctgttcggcccccacgactgcagccacgccccccccgacggctaccccatcatccccaccagcggcagcgtgcccgtgcagaagcaggccagcctgttccccgacgagaaggaggacaacctgctgggcaccacctgcctgatcgccaccgccgtgatcaccctgttcaacgagcccagcgccgaggacagcaagaagggccccctgaccgtggcccagaagaaggcccagaacatcatggagagcttcgagaaccccttcagaatgatcagcaacagatggaagctggcccaggtgcaggtgcagaaggacagcaaggaggccgtgaagaagaaggccgccgagcagaccgccgccagagagcaggccaaggaggcctgcaaggccgccgccgagcaggccatcagcgtgagacagcaggtggtgctggagaacgccgccaagaagagagagagagccaccagcgaccccagaaccaccgagcagaagcaggagaagaagagactgaagatcagcaagaagcccaaggaccccgagccccccgagaaggagttcaccccctacgactacagccagagcgacttcaaggccttcgccggcaacagcaagagcaaggtgagcagccagttcgaccccaacaagcagacccccagcggcaagaagtgcatcgccgccaagaagatcaagcagagcgtgggcaacaagagcatgagcttccccaccggcaagagcgacagaggcttcagatacaactggccccagagatag

SEQ ID NO: 81036 - DNA, 2658 bp, Artificial Sequence
  Description of Artificial Sequence: Synthetic coding sequence
atggccccccccagcaccagagagcccagagtgctgagcgccaccagcgccaccaagagcgacggcgagatggtgctgcccggcttccccgacgccgacagcttcgtgaagttcgccctgggcagcgtggtggccgtgaccaaggccagcggcggcctgccccagttcggcgacgagtacgacttctacagaagcttccccggcttccaggccttctgcgagacccagggcgacagactgctgcagtgcatgagcagagtgatgcagtaccacggctgcagaagcaacatcaaggacagaagcaaggtgaccgagctggaggacaagttcgacctgctggtggacgccaacgacgtgatcctggagagagtgggcatcctgctggacgaggccagcggcgtgaacaagaaccagcagcccgtgctgcccgccggcctgcaggtgcccaagaccgtggtgagcagctggaacagaaaggccgccgagtacggcaagaaggccaagagcgagaccttcagactgctgcacgccaagaacatcatcagaccccagctgaagttcagagagaagatcgacaacagcaacacccccttcctgcccaagatcttcatcaagcccaacgcccagaagcccctgccccaggccctgagcaaggagagaagagagagaccccaggacagacccgaggacctggacgtgccccccgccctggccgacttcatccaccagcagagaacccagcaggtggagcaggacatgttcgcccacccctaccagtacgagctgaaccacttcacccccgccgacgccgtgctgcagaagccccagccccagctgtacagacccatcgaggagaccccctgccacttcatcagcagcctggacgagctggtggagctgaacgagaagctgctgaactgccaggagttcgccgtggacctggagcaccacagctacagaagcttcctgggcctgacctgcctgatgcagatcagcaccagaaccgaggacttcatcatcgacaccctggagctgagaagcgacatgtacatcctgaacgagagcctgaccgaccccgccatcgtgaaggtgttccacggcgccgacagcgacatcgagtggctgcagaaggacttcggcctgtacgtggtgaacatgttcgacacccaccaggccgccagactgctgaacctgggcagacacagcctggaccacctgctgaagctgtactgcaacgtggacagcaacaagcagtaccagctggccgactggagaatcagacccctgcccgaggagatgctgagctacgccagagacgacacccactacctgctgtacatctacgacaagatgagactggagatgtgggagagaggcaacggccagcccgtgcagctgcaggtggtgtggcagagaagcagagacatctgcctgaagaagttcatcaagcccatcttcaccgacgagagctacctggagctgtacagaaagcagaagaagcacctgaacacccagcagctgaccgccttccagctgctgttcgcctggagagacaagaccgccagaagagaggacgagagctacggctacgtgctgcccaaccacatgatgctgaagatcgccgaggagctgcccaaggagccccagggcatcatcgcctgctgcaaccccgtgccccccctggtgagacagcagatcaacgagatgcacctgctgatccagcaggccagagagatgcccctgctgaagagcgaggtggccgccggcgtgaagaagagcggccccctgcccagcgccgagagactggagaacgtgctgttcggcccccacgactgcagccacgccccccccgacggctaccccatcatccccaccagcggcagcgtgcccgtgcagaagcaggccagcctgttccccgacgagaaggaggacaacctgctgggcaccacctgcctgatcgccaccgccgtgatcaccctgttcaacgagcccagcgccgaggacagcaagaagggccccctgaccgtggcccagaagaaggcccagaacatcatggagagcttcgagaaccccttcagaatgttcctgcccagcctgggccacagagcccccgtgagccaggccgccaagttcgaccccagcaccaagatctacgagatcagcaacagatggaagctggcccaggtgcaggtgcagaaggacagcaaggaggccgtgaagaagaaggccgccgagcagaccgccgccagagagcaggccaaggaggcctgcaaggccgccgccgagcaggccatcagcgtgagacagcaggtggtgctggagaacgccgccaagaagagagagagagccaccagcgaccccagaaccaccgagcagaagcaggagaagaagagactgaagatcagcaagaagcccaaggaccccgagccccccgagaaggagttcaccccctacgactacagccagagcgacttcaaggccttcgccggcaacagcaagagcaaggtgagcagccagttcgaccccaacaagcagacccccagcggcaagaagtgcatcgccgccaagaagatcaagcagagcgtgggcaacaagagcatgagcttccccaccggcaagagcgacagaggcttcagatacaactggccccagagatag

SEQ ID NO: 81037 - DNA, 2040 bp, Artificial Sequence
  Description of Artificial Sequence: Synthetic coding sequence
atggccccccccagcaccagagagcccagagtgctgagcgccaccagcgccaccaagagcgacggcgagatggtgctgcccggcttccccgacgccgacagcttcgtgaagttcgccctgggcagcgtggtggccgtgaccaaggccagcggcggcctgccccagttcggcgacgagtacgacttctacagaagcttccccggcttccaggccttctgcgagacccagggcgacagactgctgcagtgcatgagcagagtgatgcagtaccacggctgcagaagcaacatcaaggacagaagcaaggtgaccgagctggaggacaagttcgacctgctggtggacgccaacgacgtgatcctggagagagtgggcatcctgctggacgaggccagcggcgtgaacaagaaccagcagcccgtgctgcccgccggcctgcaggtgcccaagaccgtggtgagcagctggaacagaaaggccgccgagtacggcaagaaggccaagagcgagaccttcagactgctgcacgccaagaacatcatcagaccccagctgaagttcagagagaagatcgacaacagcaacacccccttcctgcccaagatcttcatcaagcccaacgcccagaagcccctgccccaggccctgagcaaggagagaagagagagaccccaggacagacccgaggacctggacgtgccccccgccctggccgacttcatccaccagcagagaacccagcaggtggagcaggacatgttcgcccacccctaccagtacgagctgaaccacttcacccccgccgacgccgtgctgcagaagccccagccccagctgtacagacccatcgaggagaccccctgccacttcatcagcagcctggacgagctggtggagctgaacgagaagctgctgaactgccaggagttcgccgtggacctggagcaccacagctacagaagcttcctgggcctgacctgcctgatgcagatcagcaccagaaccgaggacttcatcatcgacaccctggagctgagaagcgacatgtacatcctgaacgagagcctgaccgaccccgccatcgtgaaggtgttccacggcgccgacagcgacatcgagtggctgcagaaggacttcggcctgtacgtggtgaacatgttcgacacccaccaggccgccagactgctgaacctgggcagacacagcctggaccacctgctgaagctgtactgcaacgtggacagcaacaagcagtaccagctggccgactggagaatcagacccctgcccgaggagatgctgagctacgccagagacgacacccactacctgctgtacatctacgacaagatgagactggagatgtgggagagaggcaacggccagcccgtgcagctgcaggtggtgtggcagagaagcagagacatctgcctgaagaagttcatcaagcccatcttcaccgacgagagctacctggagctgtacagaaagcagaagaagcacctgaacacccagcagctgaccgccttccagctgctgttcgcctggagagacaagaccgccagaagagaggacgagagctacggctacgtgctgcccaaccacatgatgctgaagatcgccgaggagctgcccaaggagccccagggcatcatcgcctgctgcaaccccgtgccccccctggtgagacagcagatcaacgagatgcacctgctgatccagcaggccagagagatgcccctgctgaagagcgaggtggccgccggcgtgaagaagagcggccccctgcccagcgccgaggtggagtgcagaatctgcttcctgccccaggagggcaagagacaggtgaccgccagcgccagcacccccctgaccgaggcctgcgccgacagctggcagaaggccaccgccggcctgcacgtgctgcacgccagcctgctggtgagcttcaacgccgagatcggcgagtgcagcctgtggaccagcagactgctgccctgccccagcggctggctgagcaaccaccccaaccagtggtag

SEQ ID NO: 81038 - DNA, 747 bp, Artificial Sequence
  Description of Artificial Sequence: Synthetic coding sequence
atggccgccggcttcaagaccgtggagcccctggagtactacagaagattcctgaaggagaactgcagacccgacggcagagagctgggcgagttcagaaccaccaccgtgaacatcggcagcatcagcaccgccgacggcagcgccctggtgaagctgggcaacaccaccgtgatctgcggcgtgaaggccttcagaagcggcccccccggcgaggaggcccaggtggccagccagttcatcgccgacgtgatcgagaacagccagatcatccagaaggaggacctgtgcatcagccccggcaagctggtgtgggtgctgtactgcgacctgatctgcctggactacgacggcaacatcctggacgcctgcaccttcgccctgctggccgccctgaagaacgtgcagctgcccgaggtgaccatcaacgaggagaccgccctggccgaggtgaacctgaagaagaagagctacctgaacatcagaacccaccccgtggccaccagcttcgccgtgttcgacgacaccctgctgatcgtggaccccaccggcgaggaggagcacctggccaccggcaccctgaccatcgtgatggacgaggagggcaagctgtgctgcctgcacaagcccggcggcagcggcctgaccggcgccaagctgcaggactgcatgagcagagccgtgaccagacacaaggaggtgaagaagctgatggacgaggtgatcaagagcatgaagcccaagtag

SEQ ID NO: 81039 - DNA, 831 bp, Artificial Sequence
  Description of Artificial Sequence: Synthetic coding sequence
atggccgccggcttcaagaccgtggagcccctggagtactacagaagattcctgaaggagaactgcagacccgacggcagagagctgggcgagttcagaaccaccaccgtgaacatcggcagcatcagcaccgccgacggcagcgccctggtgaagctgggcaacaccaccgtgatctgcggcgtgaaggccgagttcgccgcccccagcaccgacgcccccgacaagggctacgtggtgcccaacgtggacctgccccccctgtgcagcagcagattcagaagcggcccccccggcgaggaggcccaggtggccagccagttcatcgccgacgtgatcgagaacagccagatcatccagaaggaggacctgtgcatcagccccggcaagctggtgtgggtgctgtactgcgacctgatctgcctggactacgacggcaacatcctggacgcctgcaccttcgccctgctggccgccctgaagaacgtgcagctgcccgaggtgaccatcaacgaggagaccgccctggccgaggtgaacctgaagaagaagagctacctgaacatcagaacccaccccgtggccaccagcttcgccgtgttcgacgacaccctgctgatcgtggaccccaccggcgaggaggagcacctggccaccggcaccctgaccatcgtgatggacgaggagggcaagctgtgctgcctgcacaagcccggcggcagcggcctgaccggcgccaagctgcaggactgcatgagcagagccgtgaccagacacaaggaggtgaagaagctgatggacgaggtgatcaagagcatgaagcccaagtag

SEQ ID NO: 81040 - DNA, 1320 bp, Artificial Sequence
  Description of Artificial Sequence: Synthetic coding sequence
atgaaggagacccccctgagcaactgcgagagaagattcctgctgagagccatcgaggagaagaagagactggacggcagacagacctacgactacagaaacatcagaatcagcttcggcaccgactacggctgctgcatcgtggagctgggcaagaccagagtgctgggccaggtgagctgcgagctggtgagccccaagctgaacagagccaccgagggcatcctgttcttcaacctggagctgagccagatggccgcccccgccttcgagcccggcagacagagcgacctgctggtgaagctgaacagactgatggagagatgcctgagaaacagcaagtgcatcgacaccgagagcctgtgcgtggtggccggcgagaaggtgtggcagatcagagtggacctgcacctgctgaaccacgacggcaacatcatcgacgccgccagcatcgccgccatcgtggccctgtgccacttcagaagacccgacgtgagcgtgcagggcgacgaggtgaccctgtacacccccgaggagagagaccccgtgcccctgagcatccaccacatgcccatctgcgtgagcttcgccttcttccagcagggcacctacctgctggtggaccccaacgagagagaggagagagtgatggacggcctgctggtgatcgccatgaacaagcacagagagatctgcaccatccagagcagcggcggcatcatgctgctgaaggaccaggtgctgagatgcagcaagatcgccggcgtgaaggtggccgagatcaccgagctgatcctgaaggccctggagaacgaccagaaggtgagaaaggagggcggcaagttcggcttcgccgagagcatcgccaaccagagaatcaccgccttcaagatggagaaggcccccatcgacaccagcgacgtggaggagaaggccgaggagatcatcgccgaggccgagccccccagcgaggtggtgagcacccccgtgctgtggacccccggcaccgcccagatcggcgagggcgtggagaacagctggggcgacctggaggacagcgagaaggaggacgacgagggcggcggcgaccaggccatcatcctggacggcatcaagatggacaccggcgtggaggtgagcgacatcggcagccaggacgcccccatcatcctgagcgacagcgaggaggaggagatgatcatcctggagcccgacaagaaccccaagaagatcagaacccagaccaccagcgccaagcaggagaaggcccccagcaagaagcccgtgaagagaagaaagaagaagagagccgccaactag

SEQ ID NO: 81041 - DNA, 1371 bp, Artificial Sequence
  Description of Artificial Sequence: Synthetic coding sequence
atgaaggagacccccctgagcaactgcgagagaagattcctgctgagagccatcgaggagaagaagagactggacggcagacagacctacgactacagaaacatcagaatcagcttcggcaccgactacggctgctgcatcgtggagctgggcaagaccagagtgctgggccaggtgagctgcgagctggtgagccccaagctgaacagagccaccgagggcatcctgttcttcaacctggagctgagccagatggccgcccccgccttcgagcccggcagacagagcgacctgctggtgaagctgaacagactgatggagagatgcctgagaaacagcaagtgcatcgacaccgagagcctgtgcgtggtggccggcgagaaggtgtggcagatcagagtggacctgcacctgctgaaccacgacggcaacatcatcgacgccgccagcatcgccgccatcgtggccctgtgccacttcagaagacccgacgtgagcgtgcagggcgacgaggtgaccctgtacacccccgaggagagagaccccgtgcccctgagcatccaccacatgcccatctgcgtgagcttcgccttcttccagcagggcacctacctgctggtggaccccaacgagagagaggagagagtgatggacggcctgctggtgatcgccatgaacaagcacagagagatctgcaccatccagagcagcggcggcatcatgctgctgaaggaccaggtgctgagatgcagcaagatcgccggcgtgaaggtggccgagatcaccgagctgatcctgaaggccctggagaacgaccagaaggtgagaaaggagggcggcaagttcggcttcgccgagagcatcgccaaccagagaatcaccgccttcaagatggagaaggcccccatcgacaccagcgacgtggaggagaaggccgaggagatcatcgccgaggccgagccccccagcgaggtggtgagcacccccgtgctgtggacccccggcaccgcccagatcggcgagggcgtggagaacagctggggcgacctggaggacagcgagaaggaggacgacgagggcggcggcgaccaggccatcatcctggacggcatcaagatggacaccggcgtggaggtgagcgacatcggcagccaggagctgggcttccaccacgtgggccagaccggcctggagttcctgaccagcgacgcccccatcatcctgagcgacagcgaggaggaggagatgatcatcctggagcccgacaagaaccccaagaagatcagaacccagaccaccagcgccaagcaggagaaggcccccagcaagaagcccgtgaagagaagaaagaagaagagagccgccaactag

SEQ ID NO: 81042 - DNA, 2031 bp, Artificial Sequence
  Description of Artificial Sequence: Synthetic coding sequence
atgcagagctggagaagaagaaagagcctgtggctggccctgagcgccagctggctgctgctggtgctgctgggcggcttcagcctgctgagactggccctgccccccagacccagacccggcgccagccagggctggcccagatggctggacgccgagctgctgcagagcttcagccagcccggcgagctgcccgaggacgccgtgagccccccccaggccccccacggcggcagctgcaactgggagagctgcttcgacaccagcaagtgcagaggcgacggcctgaaggtgttcgtgtaccccgccgtgggcaccatcagcgagacccacagaagaatcctggccagcatcgagggcagcagattctacaccttcagccccgccggcgcctgcctgctgctgctgctgagcctggacgcccagaccggcgagtgcagcagcatgcccctgcagtggaacagaggcagaaaccacctggtgctgagactgcaccccgccccctgccccagaaccttccagctgggccaggccatggtggccgaggccagccccaccgtggacagcttcagacccggcttcgacgtggccctgcccttcctgcccgaggcccaccccctgagaggcggcgcccccggccagctgagacagcacagcccccagcccggcgtggccctgctggccctggaggaggagagaggcggctggagaaccgccgacaccggcagcagcgcctgcccctgggacggcagatgcgagcaggaccccggccccggccagacccagagacaggagaccctgcccaacgccaccttctgcctgatcagcggccacagacccgaggccgccagcagattcctgcaggccctgcaggccggctgcatccccgtgctgctgagccccagatgggagctgcccttcagcgaggtgatcgactggaccaaggccgccatcgtggccgacgagagactgcccctgcaggtgctggccgccctgcaggagatgagccccgccagagtgctggccctgagacagcagacccagttcctgtgggacgcctacttcagcagcgtggagaaggtgatccacaccaccctggaggtgatccaggacagaatcttcggcaccagcgcccaccccagcctgctgtggaacagcccccccggcgccctgctggccctgagcaccttcagcaccagcccccaggacttccccttctactacctgcagcagggcagcagacccgagggcagattcagcgccctgatctgggtgggcccccccggccagccccccctgaagctgatccaggccgtggccggcagccagcactgcgcccagatcctggtgctgtggagcaacgagagacccctgcccagcagatggcccgagaccgccgtgcccctgaccgtgatcgacggccacagaaaggtgagcgacagattctacccctacagcaccatcagaaccgacgccatcctgagcctggacgccagaagcagcctgagcaccagcgaggtggacttcgccttcctggtgtggcagagcttccccgagagaatggtgggcttcctgaccagcagccacttctgggacgaggcccacggcggctggggctacaccgccgagagaaccaacgagttcagcatggtgctgaccaccgccgccttctaccacagatactaccacaccctgttcacccacagcctgcccaaggccctgagaaccctggccgacgaggcccccacctgcgtggacgtgctgatgaacttcatcgtggccgccgtgaccaagctgccccccatcaaggtgccctacggcaagcagagacaggaggccgcccccctggcccccggcggccccggccccagacccaagccccccgcccccgcccccgactgcatcaaccagatcgccgccgccttcggccacatgcccctgctgagcagcagactgagactggaccccgtgctgttcaaggaccccgtgagcgtgcagagaaagaagtacagaagcctggagaagccctag

SEQ ID NO: 81043 - DNA, 993 bp, Artificial Sequence
  Description of Artificial Sequence: Synthetic coding sequence
atgagatgctgccacatctgcaagctgcccggcagagtgatgggcatcagagtgctgagactgagcctggtggtgatcctggtgctgctgctggtggccggcgccctgaccgccctgctgcccagcgtgaaggaggacaagatgctgatgctgagaagagagatcaagagccagggcaagagcaccatggacagcttcaccctgatcatgcagacctacaacagaaccgacctgctgctgaagctgctgaaccactaccaggccgtgcccaacctgcacaaggtgatcgtggtgtggaacaacatcggcgagaaggcccccgacgagctgtggaacagcctgggcccccaccccatccccgtgatcttcaagcagcagaccgccaacagaatgagaaacagactgcaggtgttccccgagctggagaccaacgccgtgctgatggtggacgacgacaccctgatcagcacccccgacctggtgttcgccttcagcgtgtggcagcagttccccgaccagatcgtgggcttcgtgcccagaaagcacgtgagcaccagcagcggcatctacagctacggcagcttcgagatgcaggcccccggcagcggcaacggcgaccagtacagcatggtgctgatcggcgccagcttcttcaacagcaagtacctggagctgttccagagacagcccgccgccgtgcacgccctgatcgacgacacccagaactgcgacgacatcgccatgaacttcatcatcgccaagcacatcggcaagaccagcggcatcttcgtgaagcccgtgaacatggacaacctggagaaggagaccaacagcggctacagcggcatgtggcacagagccgagcacgccctgcagagaagctactgcatcaacaagctggtgaacatctacgacagcatgcccctgagatacagcaacatcatgatcagccagttcggcttcccctacgccaactacaagagaaagatctag

SEQ ID NO: 81044 - DNA, 993 bp, Artificial Sequence; identical to SEQ ID NO: 81043
  Description of Artificial Sequence: Synthetic coding sequence

SEQ ID NO: 81045 - DNA, 354 bp, Artificial Sequence
  Description of Artificial Sequence: Synthetic coding sequence
atgggcatcagagtgctgagactgagcctggtggtgatcctggtgctgctgctggtggccggcgccctgaccgccctgctgcccagcgtgaaggaggacaagatgctgatgctgagaagagagatcaagagccagggcaagagcaccatggacagcttcaccctgatcatgcagacctacaacagaaccgacctgctgctgaagctgctgaaccactaccaggccgtgcccaacctgcacaaggtgatcgtggtgtggaacaacatcggcgagaaggcccccgacgagctgtggaacagcctgggcccccaccccatccccgtgatcttcaagcagcagaccgccaacagatag

SEQ ID NO: 81046 - DNA, 801 bp, Artificial Sequence
  Description of Artificial Sequence: Synthetic coding sequence
atgagaacctggaacagcggcggcaccaagtgctgccacatctgcaagctgcccggcagagtgatgggcatcagagtgctgagactgagcctggtggtgatcctggtgctgctgctggtggccggcgccctgaccgccctgctgcccagcgtgaaggaggacaagatgctgatgctgagaagagagatcaagagccagggcaagagcaccatggacagcttcaccctgatcatgcagacctacaacagaaccgacctgctgctgaagctgctgaaccactaccaggccgtgcccaacctgcacaaggtgatcgtggtgtggaacaacatcggcgagaaggcccccgacgagctgtggaacagcctgggcccccaccccatccccgtgatcttcaagcagcagaccgccaacagaatgagaaacagactgcaggtgttccccgagctggagaccaacgccgtgctgatggtggacgacgacaccctgatcagcacccccgacctggtgttcgccttcagcgtgtggcagcagttccccgaccagatcgtgggcttcgtgcccagaaagcacgtgagcaccagcagcggcatctacagctacggcagcttcgagatgcaggcccccggcagcggcaacggcgaccagtacagcatggtgctgatcggcgccagcttcttcaacagcaagtacctggagctgttccagagacagcccgccgccgtgcacgccctgatcgacgacacccagaactgcgacgacatcgccatgaacttcatcatcgccaagcacatcggcaagtag

SEQ ID NO: 81047 - DNA, 954 bp, Artificial Sequence
  Description of Artificial Sequence: Synthetic coding sequence
atgggcatcagagtgctgagactgagcctggtggtgatcctggtgctgctgctggtggccggcgccctgaccgccctgctgcccagcgtgaaggaggacaagatgctgatgctgagaagagagatcaagagccagggcaagagcaccatggacagcttcaccctgatcatgcagacctacaacagaaccgacctgctgctgaagctgctgaaccactaccaggccgtgcccaacctgcacaaggtgatcgtggtgtggaacaacatcggcgagaaggcccccgacgagctgtggaacagcctgggcccccaccccatccccgtgatcttcaagcagcagaccgccaacagaatgagaaacagactgcaggtgttccccgagctggagaccaacgccgtgctgatggtggacgacgacaccctgatcagcacccccgacctggtgttcgccttcagcgtgtggcagcagttccccgaccagatcgtgggcttcgtgcccagaaagcacgtgagcaccagcagcggcatctacagctacggcagcttcgagatgcaggcccccggcagcggcaacggcgaccagtacagcatggtgctgatcggcgccagcttcttcaacagcaagtacctggagctgttccagagacagcccgccgccgtgcacgccctgatcgacgacacccagaactgcgacgacatcgccatgaacttcatcatcgccaagcacatcggcaagaccagcggcatcttcgtgaagcccgtgaacatggacaacctggagaaggagaccaacagcggctacagcggcatgtggcacagagccgagcacgccctgcagagaagctactgcatcaacaagctggtgaacatctacgacagcatgcccctgagatacagcaacatcatgatcagccagttcggcttcccctacgccaactacaagagaaagatctag

SEQ ID NO: 81048 - DNA, 519 bp, Artificial Sequence
  Description of Artificial Sequence: Synthetic coding sequence
atgagcgtgcccggccccagcagccccgacggcgccctgaccagacccccctactgcctggaggccggcgagcccacccccggcctgagcgacaccagccccgacgagggcctgatcgaggacctgaccatcgaggacaaggccgtggagcagctggccgagggcctgctgagccactacctgcccgacctgcagagaagcaagcaggccctgcaggagctgacccagaaccaggtggtgctgctggacaccctggagcaggagatcagcaagttcaaggagtgccacagcatgctggacatcaacgccctgttcgccgaggccaagcactaccacgccaagctggtgaacatcagaaaggagatgctgatgctgcacgagaagaccagcaagctgaagaagagagccctgaagctgcagcagaagagacagaaggaggagctggagagagagcagcagagagagaaggagttcgagagagagaagcagctgaccgccagacccgccaagagaatgtag

SEQ ID NO: 81049 - DNA, 1608 bp, Artificial Sequence
  Description of Artificial Sequence: Synthetic coding sequence
atgctgcacaagagcgaggagggcagagtgctggtggagttcacctgcaagaaccagcccaagcccagcctgcccaccgagtgggccctgtgcggcgagagagaggacagactggagctgctgaagctgagcaccttcgccctgatcatcacccccggcgaccccagactggtgatcagcagcggctgcgccaccagactgttcgaggccctggaggtgggcgccgtgcccgtggtgctgggcgagcaggtgcagctgccctaccaggacatgctgcagtggaacgaggccgccctggtggtgcccaagcccagagtgaccgaggtgcacttcctgctgagaagcctgagcgacagcgacctgctggccatgagaagacagggcagattcctgtgggagacctacttcagcaccgccgacagcatcttcaacaccgtgctggccatgatcagaaccagaatccagatccccgccgcccccatcagagaggaggccgccgccgagatcccccacagaagcggcaaggccgccggcaccgaccccaacatggccgacaacggcgacctggacctgggccccgtggagaccgagcccccctacgccagccccagatacctgagaaacttcaccctgaccgtgaccgacttctacagaagctggaactgcgcccccggccccttccacctgttcccccacacccccttcgaccccgtgctgcccagcgaggccaagttcctgggcagcggcaccggcttcagacccatcggcggcggcgccggcggcagcggcaaggagttccaggccgccctgggcggcaacgtgcccagagagcagttcaccgtggtgatgctgacctacgagagagaggaggtgctgatgaacagcctggagagactgaacggcctgccctacctgaacaaggtggtggtggtgtggaacagccccaagctgcccagcgaggacctgctgtggcccgacatcggcgtgcccatcatggtggtgagaaccgagaagaacagcctgaacaacagattcctgccctggaacgagatcgagaccgaggccatcctgagcatcgacgacgacgcccacctgagacacgacgagatcatgttcggcttcagagtgtggagagaggccagagacagaatcgtgggcttccccggcagataccacgcctgggacatcccccaccagagctggctgtacaacagcaactacagctgcgagctgagcatggtgctgaccggcgccgccttcttccacaagtactacgcctacctgtacagctacgtgatgccccaggccatcagagacatggtggacgagtacatcaactgcgaggacatcgccatgaacttcctggtgagccacatcaccagaaagccccccatcaaggtgaccagcagatggaccttcagatgccccggctgcccccaggccctgagccacgacgacagccacttccacgagagacacaagtgcatcaacttcttcgtgaaggtgtacggctacatgcccctgctgtacacccagttcagagtggacagcgtgctgttcaagaccagactgccccacgacaagaccaagtgcttcaagttcatctag

SEQ ID NO: 81050 - DNA, 3216 bp, Artificial Sequence
  Description of Artificial Sequence: Synthetic coding sequence
atgcccgccatcatgaccatgctggccgaccacgccgccagacagctgctggacttcagccagaagctggacatcaacctgctggacaacgtggtgaactgcctgtaccacggcgagggcgcccagcagagaatggcccaggaggtgctgacccacctgaaggagcaccccgacgcctggaccagagtggacaccatcctggagttcagccagaacatgaacaccaagtactacggcctgcagatcctggagaacgtgatcaagaccagatggaagatcctgcccagaaaccagtgcgagggcatcaagaagtacgtggtgggcctgatcatcaagaccagcagcgaccccacctgcgtggagaaggagaaggtgtacatcggcaagctgaacatgatcctggtgcagatcctgaagcaggagtggcccaagcactggcccaccttcatcagcgacatcgtgggcgccagcagaaccagcgagagcctgtgccagaacaacatggtgatcctgaagctgctgagcgaggaggtgttcgacttcagcagcggccagatcacccaggtgaagagcaagcacctgaaggacagcatgtgcaacgagttcagccagatcttccagctgtgccagttcgtgatggagaacagccagaacgcccccctggtgcacgccaccctggagaccctgctgagattcctgaactggatccccctgggctacatcttcgagaccaagctgatcagcaccctgatctacaagttcctgaacgtgcccatgttcagaaacgtgagcctgaagtgcctgaccgagatcgccggcgtgagcgtgagccagtacgaggagcagttcgtgaccctgttcaccctgaccatgatgcagctgaagcagatgctgcccctgaacaccaacatcagactggcctacagcaacggcaaggacgacgagcagaacttcatccagaacctgagcctgttcctgtgcaccttcctgaaggagcacgaccagctgatcgagaagagactgaacctgagagagaccctgatggaggccctgcactacatgctgctggtgagcgaggtggaggagaccgagatcttcaagatctgcctggagtactggaaccacctggccgccgagctgtacagagagagccccttcagcaccagcgccagccccctgctgagcggcagccagcacttcgacgtgccccccagaagacagctgtacctgcccatgctgttcaaggtgagactgctgatggtgagcagaatggccaagcccgaggaggtgctggtggtggagaacgaccagggcgaggtggtgagagagttcatgaaggacaccgacagcatcaacctgtacaagaacatgagagagaccctggtgtacctgacccacctggactacgtggacaccgagagaatcatgaccgagaagctgcacaaccaggtgaacggcaccgagtggagctggaagaacctgaacaccctgtgctgggccatcggcagcatcagcggcgccatgcacgaggaggacgagaagagattcctggtgaccgtgatcaaggacctgctgggcctgtgcgagcagaagagaggcaaggacaacaaggccatcatcgccagcaacatcatgtacatcgtgggccagtaccccagattcctgagagcccactggaagttcctgaagaccgtggtgaacaagctgttcgagttcatgcacgagacccacgacggcgtgcaggacatggcctgcgacaccttcatcaagatcgcccagaagtgcagaagacacttcgtgcaggtgcaggtgggcgaggtgatgcccttcatcgacgagatcctgaacaacatcaacaccatcatctgcgacctgcagccccagcaggtgcacaccttctacgaggccgtgggctacatgatcggcgcccagaccgaccagaccgtgcaggagcacctgatcgagaagtacatgctgctgcccaaccaggtgtgggacagcatcatccagcaggccaccaagaacgtggacatcctgaaggaccccgagaccgtgaagcagctgggcagcatcctgaagaccaacgtgagagcctgcaaggccgtgggccaccccttcgtgatccagctgggcagaatctacctggacatgctgaacgtgtacaagtgcctgagcgagaacatcagcgccgccatccaggccaacggcgagatggtgaccaagcagcccctgatcagaagcatgagaaccgtgaagagagagaccctgaagctgatcagcggctgggtgagcagaagcaacgacccccagatggtggccgagaacttcgtgccccccctgctggacgccgtgctgatcgactaccagagaaacgtgcccgccgccagagagcccgaggtgctgagcaccatggccatcatcgtgaacaagctgggcggccacatcaccgccgagatcccccagatcttcgacgccgtgttcgagtgcaccctgaacatgatcaacaaggacttcgaggagtaccccgagcacagaaccaacttcttcctgctgctgcaggccgtgaacagccactgcttccccgccttcctggccatcccccccacccagttcaagctggtgctggacagcatcatctgggccttcaagcacaccatgagaaacgtggccgacaccggcctgcagatcctgttcaccctgctgcagaacgtggcccaggaggaggccgccgcccagagcttctaccagacctacttctgcgacatcctgcagcacatcttcagcgtggtgaccgacaccagccacaccgccggcctgaccatgcacgccagcatcctggcctacatgttcaacctggtggaggagggcaagatcagcaccagcctgaaccccggcaaccccgtgaacaaccagatcttcctgcaggagtacgtggccaacctgctgaagagcgccttcccccacctgcaggacgcccaggtgaagctgttcgtgaccggcctgttcagcctgaaccaggacatccccgccttcaaggagcacctgagagacttcctggtgcagatcaaggagttcgccggcgaggacaccagcgacctgttcctggaggagagagagatcgccctgagacaggccgacgaggagaagcacaagagacagatgagcgtgcccggcatcttcaacccccacgagatccccgaggagatgtgcgactag

SEQ ID NO: 81051 - DNA, 3216 bp, Artificial Sequence; identical to SEQ ID NO: 81050
  Description of Artificial Sequence: Synthetic coding sequence

SEQ ID NO: 81052 - DNA, 3216 bp, Artificial Sequence; identical to SEQ ID NO: 81050
  Description of Artificial Sequence: Synthetic coding sequence

SEQ ID NO: 81053 - DNA, 303 bp, Artificial Sequence
  Description of Artificial Sequence: Synthetic coding sequence
atgcccgccatcatgaccatgctggccgaccacgccgccagacagctgctggacttcagccagaagctggacatcaacctgctggacaacgtggtgaactgcctgtaccacggcgagggcgcccagcagagaatggcccaggaggtgctgacccacctgaaggagcaccccgacgcctggaccagagtggacaccatcctggagttcagccagaacatgaacaccaagtactacggcctgcagatcctggagaacgtgatcaagaccagatggaagatcctgcccagaaaccagtgcgagtag

SEQ ID NO: 81054 - DNA, 288 bp, Artificial Sequence
  Description of Artificial Sequence: Synthetic coding sequence
atgcccgccatcatgaccatgctggccgaccacgccgccagacagctgctggacttcagccagaagctggacatcaacctgctggacaacgtggtgaactgcctgtaccacggcgagggcgcccagcagagaatggcccaggaggtgctgacccacctgaaggagcaccccgacgcctggaccagagtggacaccatcctggagttcagccagaacatgaacaccaagtactacggcctgcagatcctggagaacgtgatcaagaccagatggaagatcctgccctag

SEQ ID NO: 81055 - DNA, 180 bp, Artificial Sequence
  Description of Artificial Sequence: Synthetic coding sequence
atgcccgccatcatgaccatgctggccgaccacgccgccagacagctgctggacttcagccagaagctggacatcaacctgctggacaacgtggtgaactgcctgtaccacggcgagggcgcccagcagagaatggcccaggaggtgctgacccacctgaaggagcaccccgacgcctag

SEQ ID NO: 81056 - DNA, 399 bp, Artificial Sequence
  Description of Artificial Sequence: Synthetic coding sequence
atgcccgccatcatgaccatgctggccgaccacgccgccagacagctgctggacttcagccagaagctggacatcaacctgctggacaacgtggtgaactgcctgtaccacggcgagggcgcccagcagagaatggcccaggaggtgctgacccacctgaaggagcaccccgacgcctggaccagagtggacaccatcctggagttcagccagaacatgaacaccaagtactacggcctgcagatcctggagaacgtgatcaagaccagatggaagatcctgcccagaaaccagtgcgagggcatcaagaagtacgtggtgggcctgatcatcaagaccagcagcgaccccacctgcgtggagaaggagaaggtgtacatcggcaagctgaacatgtag

SEQ ID NO: 81057 - DNA, 189 bp, Artificial Sequence
  Description of Artificial Sequence: Synthetic coding sequence
atgcccgccatcatgaccatgctggccgaccacgccgccagacagctgctggacttcagccagaagctggacatcaacctgctggacaacgtggtgaactgcctgtaccacggcgagggcgcccagcagagaatggcccaggaggtgctgacccacctgaaggagcaccccgacgcctggaccagatag

SEQ ID NO: 81058 - DNA, 540 bp, Artificial Sequence
  Description of Artificial Sequence: Synthetic coding sequence
atgcccgccatcatgaccatgctggccgaccacgccgccagacagctgctggacttcagccagaagctggacatcaacctgctggacaacgtggtgaactgcctgtaccacggcgagggcgcccagcagagaatggcccaggaggtgctgacccacctgaaggagcaccccgacgcctggaccagagtggacaccatcctggagttcagccagaacatgaacaccaagtactacggcctgcagatcctggagaacgtgatcaagaccagatggaagatcctgcccagaaaccagtgcgagggcatcaagaagtacgtggtgggcctgatcatcaagaccagcagcgaccccacctgcgtggagaaggagaaggtgtacatcggcaagctgaacatgatcctggtgcagatcctgaagcaggagtggcccaagcactggcccaccttcatcagcgacatcgtgggcgccagcagaaccagcgagagcctgtgccagaacaacatggtgatcctgaagctgctgagcgaggaggtgttctag

SEQ ID NO: 81059 - DNA, 285 bp, Artificial Sequence
  Description of Artificial Sequence: Synthetic coding sequence
atgcccgccatcatgaccatgctggccgaccacgccgccagacagctgctggacttcagccagaagctggacatcaacctgctggacaacgtggtgaactgcctgtaccacggcgagggcgcccagcagagaatggcccaggaggtgctgacccacctgaaggagcaccccgacgcctggaccagagtggacaccatcctggagttcagccagaacatgaacaccaagtactacggcctgcagatcctggagaacgtgatcaagaccagatggaagatcctgtag

SEQ ID NO: 81060 - DNA, 3615 bp, Artificial Sequence
  Description of Artificial Sequence: Synthetic coding sequence
atggccatggaccaggtgaacgccctgtgcgagcagctggtgaaggccgtgaccgtgatgatggaccccaacagcacccagagatacagactggaggccctgaagttctgcgaggagttcaaggagaagtgccccatctgcgtgccctgcggcctgagactggccgagaagacccaggtggccatcgtgagacacttcggcctgcagatcctggagcacgtggtgaagttcagatggaacggcatgagcagactggagaaggtgtacctgaagaacagcgtgatggagctgatcgccaacggcaccctgaacatcctggaggaggagaaccacatcaaggacgccctgagcagaatcgtggtggagatgatcaagagagagtggccccagcactggcccgacatgctgatcgagctggacaccctgagcaagcagggcgagacccagaccgagctggtgatgttcatcctgctgagactggccgaggacgtggtgaccttccagaccctgcccccccagagaagaagagacatccagcagaccctgacccagaacatggagagaatcttcagcttcctgctgaacaccctgcaggagaacgtgaacaagtaccagcaggtgaagaccgacaccagccaggagagcaaggcccaggccaactgcagagtgggcgtggccgccctgaacaccctggccggctacatcgactgggtgagcatgagccacatcaccgccgagaactgcaagctgctggagatcctgtgcctgctgctgaacgagcaggagctgcagctgggcgccgccgagtgcctgctgatcgccgtgagcagaaagggcaagctggaggacagaaagcccctgatggtgctgttcggcgacgtggccatgcactacatcctgagcgccgcccagaccgccgacggcggcggcctggtggagaagcactacgtgttcctgaagagactgtgccaggtgctgtgcgccctgggcaaccagctgtgcgccctgctgggcgccgacagcgacgtggagacccccagcaacttcggcaagtacctggagagcttcctggccttcaccacccaccccagccagttcctgagaagcagcacccagatgacctggggcgccctgttcagacacgagatcctgagcagagaccccctgctgctggccatcatccccaagtacctgagagccagcatgaccaacctggtgaagatgggcttccccagcaagaccgacagccccagctgcgagtacagcagattcgacttcgacagcgacgaggacttcaacgccttcttcaacagcagcagagcccagcagggcgaggtgatgagactggcctgcagactggaccccaagaccagcttccagatggccggcgagtggctgaagtaccagctgagcaccttcctggacgccggcagcgtgaacagctgcagcgccgtgggcaccggcgagggcagcctgtgcagcgtgttcagccccagcttcgtgcagtgggaggccatgaccctgttcctggagagcgtgatcacccagatgttcagaaccctgaacagagaggagatccccgtgaacgacggcatcgagctgctgcagatggtgctgaacttcgacaccaaggaccccctgatcctgagctgcgtgctgaccaacgtgagcgccctgttccccttcgtgacctacagacccgagttcctgccccaggtgttcagcaagctgttcagcagcgtgaccttcgagaccgtggaggagagcaaggcccccagaaccagagccgtgagaaacgtgagaagacacgcctgcagcagcatcatcaagatgtgcagagactacccccagctggtgctgcccaacttcgacatgctgtacaaccacgtgaagcagctgctgagcaacgagctgctgctgacccagatggagaagtgcgccctgatggaggccctggtgctgatcagcaaccagttcaagaactacgagagacagaaggtgttcctggaggagctgatggcccccgtggccagcatctggctgagccaggacatgcacagagtgctgagcgacgtggacgccttcatcgcctacgtgggcaccgaccagaagagctgcgaccccggcctggaggacccctgcggcctgaacagagccagaatgagcttctgcgtgtacagcatcctgggcgtggtgaagagaacctgctggcccaccgacctggaggaggccaaggccggcggcttcgtggtgggctacaccagcagcggcaaccccatcttcagaaacccctgcaccgagcagatcctgaagctgctggacaacctgctggccctgatcagaacccacaacaccctgtacgcccccgagatgctggccaagatggccgagcccttcaccaaggccctggacatgctggacgccgagaagagcgccatcctgggcctgccccagcccctgctggagctgaacgacagccccgtgttcaagaccgtgctggagagaatgcagagattcttcagcaccctgtacgagaactgcttccacatcctgggcaaggccggccccagcatgcagcaggacttctacaccgtggaggacctggccacccagctgctgagcagcgccttcgtgaacctgaacaacatccccgactacagactgagacccatgctgagagtgttcgtgaagcccctggtgctgttctgcccccccgagcactacgaggccctggtgagccccatcctgggccccctgttcacctacctgcacatgagactgagccagaagtggcaggtgatcaaccagagaagcctgctgtgcggcgaggacgaggccgccgacgagaaccccgagagccaggagatgctggaggagcagctggtgagaatgctgaccagagaggtgatggacctgatcaccgtgtgctgcgtgagcaagaagggcgccgaccacagcagcgccccccccgccgacggcgacgacgaggagatgatggccaccgaggtgacccccagcgccatggccgagctgaccgacctgggcaagtgcctgatgaagcacgaggacgtgtgcaccgccctgctgatcaccgccttcaacagcctggcctggaaggacaccctgagctgccagagaaccaccagccagctgtgctggcccctgctgaagcaggtgctgagcggcaccctgctggccgacgccgtgacctggctgttcaccagcgtgctgaagggcctgcagatgcacggccagcacgacggctgcatggccagcctggtgcacctggccttccagatctacgaggccctgagacccagatacctggagatcagagccgtgatggagcagatccccgagatccagaaggacagcctggaccagttcgactgcaagctgctgaaccccagcctgcagaaggtggccgacaagagaagaaaggaccagttcaagagactgatcgccggctgcatcggcaagcccctgggcgagcagttcagaaaggaggtgcacatcaagaacctgcccagcctgttcaagaagaccaagcccatgctggagaccgaggtgctggacaacgacggcggcggcctggccaccatcttcgagccctag

SEQ ID NO: 81061 - DNA, 513 bp, Artificial Sequence
  Description of Artificial Sequence: Synthetic coding sequence
atggccggcgagtggctgaagtaccagctgagcaccttcctggacgccggcagcgtgaacagctgcagcgccgtgggcaccggcgagggcagcctgtgcagcgtgttcagccccagcttcgtgcagtgggaggccatgaccctgttcctggagagcgtgatcacccagatgttcagaaccctgaacagagaggagatccccgtgaacgacggcatcgagctgctgcagatggtgctgaacttcgacaccaaggaccccctgatcctgagctgcgtgctgaccaacgtgagcgccctgttccccttcgtgacctacagacccgagttcctgccccaggtgttcagcaagctgttcagcagcgtgaccttcgagaccgtggaggagagcaagcccccccacttcccccccctgagcgcctggaaggagatccaggtgtggagctggagagagcaggccctgtgcagaaccagaagcaactacaccaaggtgagcagaaagggcgtgagagcctag

SEQ ID NO: 81062 - DNA, 2166 bp, Artificial Sequence
  Description of Artificial Sequence: Synthetic coding sequence
atggccggcgagtggctgaagtaccagctgagcaccttcctggacgccggcagcgtgaacagctgcagcgccgtgggcaccggcgagggcagcctgtgcagcgtgttcagccccagcttcgtgcagtgggaggccatgaccctgttcctggagagcgtgatcacccagatgttcagaaccctgaacagagaggagatccccgtgaacgacggcatcgagctgctgcagatggtgctgaacttcgacaccaaggaccccctgatcctgagctgcgtgctgaccaacgtgagcgccctgttccccttcgtgacctacagacccgagttcctgccccaggtgttcagcaagctgttcagcagcgtgaccttcgagaccgtggaggagagcaaggcccccagaaccagagccgtgagaaacgtgagaagacacgcctgcagcagcatcatcaagatgtgcagagactacccccagctggtgctgcccaacttcgacatgctgtacaaccacgtgaagcagctgctgagcaacgagctgctgctgacccagatggagaagtgcgccctgatggaggccctggtgctgatcagcaaccagttcaagaactacgagagacagaaggtgttcctggaggagctgatggcccccgtggccagcatctggctgagccaggacatgcacagagtgctgagcgacgtggacgccttcatcgcctacgtgggcaccgaccagaagagctgcgaccccggcctggaggacccctgcggcctgaacagagccagaatgagcttctgcgtgtacagcatcctgggcgtggtgaagagaacctgctggcccaccgacctggaggaggccaaggccggcggcttcgtggtgggctacaccagcagcggcaaccccatcttcagaaacccctgcaccgagcagatcctgaagctgctggacaacctgctggccctgatcagaacccacaacaccctgtacgcccccgagatgctggccaagatggccgagcccttcaccaaggccctggacatgctggacgccgagaagagcgccatcctgggcctgccccagcccctgctggagctgaacgacagccccgtgttcaagaccgtgctggagagaatgcagagattcttcagcaccctgtacgagaactgcttccacatcctgggcaaggccggccccagcatgcagcaggacttctacaccgtggaggacctggccacccagctgctgagcagcgccttcgtgaacctgaacaacatccccgactacagactgagacccatgctgcacatcctgagcaagcccctggtgctgttctgcccccccgagcactacgaggccctggtgagccccatcctgggccccctgttcacctacctgcacatgagactgagccagaagtggcaggtgatcaaccagagaagcctgctgtgcggcgaggacgaggccgccgacgagaaccccgagagccaggagatgctggaggagcagctggtgagaatgctgaccagagaggtgatggacctgatcaccgtgtgctgcgtgagcaagaagggcgccgaccacagcagcgccccccccgccgacggcgacgacgaggagatgatggccaccgaggtgacccccagcgccatggccgagctgaccgacctgggcaagtgcctgatgaagcacgaggacgtgtgcaccgccctgctgatcaccgccttcaacagcctggcctggaaggacaccctgagctgccagagaaccaccagccagctgtgctggcccctgctgaagcaggtgctgagcggcaccctgctggccgacgccgtgacctggctgttcaccagcgtgctgaagggcctgcagatgcacggccagcacgacggctgcatggccagcctggtgcacctggccttccagatctacgaggccctgagacccagatacctggagatcagagccgtgatggagcagatccccgagatccagaaggacagcctggaccagttcgactgcaagctgctgaaccccagcctgcagaaggtggccgacaagagaagaaaggaccagttcaagagactgatcgccggctgcatcggcaagcccctgggcgagcagttcagaaaggaggtgcacatcaagaacctgcccttcgtggccgacctgtag

SEQ ID NO: 81063 - DNA, 2211 bp, Artificial Sequence
  Description of Artificial Sequence: Synthetic coding sequence
atgcactacatcctgagcgccgcccagaccgccgacggcggcggcctggtggagaagcactacgtgttcctgaagagactgtgccaggtgctgtgcgccctgggcaaccagctgtgcgccctgctgggcgccgacagcgacgtggagacccccagcaacttcggcaagtacctggagagcttcctggccttcaccacccaccccagccagttcctgagaagcagcacccagatgacctggggcgccctgttcagacacgagatcctgagcagagaccccctgctgctggccatcatccccaagtacctgagagccagcatgaccaacctggtgaagatgggcttccccagcaagaccgacagccccagctgcgagtacagcagattcgacttcgacagcgacgaggacttcaacgccttcttcaacagcagcagagcccagcagggcgaggtgatgagactggcctgcagactggaccccaagaccagcttccagatggccggcgagtggctgaagtaccagctgagcaccttcctggacgccggcagcgtgaacagctgcagcgccgtgggcaccggcgagggcagcctgtgcagcgtgttcagccccagcttcgtgcagtgggaggccatgaccctgttcctggagagcgtgatcacccagatgttcagaaccctgaacagagaggagatccccgtgaacgacggcatcgagctgctgcagatggtgctgaacttcgacaccaaggaccccctgatcctgagctgcgtgctgaccaacgtgagcgccctgttccccttcgtgacctacagacccgagttcctgccccaggtgttcagcaagctgttcagcagcgtgaccttcgagaccgtggaggagagcaaggcccccagaaccagagccgtgagaaacgtgagaagacacgcctgcagcagcatcatcaagatgtgcagagactacccccagctggtgctgcccaacttcgacatgctgtacaaccacgtgaagcagctgctgagcaacgagctgctgctgacccagatggagaagtgcgccctgatggaggccctggtgctgatcagcaaccagttcaagaactacgagagacagaaggtgttcctggaggagctgatggcccccgtggccagcatctggctgagccaggacatgcacagagtgctgagcgacgtggacgccttcatcgcctacgtgggcaccgaccagaagagctgcgaccccggcctggaggacccctgcggcctgaacagagccagaatgagcttctgcgtgtacagcatcctgggcgtggtgaagagaacctgctggcccaccgacctggaggaggccaaggccggcggcttcgtggtgggctacaccagcagcggcaaccccatcttcagaaacccctgcaccgagcagatcctgaagctgctggacaacctgctggccctgatcagaacccacaacaccctgtacgcccccgagatgctggccaagatggccgagcccttcaccaaggccctggacatgctggacgccgagaagagcgccatcctgggcctgccccagcccctgctggagctgaacgacagccccgtgttcaagaccgtgctggagagaatgcagagattcttcagcaccctgtacgagaactgcttccacatcctgggcaaggccggccccagcatgcagcaggacttctacaccgtggaggacctggccacccagctgctgagcagcgccttcgtgaacctgaacaacatccccgactacagactgagacccatgctgcacatcctgagcaagcccctggtgctgttctgcccccccgagcactacgaggccctggtgagccccatcctgggccccctgttcacctacctgcacatgagactgagccagaagtggcaggtgatcaaccagagaagcctgctgtgcggcgaggacgaggccgccgacgagaaccccgagagccaggagatgctggaggagcagctggtgagaatgctgaccagagaggtgatggacctgatcaccgtgtgctgcgtgagcaagaagggcgccgaccacagcagcgccccccccgccgacggcgacgacgaggagatgatggccaccgaggtgacccccagcgccatggccgagctgaccgacctggtgagcatccagagcaccgacaagagagtgagccccagagccgaggtggactag

SEQ ID NO: 81064 - DNA, 2499 bp, Artificial Sequence
  Description of Artificial Sequence: Synthetic coding sequence
atgacctggggcgccctgttcagacacgagatcctgagcagagaccccctgctgctggccatcatccccaagtacctgagagccagcatgaccaacctggtgaagatgggcttccccagcaagaccgacagccccagctgcgagtacagcagattcgacttcgacagcgacgaggacttcaacgccttcttcaacagcagcagagcccagcagggcgaggtgatgagactggcctgcagactggaccccaagaccagcttccagatggccggcgagtggctgaagtaccagctgagcaccttcctggacgccggcagcgtgaacagctgcagcgccgtgggcaccggcgagggcagcctgtgcagcgtgttcagccccagcttcgtgcagtgggaggccatgaccctgttcctggagagcgtgatcacccagatgttcagaaccctgaacagagaggagatccccgtgaacgacggcatcgagctgctgcagatggtgctgaacttcgacaccaaggaccccctgatcctgagctgcgtgctgaccaacgtgagcgccctgttccccttcgtgacctacagacccgagttcctgccccaggtgttcagcaagctgttcagcagcgtgaccttcgagaccgtggaggagagcaaggcccccagaaccagagccgtgagaaacgtgagaagacacgcctgcagcagcatcatcaagatgtgcagagactacccccagctggtgctgcccaacttcgacatgctgtacaaccacgtgaagcagctgctgagcaacgagctgctgctgacccagatggagaagtgcgccctgatggaggccctggtgctgatcagcaaccagttcaagaactacgagagacagaaggtgttcctggaggagctgatggcccccgtggccagcatctggctgagccaggacatgcacagagtgctgagcgacgtggacgccttcatcgcctacgtgggcaccgaccagaagagctgcgaccccggcctggaggacccctgcggcctgaacagagccagaatgagcttctgcgtgtacagcatcctgggcgtggtgaagagaacctgctggcccaccgacctggaggaggccaaggccggcggcttcgtggtgggctacaccagcagcggcaaccccatcttcagaaacccctgcaccgagcagatcctgaagctgctggacaacctgctggccctgatcagaacccacaacaccctgtacgcccccgagatgctggccaagatggccgagcccttcaccaaggccctggacatgctggacgccgagaagagcgccatcctgggcctgccccagcccctgctggagctgaacgacagccccgtgttcaagaccgtgctggagagaatgcagagattcttcagcaccctgtacgagaactgcttccacatcctgggcaaggccggccccagcatgcagcaggacttctacaccgtggaggacctggccacccagctgctgagcagcgccttcgtgaacctgaacaacatccccgactacagactgagacccatgctgagagtgttcgtgaagcccctggtgctgttctgcccccccgagcactacgaggccctggtgagccccatcctgggccccctgttcacctacctgcacatgagactgagccagaagtggcaggtgatcaaccagagaagcctgctgtgcggcgaggacgaggccgccgacgagaaccccgagagccaggagatgctggaggagcagctggtgagaatgctgaccagagaggtgatggacctgatcaccgtgtgctgcgtgagcaagaagggcgccgaccacagcagcgccccccccgccgacggcgacgacgaggagatgatggccaccgaggtgacccccagcgccatggccgagctgaccgacctgggcaagtgcctgatgaagcacgaggacgtgtgcaccgccctgctgatcaccgccttcaacagcctggcctggaaggacaccctgagctgccagagaaccaccagccagctgtgctggcccctgctgaagcaggtgctgagcggcaccctgctggccgacgccgtgacctggctgttcaccagcgtgctgaagggcctgcagatgcacggccagcacgacggctgcatggccagcctggtgcacctggccttccagatctacgaggccctgagacccagatacctggagatcagagccgtgatggagcagatccccgagatccagaaggacagcctggaccagttcgactgcaagctgctgaaccccagcctgcagaaggtggccgacaagagaagaaaggaccagttcaagagactgatcgccggctgcatcggcaagcccctgggcgagcagttcagaaaggaggtgcacatcaagaacctgcccagcctgttcaagaagaccaagcccatgctggagaccgaggtgctggacaacgacggcggcggcctggccaccatcttcgagccctag

SEQ ID NO: 81065 - DNA, 3378 bp, Artificial Sequence
  Description of Artificial Sequence: Synthetic coding sequence
atggccagcgaggaggccagcctgagagccctggagagcctgatgaccgagttcttccacgactgcaccaccaacgagagaaagagagagatcgaggagctgctgaacaacttcgcccagcagatcggcgcctggagattctgcctgtacttcctgagcagcaccagaaacgactacgtgatgatgtacagcctgaccgtgttcgagaacctgatcaacaagatgtggctgggcgtgcccagccaggacaagatggagatcagaagctgcctgcccaagctgctgctggcccaccacaagaccctgccctacttcatcagaaacaagctgtgcaaggtgatcgtggacatcggcagacaggactggcccatgttctaccacgacttcttcaccaacatcctgcagctgatccagagccccgtgaccacccccctgggcctgatcatgctgaagaccaccagcgaggagctggcctgccccagagaggacctgagcgtggccagaaaggaggagctgagaaagctgctgctggaccaggtgcagaccgtgctgggcctgctgaccggcatcctggagaccgtgtgggacaagcacagcgtgaccgccgccacccccccccccagccccaccagcggcgagagcggcgacctgctgagcaacctgctgcagagccccagcagcgccaagctgctgaaccagcccatccccatcctggacgtggagagcgagtacatctgcagcctggccctggagtgcctggcccacctgttcagctggatccccctgagcgccagcatcacccccagcctgctgaccaccatcttccacttcgccagattcggctgcgacatcagagccagaaagatggccagcgtgaacggcagcagccagaactgcgtgagcggccaggagagaggcagactgggcgtgctggccatgagctgcatcaacgagctgatgagcaagaactgcgtgcccatggagttcgaggagtacctgctgagaatgttccagcagaccttctacctgctgcagaagatcaccaaggacaacaacgcccacaccgtgaagagcagactggaggagctggacgagagctacatcgagaagttcaccgacttcctgagactgttcgtgagcgtgcacctgagaagaatcgagagctacagccagttccccgtggtggagttcctgaccctgctgttcaagtacaccttccaccagcccacccacgagggctacttcagctgcctggacatctggaccctgttcctggactacctgaccagcaagatcaagagcagactgggcgacaaggaggccgtgctgaacagatacgaggacgccctggtgctgctgctgaccgaggtgctgaacagaatccagttcagatacaaccaggcccagctggaggagctggacgacgagaccctggacgacgaccagcagaccgagtggcagagatacctgagacagagcctggaggtggtggccaaggtgatggagctgctgcccacccacgccttcagcaccctgttccccgtgctgcaggacaacctggaggtgtacctgggcctgcagcagttcatcgtgaccagcggcagcggccacagactgaacatcaccgccgagaacgactgcagaagactgcactgcagcctgagagacctgagcagcctgctgcaggccgtgggcagactggccgagtacttcatcggcgacgtgttcgccgccagattcaacgacgccctgaccgtggtggagagactggtgaaggtgaccctgtacggcagccagatcaagctgtacaacatcgagaccgccgtgcccagcgtgctgaagcccgacctgatcgacgtgcacgcccagagcctggccgccctgcaggcctacagccactggctggcccagtactgcagcgaggtgcacagacagaacacccagcagttcgtgaccctgatcagcaccaccatggacgccatcacccccctgatcagcaccaaggtgcaggacaagctgctgctgagcgcctgccacctgctggtgagcctggccaccaccgtgagacccgtgttcctgatcagcatccccgccgtgcagaaggtgttcaacagaatcaccgacgccagcgccctgagactggtggacaaggcccaggtgctggtgtgcagagccctgagcaacatcctgctgctgccctggcccaacctgcccgagaacgagcagcagtggcccgtgagaagcatcaaccacgccagcctgatcagcgccctgagcagagactacagaaacctgaagcccagcgccgtggccccccagagaaagatgcccctggacgacaccaagctgatcatccaccagaccctgagcgtgctggaggacatcgtggagaacatcagcggcgagagcaccaagagcagacagatctgctaccagagcctgcaggagagcgtgcaggtgagcctggccctgttccccgccttcatccaccagagcgacgtgaccgacgagatgctgagcttcttcctgaccctgttcagaggcctgagagtgcagatgggcgtgcccttcaccgagcagatcatccagaccttcctgaacatgttcaccagagagcagctggccgagagcatcctgcacgagggcagcaccggctgcagagtggtggagaagttcctgaagatcctgcaggtggtggtgcaggagcccggccaggtgttcaagcccttcctgcccagcatcatcgccctgtgcatggagcaggtgtaccccatcatcgccgagagacccagccccgacgtgaaggccgagctgttcgagctgctgttcagaaccctgcaccacaactggagatacttcttcaagagcaccgtgctggccagcgtgcagagaggcatcgccgaggagcagatggagaacgagccccagttcagcgccatcatgcaggccttcggccagagcttcctgcagcccgacatccacctgttcaagcagaacctgttctacctggagaccctgaacaccaagcagaagctgtaccacaagaagatcttcagaaccgccatgctgttccagttcgtgaacgtgctgctgcaggtgctggtgcacaagagccacgacctgctgcaggaggagatcggcatcgccatctacaacatggccagcgtggacttcgacggcttcttcgccgccttcctgcccgagttcctgaccagctgcgacggcgtggacgccaaccagaagagcgtgctgggcagaaacttcaagatggacagagacctgcccagcttcacccagaacgtgcacagactggtgaacgacctgagatactacagactgtgcaacgacagcctgccccccggcaccgtgaagctgtag

SEQ ID NO: 81066 - DNA, 3336 bp, Artificial Sequence
  Description of Artificial Sequence: Synthetic coding sequence
atgaccgagttcttccacgactgcaccaccaacgagagaaagagagagatcgaggagctgctgaacaacttcgcccagcagatcggcgcctggagattctgcctgtacttcctgagcagcaccagaaacgactacgtgatgatgtacagcctgaccgtgttcgagaacctgatcaacaagatgtggctgggcgtgcccagccaggacaagatggagatcagaagctgcctgcccaagctgctgctggcccaccacaagaccctgccctacttcatcagaaacaagctgtgcaaggtgatcgtggacatcggcagacaggactggcccatgttctaccacgacttcttcaccaacatcctgcagctgatccagagccccgtgaccacccccctgggcctgatcatgctgaagaccaccagcgaggagctggcctgccccagagaggacctgagcgtggccagaaaggaggagctgagaaagctgctgctggaccaggtgcagaccgtgctgggcctgctgaccggcatcctggagaccgtgtgggacaagcacagcgtgaccgccgccacccccccccccagccccaccagcggcgagagcggcgacctgctgagcaacctgctgcagagccccagcagcgccaagctgctgaaccagcccatccccatcctggacgtggagagcgagtacatctgcagcctggccctggagtgcctggcccacctgttcagctggatccccctgagcgccagcatcacccccagcctgctgaccaccatcttccacttcgccagattcggctgcgacatcagagccagaaagatggccagcgtgaacggcagcagccagaactgcgtgagcggccaggagagaggcagactgggcgtgctggccatgagctgcatcaacgagctgatgagcaagaactgcgtgcccatggagttcgaggagtacctgctgagaatgttccagcagaccttctacctgctgcagaagatcaccaaggacaacaacgcccacaccgtgaagagcagactggaggagctggacgagagctacatcgagaagttcaccgacttcctgagactgttcgtgagcgtgcacctgagaagaatcgagagctacagccagttccccgtggtggagttcctgaccctgctgttcaagtacaccttccaccagcccacccacgagggctacttcagctgcctggacatctggaccctgttcctggactacctgaccagcaagatcaagagcagactgggcgacaaggaggccgtgctgaacagatacgaggacgccctggtgctgctgctgaccgaggtgctgaacagaatccagttcagatacaaccaggcccagctggaggagctggacgacgagaccctggacgacgaccagcagaccgagtggcagagatacctgagacagagcctggaggtggtggccaaggtgatggagctgctgcccacccacgccttcagcaccctgttccccgtgctgcaggacaacctggaggtgtacctgggcctgcagcagttcatcgtgaccagcggcagcggccacagactgaacatcaccgccgagaacgactgcagaagactgcactgcagcctgagagacctgagcagcctgctgcaggccgtgggcagactggccgagtacttcatcggcgacgtgttcgccgccagattcaacgacgccctgaccgtggtggagagactggtgaaggtgaccctgtacggcagccagatcaagctgtacaacatcgagaccgccgtgcccagcgtgctgaagcccgacctgatcgacgtgcacgcccagagcctggccgccctgcaggcctacagccactggctggcccagtactgcagcgaggtgcacagacagaacacccagcagttcgtgaccctgatcagcaccaccatggacgccatcacccccctgatcagcaccaaggtgcaggacaagctgctgctgagcgcctgccacctgctggtgagcctggccaccaccgtgagacccgtgttcctgatcagcatccccgccgtgcagaaggtgttcaacagaatcaccgacgccagcgccctgagactggtggacaaggcccaggtgctggtgtgcagagccctgagcaacatcctgctgctgccctggcccaacctgcccgagaacgagcagcagtggcccgtgagaagcatcaaccacgccagcctgatcagcgccctgagcagagactacagaaacctgaagcccagcgccgtggccccccagagaaagatgcccctggacgacaccaagctgatcatccaccagaccctgagcgtgctggaggacatcgtggagaacatcagcggcgagagcaccaagagcagacagatctgctaccagagcctgcaggagagcgtgcaggtgagcctggccctgttccccgccttcatccaccagagcgacgtgaccgacgagatgctgagcttcttcctgaccctgttcagaggcctgagagtgcagatgggcgtgcccttcaccgagcagatcatccagaccttcctgaacatgttcaccagagagcagctggccgagagcatcctgcacgagggcagcaccggctgcagagtggtggagaagttcctgaagatcctgcaggtggtggtgcaggagcccggccaggtgttcaagcccttcctgcccagcatcatcgccctgtgcatggagcaggtgtaccccatcatcgccgagagacccagccccgacgtgaaggccgagctgttcgagctgctgttcagaaccctgcaccacaactggagatacttcttcaagagcaccgtgctggccagcgtgcagagaggcatcgccgaggagcagatggagaacgagccccagttcagcgccatcatgcaggccttcggccagagcttcctgcagcccgacatccacctgttcaagcagaacctgttctacctggagaccctgaacaccaagcagaagctgtaccacaagaagatcttcagaaccgccatgctgttccagttcgtgaacgtgctgctgcaggtgctggtgcacaagagccacgacctgctgcaggaggagatcggcatcgccatctacaacatggccagcgtggacttcgacggcttcttcgccgccttcctgcccgagttcctgaccagctgcgacggcgtggacgccaaccagaagagcgtgctgggcagaaacttcaagatggacagagacctgcccagcttcacccagaacgtgcacagactggtgaacgacctgagatactacagactgtgcaacgacagcctgccccccggcaccgtgaagctgtag

SEQ ID NO: 81067 - DNA, 3264 bp, Artificial Sequence
  Description of Artificial Sequence: Synthetic coding sequence
atggccgaccacgtgcagagcctggcccagctggagaacctgtgcaagcagctgtacgagaccaccgacaccaccaccagactgcaggccgagaaggccctggtggagttcaccaacagccccgactgcctgagcaagtgccagctgctgctggagagaggcagcagcagctacagccagctgctggccgccacctgcctgaccaagctggtgagcagaaccaacaaccccctgcccctggagcagagaatcgacatcagaaactacgtgctgaactacctggccaccagacccaagctggccaccttcgtgacccaggccctgatccagctgtacgccagaatcaccaagctgggctggttcgactgccagaaggacgactacgtgttcagaaacgccatcaccgacgtgaccagattcctgcaggacagcgtggagtactgcatcatcggcgtgaccatcctgagccagctgaccaacgagatcaaccaggccgacaccacccaccccctgaccaagcacagaaagatcgccagcagcttcagagacagcagcctgttcgacatcttcaccctgagctgcaacctgctgaagcaggccagcggcaagaacctgaacctgaacgacgagagccagcacggcctgctgatgcagctgctgaagctgacccacaactgcctgaacttcgacttcatcggcaccagcaccgacgagagcagcgacgacctgtgcaccgtgcagatccccaccagctggagaagcgccttcctggacagcagcaccctgcagctgttcttcgacctgtaccacagcatcccccccagcttcagccccctggtgctgagctgcctggtgcagatcgccagcgtgagaagaagcctgttcaacaacgccgagagagccaagttcctgagccacctggtggacggcgtgaagagaatcctggagaacccccagagcctgagcgaccccaacaactaccacgagttctgcagactgctggccagactgaagagcaactaccagctgggcgagctggtgaaggtggagaactaccccgaggtgatcagactgatcgccaacttcaccgtgaccagcctgcagcactgggagttcgcccccaacagcgtgcactacctgctgagcctgtggcagagactggccgccagcgtgccctacgtgaaggccaccgagccccacatgctggagacctacacccccgaggtgaccaaggcctacatcaccagcagactggagagcgtgcacatcatcctgagagacggcctggaggaccccctggaggacaccggcctggtgcagcagcagctggaccagctgagcaccatcggcagatgcgagtacgagaagacctgcgccctgctggtgcagctgttcgaccagagcgcccagagctaccaggagctgctgcagagcgccagcgccagccccatggacatcgccgtgcaggagggcagactgacctggctggtgtacatcatcggcgccgtgatcggcggcagagtgagcttcgccagcaccgacgagcaggacgccatggacggcgagctggtgtgcagagtgctgcagctgatgaacctgaccgacagcagactggcccaggccggcaacgagaagctggagctggccatgctgagcttcttcgagcagttcagaaagatctacatcggcgaccaggtgcagaagagcagcaagctgtacagaagactgagcgaggtgctgggcctgaacgacgagaccatggtgctgagcgtgttcatcggcaagatcatcaccaacctgaagtactggggcagatgcgagcccatcaccagcaagaccctgcagctgctgaacgacctgagcatcggctacagcagcgtgagaaagctggtgaagctgagcgccgtgcagttcatgctgaacaaccacaccagcgagcacttcagcttcctgggcatcaacaaccagagcaacctgaccgacatgagatgcagaaccaccttctacaccgccctgggcagactgctgatggtggacctgggcgaggacgaggaccagtacgagcagttcatgctgcccctgaccgccgccttcgaggccgtggcccagatgttcagcaccaacagcttcaacgagcaggaggccaagagaaccctggtgggcctggtgagagacctgagaggcatcgccttcgccttcaacgccaagaccagcttcatgatgctgttcgagtggatctaccccagctacatgcccatcctgcagagagccatcgagctgtggtaccacgaccccgcctgcaccacccccgtgctgaagctgatggccgagctggtgcacaacagaagccagagactgcagttcgacgtgagcagccccaacggcatcctgctgttcagagagaccagcaagatgatcaccatgtacggcaacagaatcctgaccctgggcgaggtgcccaaggaccaggtgtacgccctgaagctgaagggcatcagcatctgcttcagcatgctgaaggccgccctgagcggcagctacgtgaacttcggcgtgttcagactgtacggcgacgacgccctggacaacgccctgcagaccttcatcaagctgctgctgagcatcccccacagcgacctgctggactaccccaagctgagccagagctactacagcctgctggaggtgctgacccaggaccacatgaacttcatcgccagcctggagccccacgtgatcatgtacatcctgagcagcatcagcgagggcctgaccgccctggacaccatggtgtgcaccggctgctgcagctgcctggaccacatcgtgacctacctgttcaagcagctgagcagaagcaccaagaagagaaccacccccctgaaccaggagagcgacagattcctgcacatcatgcagcagcaccccgagatgatccagcagatgctgagcaccgtgctgaacatcatcatcttcgaggactgcagaaaccagtggagcatgagcagacccctgctgggcctgatcctgctgaacgagaagtacttcagcgacctgagaaacagcatcgtgaacagccagccccccgagaagcagcaggccatgcacctgtgcttcgagaacctgatggagggcatcgagagaaacctgctgaccaagaacagagacagattcacccagaacctgagcgccttcagaagagaggtgaacgacagcatgaagaacagcacctacggcgtgaacagcaacgacatgatgagctag

SEQ ID NO: 81068 - DNA, 3267 bp, Artificial Sequence
  Description of Artificial Sequence: Synthetic coding sequence
atgagagaccccggcagaaagagcctggcccagctggagaacctgtgcaagcagctgtacgagaccaccgacaccaccaccagactgcaggccgagaaggccctggtggagttcaccaacagccccgactgcctgagcaagtgccagctgctgctggagagaggcagcagcagctacagccagctgctggccgccacctgcctgaccaagctggtgagcagaaccaacaaccccctgcccctggagcagagaatcgacatcagaaactacgtgctgaactacctggccaccagacccaagctggccaccttcgtgacccaggccctgatccagctgtacgccagaatcaccaagctgggctggttcgactgccagaaggacgactacgtgttcagaaacgccatcaccgacgtgaccagattcctgcaggacagcgtggagtactgcatcatcggcgtgaccatcctgagccagctgaccaacgagatcaaccaggccgacaccacccaccccctgaccaagcacagaaagatcgccagcagcttcagagacagcagcctgttcgacatcttcaccctgagctgcaacctgctgaagcaggccagcggcaagaacctgaacctgaacgacgagagccagcacggcctgctgatgcagctgctgaagctgacccacaactgcctgaacttcgacttcatcggcaccagcaccgacgagagcagcgacgacctgtgcaccgtgcagatccccaccagctggagaagcgccttcctggacagcagcaccctgcagctgttcttcgacctgtaccacagcatcccccccagcttcagccccctggtgctgagctgcctggtgcagatcgccagcgtgagaagaagcctgttcaacaacgccgagagagccaagttcctgagccacctggtggacggcgtgaagagaatcctggagaacccccagagcctgagcgaccccaacaactaccacgagttctgcagactgctggccagactgaagagcaactaccagctgggcgagctggtgaaggtggagaactaccccgaggtgatcagactgatcgccaacttcaccgtgaccagcctgcagcactgggagttcgcccccaacagcgtgcactacctgctgagcctgtggcagagactggccgccagcgtgccctacgtgaaggccaccgagccccacatgctggagacctacacccccgaggtgaccaaggcctacatcaccagcagactggagagcgtgcacatcatcctgagagacggcctggaggaccccctggaggacaccggcctggtgcagcagcagctggaccagctgagcaccatcggcagatgcgagtacgagaagacctgcgccctgctggtgcagctgttcgaccagagcgcccagagctaccaggagctgctgcagagcgccagcgccagccccatggacatcgccgtgcaggagggcagactgacctggctggtgtacatcatcggcgccgtgatcggcggcagagtgagcttcgccagcaccgacgagcaggacgccatggacggcgagctggtgtgcagagtgctgcagctgatgaacctgaccgacagcagactggcccaggccggcaacgagaagctggagctggccatgctgagcttcttcgagcagttcagaaagatctacatcggcgaccaggtgcagaagagcagcaagctgtacagaagactgagcgaggtgctgggcctgaacgacgagaccatggtgctgagcgtgttcatcggcaagatcatcaccaacctgaagtactggggcagatgcgagcccatcaccagcaagaccctgcagctgctgaacgacctgagcatcggctacagcagcgtgagaaagctggtgaagctgagcgccgtgcagttcatgctgaacaaccacaccagcgagcacttcagcttcctgggcatcaacaaccagagcaacctgaccgacatgagatgcagaaccaccttctacaccgccctgggcagactgctgatggtggacctgggcgaggacgaggaccagtacgagcagttcatgctgcccctgaccgccgccttcgaggccgtggcccagatgttcagcaccaacagcttcaacgagcaggaggccaagagaaccctggtgggcctggtgagagacctgagaggcatcgccttcgccttcaacgccaagaccagcttcatgatgctgttcgagtggatctaccccagctacatgcccatcctgcagagagccatcgagctgtggtaccacgaccccgcctgcaccacccccgtgctgaagctgatggccgagctggtgcacaacagaagccagagactgcagttcgacgtgagcagccccaacggcatcctgctgttcagagagaccagcaagatgatcaccatgtacggcaacagaatcctgaccctgggcgaggtgcccaaggaccaggtgtacgccctgaagctgaagggcatcagcatctgcttcagcatgctgaaggccgccctgagcggcagctacgtgaacttcggcgtgttcagactgtacggcgacgacgccctggacaacgccctgcagaccttcatcaagctgctgctgagcatcccccacagcgacctgctggactaccccaagctgagccagagctactacagcctgctggaggtgctgacccaggaccacatgaacttcatcgccagcctggagccccacgtgatcatgtacatcctgagcagcatcagcgagggcctgaccgccctggacaccatggtgtgcaccggctgctgcagctgcctggaccacatcgtgacctacctgttcaagcagctgagcagaagcaccaagaagagaaccacccccctgaaccaggagagcgacagattcctgcacatcatgcagcagcaccccgagatgatccagcagatgctgagcaccgtgctgaacatcatcatcttcgaggactgcagaaaccagtggagcatgagcagacccctgctgggcctgatcctgctgaacgagaagtacttcagcgacctgagaaacagcatcgtgaacagccagccccccgagaagcagcaggccatgcacctgtgcttcgagaacctgatggagggcatcgagagaaacctgctgaccaagaacagagacagattcacccagaacctgagcgccttcagaagagaggtgaacgacagcatgaagaacagcacctacggcgtgaacagcaacgacatgatgagctag

SEQ ID NO: 81069 - DNA, 3291 bp, Artificial Sequence
  Description of Artificial Sequence: Synthetic coding sequence
atggccgaccacgtgcagagcctggcccagctggagaacctgtgcaagcagctgtacgagaccaccgacaccaccaccagactgcaggccgagaaggccctggtggagttcaccaacagccccgactgcctgagcaagtgccagctgctgctggagagaggcagcagcagctacagccagctgctggccgccacctgcctgaccaagctggtgagcagaaccaacaaccccctgcccctggagcagagaatcgacatcagaaactacgtgctgaactacctggccaccagacccaagctggccaccttcgtgacccaggccctgatccagctgtacgccagaatcaccaagctgggctggttcgactgccagaaggacgactacgtgttcagaaacgccatcaccgacgtgaccagattcctgcaggacagcgtggagtactgcatcatcggcgtgaccatcctgagccagctgaccaacgagatcaaccaggtgagcgccaccgccttcctgatcgaggccgacaccacccaccccctgaccaagcacagaaagatcgccagcagcttcagagacagcagcctgttcgacatcttcaccctgagctgcaacctgctgaagcaggccagcggcaagaacctgaacctgaacgacgagagccagcacggcctgctgatgcagctgctgaagctgacccacaactgcctgaacttcgacttcatcggcaccagcaccgacgagagcagcgacgacctgtgcaccgtgcagatccccaccagctggagaagcgccttcctggacagcagcaccctgcagctgttcttcgacctgtaccacagcatcccccccagcttcagccccctggtgctgagctgcctggtgcagatcgccagcgtgagaagaagcctgttcaacaacgccgagagagccaagttcctgagccacctggtggacggcgtgaagagaatcctggagaacccccagagcctgagcgaccccaacaactaccacgagttctgcagactgctggccagactgaagagcaactaccagctgggcgagctggtgaaggtggagaactaccccgaggtgatcagactgatcgccaacttcaccgtgaccagcctgcagcactgggagttcgcccccaacagcgtgcactacctgctgagcctgtggcagagactggccgccagcgtgccctacgtgaaggccaccgagccccacatgctggagacctacacccccgaggtgaccaaggcctacatcaccagcagactggagagcgtgcacatcatcctgagagacggcctggaggaccccctggaggacaccggcctggtgcagcagcagctggaccagctgagcaccatcggcagatgcgagtacgagaagacctgcgccctgctggtgcagctgttcgaccagagcgcccagagctaccaggagctgctgcagagcgccagcgccagccccatggacatcgccgtgcaggagggcagactgacctggctggtgtacatcatcggcgccgtgatcggcggcagagtgagcttcgccagcaccgacgagcaggacgccatggacggcgagctggtgtgcagagtgctgcagctgatgaacctgaccgacagcagactggcccaggccggcaacgagaagctggagctggccatgctgagcttcttcgagcagttcagaaagatctacatcggcgaccaggtgcagaagagcagcaagctgtacagaagactgagcgaggtgctgggcctgaacgacgagaccatggtgctgagcgtgttcatcggcaagatcatcaccaacctgaagtactggggcagatgcgagcccatcaccagcaagaccctgcagctgctgaacgacctgagcatcggctacagcagcgtgagaaagctggtgaagctgagcgccgtgcagttcatgctgaacaaccacaccagcgagcacttcagcttcctgggcatcaacaaccagagcaacctgaccgacatgagatgcagaaccaccttctacaccgccctgggcagactgctgatggtggacctgggcgaggacgaggaccagtacgagcagttcatgctgcccctgaccgccgccttcgaggccgtggcccagatgttcagcaccaacagcttcaacgagcaggaggccaagagaaccctggtgggcctggtgagagacctgagaggcatcgccttcgccttcaacgccaagaccagcttcatgatgctgttcgagtggatctaccccagctacatgcccatcctgcagagagccatcgagctgtggtaccacgaccccgcctgcaccacccccgtgctgaagctgatggccgagctggtgcacaacagaagccagagactgcagttcgacgtgagcagccccaacggcatcctgctgttcagagagaccagcaagatgatcaccatgtacggcaacagaatcctgaccctgggcgaggtgcccaaggaccaggtgtacgccctgaagctgaagggcatcagcatctgcttcagcatgctgaaggccgccctgagcggcagctacgtgaacttcggcgtgttcagactgtacggcgacgacgccctggacaacgccctgcagaccttcatcaagctgctgctgagcatcccccacagcgacctgctggactaccccaagctgagccagagctactacagcctgctggaggtgctgacccaggaccacatgaacttcatcgccagcctggagccccacgtgatcatgtacatcctgagcagcatcagcgagggcctgaccgccctggacaccatggtgtgcaccggctgctgcagctgcctggaccacatcgtgacctacctgttcaagcagctgagcagaagcaccaagaagagaaccacccccctgaaccaggagagcgacagattcctgcacatcatgcagcagcaccccgagatgatccagcagatgctgagcaccgtgctgaacatcatcatcttcgaggactgcagaaaccagtggagcatgagcagacccctgctgggcctgatcctgctgaacgagaagtacttcagcgacctgagaaacagcatcgtgaacagccagccccccgagaagcagcaggccatgcacctgtgcttcgagaacctgatggagggcatcgagagaaacctgctgaccaagaacagagacagattcacccagaacctgagcgccttcagaagagaggtgaacgacagcatgaagaacagcacctacggcgtgaacagcaacgacatgatgagctag

SEQ ID NO: 81070 - DNA, 6363 bp, Artificial Sequence
  Description of Artificial Sequence: Synthetic coding sequence
atgagaagcttcaagagagtgaacttcggcaccctgctgagcagccagaaggaggccgaggagctgctgcccgccctgaaggagttcctgagcaacccccccgccggcttccccagcagcagaagcgacgccgagagaagacaggcctgcgacgccatcctgagagcctgcaaccagcagctgaccgccaagctggcctgccccagacacctgggcagcctgctggagctggccgagctggcctgcgacggctacctggtgagcaccccccagagaccccccctgtacctggagagaatcctgttcgtgctgctgagaaacgccgccgcccagggcagccccgaggccaccctgagactggcccagcccctgcacgcctgcctggtgcagtgcagcagagaggccgccccccaggactacgaggccgtggccagaggcagcttcagcctgctgtggaagggcgccgaggccctgctggagagaagagccgccttcgccgccagactgaaggccctgagcttcctggtgctgctggaggacgagagcaccccctgcgaggtgccccacttcgccagccccaccgcctgcagagccgtggccgcccaccagctgttcgacgccagcggccacggcctgaacgaggccgacgccgacttcctggacgacctgctgagcagacacgtgatcagagccctggtgggcgagagaggcagcagcagcggcctgctgagcccccagagagccctgtgcctgctggagctgaccctggagcactgcagaagattctgctggagcagacaccacgacaaggccatcagcgccgtggagaaggcccacagctacctgagaaacaccaacctggcccccagcctgcagctgtgccagctgggcgtgaagctgctgcaggtgggcgaggagggcccccaggccgtggccaagctgctgatcaaggccagcgccgtgctgagcaagagcatggaggcccccagcccccccctgagagccctgtacgagagctgccagttcttcctgagcggcctggagagaggcaccaagagaagatacagactggacgccatcctgagcctgttcgccttcctgggcggctactgcagcctgctgcagcagctgagagacgacggcgtgtacggcggcagcagcaagcagcagcagagcttcctgcagatgtacttccagggcctgcacctgtacaccgtggtggtgtacgacttcgcccagggctgccagatcgtggacctggccgacctgacccagctggtggacagctgcaagagcaccgtggtgtggatgctggaggccctggagggcctgagcggccaggagctgaccgaccacatgggcatgaccgccagctacaccagcaacctggcctacagcttctacagccacaagctgtacgccgaggcctgcgccatcagcgagcccctgtgccagcacctgggcctggtgaagcccggcacctaccccgaggtgccccccgagaagctgcacagatgcttcagactgcaggtggagagcctgaagaagctgggcaagcaggcccagggctgcaagatggtgatcctgtggctggccgccctgcagccctgcagccccgagcacatggccgagcccgtgaccttctgggtgagagtgaagatggacgccgccagagccggcgacaaggagctgcagctgaagaccctgagagacagcctgagcggctgggaccccgagaccctggccctgctgctgagagaggagctgcaggcctacaaggccgtgagagccgacaccggccaggagagattcaacatcatctgcgacctgctggagctgagccccgaggagacccccgccggcgcctgggccagagccacccacctggtggagctggcccaggtgctgtgctaccacgacttcacccagcagaccaactgcagcgccctggacgccatcagagaggccctgcagctgctggacagcgtgagacccgaggcccaggccagagaccagctgctggacgacaaggcccaggccctgctgtggctgtacatctgcaccctggaggccaagatgcaggagggcatcgagagagacagaagagcccaggcccccggcaacctggaggagttcgaggtgaacgacctgaactacgaggacaagctgcaggaggacagattcctgtacagcaacatcgccttcaacctggccgccgacgccgcccagagcaagtgcctggaccaggccctggccctgtggaaggagctgctgaccaagggccaggcccccgccgtgagatgcctgcagcagaccgccgccagcctgcagatcctggccgccctgtaccagctggtggccaagcccatgcaggccctggaggtgctgctgctgctgagaatcgtgagcgagagactgaaggaccacagcaaggccgccggcagcagctgccacatcacccagctgctgctgaccctgggctgccccagctacgcccagctgcacctggaggaggccgccagcagcctgaagcacctggaccagaccaccgacacctacctgctgctgagcctgacctgcgacctgctgagaagccagctgtactggacccaccagaaggtgaccaagggcgtgagcctgctgctgagcgtgctgagagaccccgccctgcagaagagcagcaaggcctggtacctgctgagagtgcaggtgctgcagctggtggccgcctacctgagcctgcccagcaacaacctgagccacagcctgtgggagcagctgtgcgcccagggctggcagacccccgagatcgccctgatcgacagccacaagctgctgagaagcatcatcctgctgctgatgggcagcgacatcctgagcacccagaaggccgccgtggagaccagcttcctggactacggcgagaacctggtgcagaagtggcaggtgctgagcgaggtgctgagctgcagcgagaagctggtgtgccacctgggcagactgggcagcgtgagcgaggccaaggccttctgcctggaggccctgaagctgaccaccaagctgcagatccccagacagtgcgccctgttcctggtgctgaagggcgagctggagctggccagaaacgacatcgacctgtgccagagcgacctgcagcaggtgctgttcctgctggagagctgcaccgagttcggcggcgtgacccagcacctggacagcgtgaagaaggtgcacctgcagaagggcaagcagcaggcccaggtgccctgccccccccagctgcccgaggaggagctgttcctgagaggccccgccctggagctggtggccaccgtggccaaggagcccggccccatcgcccccagcaccaacagcagccccgtgctgaagaccaagccccagcccatccccaacttcctgagccacagccccacctgcgactgcagcctgtgcgccagccccgtgctgaccgccgtgtgcctgagatgggtgctggtgaccgccggcgtgagactggccatgggccaccaggcccagggcctggacctgctgcaggtggtgctgaagggctgccccgaggccgccgagagactgacccaggccctgcaggccagcctgaaccacaagaccccccccagcctggtgcccagcctgctggacgagatcctggcccaggcctacaccctgctggccctggagggcctgaaccagcccagcaacgagagcctgcagaaggtgctgcagagcggcctgaagttcgtggccgccagaatcccccacctggagccctggagagccagcctgctgctgatctgggccctgaccaagctgggcggcctgagctgctgcaccacccagctgttcgccagcagctggggctggcagccccccctgatcaagagcgtgcccggcagcgagcccagcaagacccagggccagaagagaagcggcagaggcagacagaagctggccagcgcccccctgagactgaacaacaccagccagaagggcctggagggcagaggcctgccctgcacccccaagccccccgacagaatcagacaggccggcccccacgtgcccttcaccgtgttcgaggaggtgtgccccaccgagagcaagcccgaggtgccccaggcccccagagtgcagcagagagtgcagaccagactgaaggtgaacttcagcgacgacagcgacctggaggaccccgtgagcgccgaggcctggctggccgaggagcccaagagaagaggcaccgccagcagaggcagaggcagagccagaaagggcctgagcctgaagaccgacgccgtggtggcccccggcagcgcccccggcaaccccggcctgaacggcagaagcagaagagccaagaaggtggccagcagacactgcgaggagagaagaccccagagagccagcgaccaggccagacccggccccgagatcatgagaaccatccccgaggaggagctgaccgacaactggagaaagatgagcttcgagatcctgagaggcagcgacggcgaggacagcgccagcggcggcaagacccccgcccccggccccgaggccgccagcggcgagtgggagctgctgagactggacagcagcaagaagaagctgcccagcccctgccccgacaaggagagcgacaaggacctgggccccagactgagactgcccagcgcccccgtggccaccggcctgagcaccctggacagcatctgcgacagcctgagcgtggccttcagaggcatcagccactgcccccccagcggcctgtacgcccacctgtgcagattcctggccctgtgcctgggccacagagacccctacgccaccgccttcctggtgaccgagagcgtgagcatcacctgcagacaccagctgctgacccacctgcacagacagctgagcaaggcccagaagcacagaggcagcctggagatcgccgaccagctgcagggcctgagcctgcaggagatgcccggcgacgtgcccctggccagaatccagagactgttcagcttcagagccctggagagcggccacttcccccagcccgagaaggagagcttccaggagagactggccctgatccccagcggcgtgaccgtgtgcgtgctggccctggccaccctgcagcccggcaccgtgggcaacaccctgctgctgaccagactggagaaggacagcccccccgtgagcgtgcagatccccaccggccagaacaagctgcacctgagaagcgtgctgaacgagttcgacgccatccagaaggcccagaaggagaacagcagctgcaccgacaagagagagtggtggaccggcagactggccctggaccacagaatggaggtgctgatcgccagcctggagaagagcgtgctgggctgctggaagggcctgctgctgcccagcagcgaggagcccggccccgcccaggaggccagcagactgcaggagctgctgcaggactgcggctggaagtaccccgacagaaccctgctgaagatcatgctgagcggcgccggcgccctgaccccccaggacatccaggccctggcctacggcctgtgccccacccagcccgagagagcccaggagctgctgaacgaggccgtgggcagactgcagggcctgaccgtgcccagcaacagccacctggtgctggtgctggacaaggacctgcagaagctgccctgggagagcatgcccagcctgcaggccctgcccgtgaccagactgcccagcttcagattcctgctgagctacagcatcatcaaggagtacggcgccagccccgtgctgagccagggcgtggaccccagaagcaccttctacgtgctgaacccccacaacaacctgagcagcaccgaggagcagttcagagccaacttcagcagcgaggccggctggagaggcgtggtgggcgaggtgcccagacccgagcaggtgcaggaggccctgaccaagcacgacctgtacatctacgccggccacggcgccggcgccagattcctggacggccaggccgtgctgagactgagctgcagagccgtggccctgctgttcggctgcagcagcgccgccctggccgtgagaggcaacctggagggcgccggcatcgtgctgaagtacatcatggccggctgccccctgttcctgggcaacctgtgggacgtgaccgacagagacatcgacagatacaccgaggccctgctgcagggctggctgggcgccggccccggcgcccccctgctgtactacgtgaaccaggccagacaggcccccagactgaagtacctgatcggcgccgcccccatcgcctacggcctgcccgtgagcctgagatag

SEQ ID NO: 81071 - DNA, 6363 bp, Artificial Sequence; identical to SEQ ID NO: 81070
  Description of Artificial Sequence: Synthetic coding sequence

SEQ ID NO: 81072 - DNA, 5388 bp, Artificial Sequence
  Description of Artificial Sequence: Synthetic coding sequence
atggaggcccccagcccccccctgagagccctgtacgagagctgccagttcttcctgagcggcctggagagaggcaccaagagaagatacagactggacgccatcctgagcctgttcgccttcctgggcggctactgcagcctgctgcagcagctgagagacgacggcgtgtacggcggcagcagcaagcagcagcagagcttcctgcagatgtacttccagggcctgcacctgtacaccgtggtggtgtacgacttcgcccagggctgccagatcgtggacctggccgacctgacccagctggtggacagctgcaagagcaccgtggtgtggatgctggaggccctggagggcctgagcggccaggagctgaccgaccacatgggcatgaccgccagctacaccagcaacctggcctacagcttctacagccacaagctgtacgccgaggcctgcgccatcagcgagcccctgtgccagcacctgggcctggtgaagcccggcacctaccccgaggtgccccccgagaagctgcacagatgcttcagactgcaggtggagagcctgaagaagctgggcaagcaggcccagggctgcaagatggtgatcctgtggctggccgccctgcagccctgcagccccgagcacatggccgagcccgtgaccttctgggtgagagtgaagatggacgccgccagagccggcgacaaggagctgcagctgaagaccctgagagacagcctgagcggctgggaccccgagaccctggccctgctgctgagagaggagctgcaggcctacaaggccgtgagagccgacaccggccaggagagattcaacatcatctgcgacctgctggagctgagccccgaggagacccccgccggcgcctgggccagagccacccacctggtggagctggcccaggtgctgtgctaccacgacttcacccagcagaccaactgcagcgccctggacgccatcagagaggccctgcagctgctggacagcgtgagacccgaggcccaggccagagaccagctgctggacgacaaggcccaggccctgctgtggctgtacatctgcaccctggaggccaagatgcaggagggcatcgagagagacagaagagcccaggcccccggcaacctggaggagttcgaggtgaacgacctgaactacgaggacaagctgcaggaggacagattcctgtacagcaacatcgccttcaacctggccgccgacgccgcccagagcaagtgcctggaccaggccctggccctgtggaaggagctgctgaccaagggccaggcccccgccgtgagatgcctgcagcagaccgccgccagcctgcagatcctggccgccctgtaccagctggtggccaagcccatgcaggccctggaggtgctgctgctgctgagaatcgtgagcgagagactgaaggaccacagcaaggccgccggcagcagctgccacatcacccagctgctgctgaccctgggctgccccagctacgcccagctgcacctggaggaggccgccagcagcctgaagcacctggaccagaccaccgacacctacctgctgctgagcctgacctgcgacctgctgagaagccagctgtactggacccaccagaaggtgaccaagggcgtgagcctgctgctgagcgtgctgagagaccccgccctgcagaagagcagcaaggcctggtacctgctgagagtgcaggtgctgcagctggtggccgcctacctgagcctgcccagcaacaacctgagccacagcctgtgggagcagctgtgcgcccagggctggcagacccccgagatcgccctgatcgacagccacaagctgctgagaagcatcatcctgctgctgatgggcagcgacatcctgagcacccagaaggccgccgtggagaccagcttcctggactacggcgagaacctggtgcagaagtggcaggtgctgagcgaggtgctgagctgcagcgagaagctggtgtgccacctgggcagactgggcagcgtgagcgaggccaaggccttctgcctggaggccctgaagctgaccaccaagctgcagatccccagacagtgcgccctgttcctggtgctgaagggcgagctggagctggccagaaacgacatcgacctgtgccagagcgacctgcagcaggtgctgttcctgctggagagctgcaccgagttcggcggcgtgacccagcacctggacagcgtgaagaaggtgcacctgcagaagggcaagcagcaggcccaggtgccctgccccccccagctgcccgaggaggagctgttcctgagaggccccgccctggagctggtggccaccgtggccaaggagcccggccccatcgcccccagcaccaacagcagccccgtgctgaagaccaagccccagcccatccccaacttcctgagccacagccccacctgcgactgcagcctgtgcgccagccccgtgctgaccgccgtgtgcctgagatgggtgctggtgaccgccggcgtgagactggccatgggccaccaggcccagggcctggacctgctgcaggtggtgctgaagggctgccccgaggccgccgagagactgacccaggccctgcaggccagcctgaaccacaagaccccccccagcctggtgcccagcctgctggacgagatcctggcccaggcctacaccctgctggccctggagggcctgaaccagcccagcaacgagagcctgcagaaggtgctgcagagcggcctgaagttcgtggccgccagaatcccccacctggagccctggagagccagcctgctgctgatctgggccctgaccaagctgggcggcctgagctgctgcaccacccagctgttcgccagcagctggggctggcagccccccctgatcaagagcgtgcccggcagcgagcccagcaagacccagggccagaagagaagcggcagaggcagacagaagctggccagcgcccccctgagactgaacaacaccagccagaagggcctggagggcagaggcctgccctgcacccccaagccccccgacagaatcagacaggccggcccccacgtgcccttcaccgtgttcgaggaggtgtgccccaccgagagcaagcccgaggtgccccaggcccccagagtgcagcagagagtgcagaccagactgaaggtgaacttcagcgacgacagcgacctggaggaccccgtgagcgccgaggcctggctggccgaggagcccaagagaagaggcaccgccagcagaggcagaggcagagccagaaagggcctgagcctgaagaccgacgccgtggtggcccccggcagcgcccccggcaaccccggcctgaacggcagaagcagaagagccaagaaggtggccagcagacactgcgaggagagaagaccccagagagccagcgaccaggccagacccggccccgagatcatgagaaccatccccgaggaggagctgaccgacaactggagaaagatgagcttcgagatcctgagaggcagcgacggcgaggacagcgccagcggcggcaagacccccgcccccggccccgaggccgccagcggcgagtgggagctgctgagactggacagcagcaagaagaagctgcccagcccctgccccgacaaggagagcgacaaggacctgggccccagactgagactgcccagcgcccccgtggccaccggcctgagcaccctggacagcatctgcgacagcctgagcgtggccttcagaggcatcagccactgcccccccagcggcctgtacgcccacctgtgcagattcctggccctgtgcctgggccacagagacccctacgccaccgccttcctggtgaccgagagcgtgagcatcacctgcagacaccagctgctgacccacctgcacagacagctgagcaaggcccagaagcacagaggcagcctggagatcgccgaccagctgcagggcctgagcctgcaggagatgcccggcgacgtgcccctggccagaatccagagactgttcagcttcagagccctggagagcggccacttcccccagcccgagaaggagagcttccaggagagactggccctgatccccagcggcgtgaccgtgtgcgtgctggccctggccaccctgcagcccggcaccgtgggcaacaccctgctgctgaccagactggagaaggacagcccccccgtgagcgtgcagatccccaccggccagaacaagctgcacctgagaagcgtgctgaacgagttcgacgccatccagaaggcccagaaggagaacagcagctgcaccgacaagagagagtggtggaccggcagactggccctggaccacagaatggaggtgctgatcgccagcctggagaagagcgtgctgggctgctggaagggcctgctgctgcccagcagcgaggagcccggccccgcccaggaggccagcagactgcaggagctgctgcaggactgcggctggaagtaccccgacagaaccctgctgaagatcatgctgagcggcgccggcgccctgaccccccaggacatccaggccctggcctacggcctgtgccccacccagcccgagagagcccaggagctgctgaacgaggccgtgggcagactgcagggcctgaccgtgcccagcaacagccacctggtgctggtgctggacaaggacctgcagaagctgccctgggagagcatgcccagcctgcaggccctgcccgtgaccagactgcccagcttcagattcctgctgagctacagcatcatcaaggagtacggcgccagccccgtgctgagccagggcgtggaccccagaagcaccttctacgtgctgaacccccacaacaacctgagcagcaccgaggagcagttcagagccaacttcagcagcgaggccggctggagaggcgtggtgggcgaggtgcccagacccgagcaggtgcaggaggccctgaccaagcacgacctgtacatctacgccggccacggcgccggcgccagattcctggacggccaggccgtgctgagactgagctgcagagccgtggccctgctgttcggctgcagcagcgccgccctggccgtgagaggcaacctggagggcgccggcatcgtgctgaagtacatcatggccggctgccccctgttcctgggcaacctgtgggacgtgaccgacagagacatcgacagatacaccgaggccctgctgcagggctggctgggcgccggccccggcgcccccctgctgtactacgtgaaccaggccagacaggcccccagactgaagtacctgatcggcgccgcccccatcgcctacggcctgcccgtgagcctgagatag

SEQ ID NO: 81073 - DNA, 1248 bp, Artificial Sequence
  Description of Artificial Sequence: Synthetic coding sequence
atgggcaccaccgccagagccgccctggtgctgacctacctggccgtggccagcgccgccagcgagggcggcttcaccgccaccggccagagacagctgagacccgagcacttccaggaggtgggctacgccgccccccccagcccccccctgagcagaagcctgcccatggaccaccccgacagcagccagcacggcccccccttcgagggccagagccaggtgcagcccccccccagccaggaggccacccccctgcagcaggagaagctgctgcccgcccagctgcccgccgagaaggaggtgggcccccccctgccccaggaggccgtgcccctgcagaaggagctgcccagcctgcagcaccccaacgagcagaaggagggcacccccgcccccttcggcgaccagagccaccccgagcccgagagctggaacgccgcccagcactgccagcaggacagaagccagggcggctggggccacagactggacggcttcccccccggcagacccagccccgacaacctgaaccagatctgcctgcccaacagacagcacgtggtgtacggcccctggaacctgccccagagcagctacagccacctgaccagacagggcgagaccctgaacttcctggagatcggctacagcagatgctgccactgcagaagccacaccaacagactggagtgcgccaagctggtgtgggaggacaccctggacaagtactgcgacagagagtacgccgtgaagacccaccaccacctgtgctgcagacacccccccagccccaccagagacgagtgcttcgccagaagagccccctaccccaactacgacagagacatcctgaccatcgacatcggcagagtgacccccaacctgatgggccacctgtgcggcaaccagagagtgctgaccaagcacaagcacatccccggcctgatccacaacatgaccgccagatgctgcgacctgcccttccccgagcaggcctgctgcgccgaggaggagaagctgaccttcatcaacgacctgtgcggccccagaagaaacatctggagagaccccgccctgtgctgctacctgagccccggcgacgagcaggtgaactgcttcaacatcaactacctgagaaacgtggccctggtgagcggcgacaccgagaacgccaagggccagggcgagcagggcagcaccggcggcaccaacatcagcagcaccagcgagcccaaggaggagtag

SEQ ID NO: 81074 - DNA, 1623 bp, Artificial Sequence
  Description of Artificial Sequence: Synthetic coding sequence
atgggcaccaccgccagagccgccctggtgctgacctacctggccgtggccagcgccgccagcgagggcggcttcaccgccaccggccagagacagctgagacccgagcacttccaggaggtgggctacgccgccccccccagcccccccctgagcagaagcctgcccatggaccaccccgacagcagccagcacggcccccccttcgagggccagagccaggtgcagcccccccccagccaggaggccacccccctgcagcaggagaagctgctgcccgcccagctgcccgccgagaaggaggtgggcccccccctgccccaggaggccgtgcccctgcagaaggagctgcccagcctgcagcaccccaacgagcagaaggagggcacccccgcccccttcggcgaccagagccaccccgagcccgagagctggaacgccgcccagcactgccagcaggacagaagccagggcggctggggccacagactggacggcttcccccccggcagacccagccccgacaacctgaaccagatctgcctgcccaacagacagcacgtggtgtacggcccctggaacctgccccagagcagctacagccacctgaccagacagggcgagaccctgaacttcctggagatcggctacagcagatgctgccactgcagaagccacaccaacagactggagtgcgccaagctggtgtgggaggaggccatgagcagattctgcgaggccgagttcagcgtgaagaccagaccccactggtgctgcaccagacagggcgaggccagattcagctgcttccaggaggaggccccccagccccactaccagctgagagcctgccccagccaccagcccgacatcagcagcggcctggagctgcccttcccccccggcgtgcccaccctggacaacatcaagaacatctgccacctgagaagattcagaagcgtgcccagaaacctgcccgccaccgaccccctgcagagagagctgctggccctgatccagctggagagagagttccagagatgctgcagacagggcaacaaccacacctgcacctggaaggcctgggaggacaccctggacaagtactgcgacagagagtacgccgtgaagacccaccaccacctgtgctgcagacacccccccagccccaccagagacgagtgcttcgccagaagagccccctaccccaactacgacagagacatcctgaccatcgacatcggcagagtgacccccaacctgatgggccacctgtgcggcaaccagagagtgctgaccaagcacaagcacatccccggcctgatccacaacatgaccgccagatgctgcgacctgcccttccccgagcaggcctgctgcgccgaggaggagaagctgaccttcatcaacgacctgtgcggccccagaagaaacatctggagagaccccgccctgtgctgctacctgagccccggcgacgagcaggtgaactgcttcaacatcaactacctgagaaacgtggccctggtgagcggcgacaccgagaacgccaagggccagggcgagcagggcagcaccggcggcaccaacatcagcagcaccagcgagcccaaggaggagtag

SEQ ID NO: 81075 - DNA, 1704 bp, Artificial Sequence
  Description of Artificial Sequence: Synthetic coding sequence
atgggcaccaccgccagagccgccctggtgctgacctacctggccgtggccagcgccgccagcgagggcggcttcaccgccaccggccagagacagctgagacccgagcacttccaggaggtgggctacgccgccccccccagcccccccctgagcagaagcctgcccatggaccaccccgacagcagccagcacggcccccccttcgagggccagagcggcaaggagggcagaggccccagaccccacagccagccctggctgggcgagagagtgggctgcagccacatcccccccagcatcgtgcagcccccccccagccaggaggccacccccctgcagcaggagaagctgctgcccgcccagctgcccgccgagaaggaggtgggcccccccctgccccaggaggccgtgcccctgcagaaggagctgcccagcctgcagcaccccaacgagcagaaggagggcacccccgcccccttcggcgaccagagccaccccgagcccgagagctggaacgccgcccagcactgccagcaggacagaagccagggcggctggggccacagactggacggcttcccccccggcagacccagccccgacaacctgaaccagatctgcctgcccaacagacagcacgtggtgtacggcccctggaacctgccccagagcagctacagccacctgaccagacagggcgagaccctgaacttcctggagatcggctacagcagatgctgccactgcagaagccacaccaacagactggagtgcgccaagctggtgtgggaggaggccatgagcagattctgcgaggccgagttcagcgtgaagaccagaccccactggtgctgcaccagacagggcgaggccagattcagctgcttccaggaggaggccccccagccccactaccagctgagagcctgccccagccaccagcccgacatcagcagcggcctggagctgcccttcccccccggcgtgcccaccctggacaacatcaagaacatctgccacctgagaagattcagaagcgtgcccagaaacctgcccgccaccgaccccctgcagagagagctgctggccctgatccagctggagagagagttccagagatgctgcagacagggcaacaaccacacctgcacctggaaggcctgggaggacaccctggacaagtactgcgacagagagtacgccgtgaagacccaccaccacctgtgctgcagacacccccccagccccaccagagacgagtgcttcgccagaagagccccctaccccaactacgacagagacatcctgaccatcgacatcggcagagtgacccccaacctgatgggccacctgtgcggcaaccagagagtgctgaccaagcacaagcacatccccggcctgatccacaacatgaccgccagatgctgcgacctgcccttccccgagcaggcctgctgcgccgaggaggagaagctgaccttcatcaacgacctgtgcggccccagaagaaacatctggagagaccccgccctgtgctgctacctgagccccggcgacgagcaggtgaactgcttcaacatcaactacctgagaaacgtggccctggtgagcggcgacaccgagaacgccaagggccagggcgagcagggcagcaccggcggcaccaacatcagcagcaccagcgagcccaaggaggagtag

SEQ ID NO: 81076 - DNA, 2100 bp, Artificial Sequence
  Description of Artificial Sequence: Synthetic coding sequence
atgaagatcgccgtgctgttctgcttcttcctgctgatcatcttccagaccgacttcggcaagaacgaggagatccccagaaagcagagaagaaagatctaccacagaagactgagaaagagcagcaccagccacaagcacagaagcaacagacagctgggcatccagcagaccaccgtgttcacccccgtggccagactgcccatcgtgaacttcgactacagcatggaggagaagttcgagagcttcagcagcttccccggcgtggagagcagctacaacgtgctgcccggcaagaagggccactgcctggtgaagggcatcaccatgtacaacaaggccgtgtggagccccgagccctgcaccacctgcctgtgcagcgacggcagagtgctgtgcgacgagaccatgtgccacccccagagatgcccccagaccgtgatccccgagggcgagtgctgccccgtgtgcagcgccaccgtgagctacagcctgctgagcggcatcgccctgaacgacagaaacgagttcagcggcgacagcagcgagcagagagagcccaccaacctgctgcacaagcagctgccccccccccaggtgggcatggacagaatcgtgagaaaggaggccctgcagagcgaggaggacgaggaggtgaaggaggaggacaccgagcagaagagagagacccccgagagcagaaaccagggccagctgtacagcgagggcgacagcagaggcggcgacagaaagcagagacccggcgaggagagaagactggcccaccagcagcagagacagggcagagaggaggaggaggacgaggaggaggagggcgaggagggcgaggaggacgaggaggacgaggaggaccccgtgagaggcgacatgttcagaatgcccagcagaagccccctgcccgccccccccagaggcaccctgagactgcccagcggctgcagcctgagctacagaaccatcagctgcatcaacgccatgctgacccagatcccccccctgaccgccccccagatcaccagcctggagctgaccggcaacagcatcgccagcatccccgacgaggccttcaacggcctgcccaacctggagagactggacctgagcaagaacaacatcaccagcagcggcatcggccccaaggccttcaagctgctgaagaagctgatgagactgaacatggacggcaacaacctgatccagatccccagccagctgcccagcaccctggaggagctgaaggtgaacgagaacaacctgcaggccatcgacgaggagagcctgagcgacctgaaccagctggtgaccctggagctggagggcaacaacctgagcgaggccaacgtgaaccccctggccttcaagcccctgaagagcctggcctacctgagactgggcaagaacaagttcagaatcatcccccagggcctgcccggcagcatcgaggagctgtacctggagaacaaccagatcgaggagatcaccgagatctgcttcaaccacaccagaaagatcaacgtgatcgtgctgagatacaacaagatcgaggagaacagaatcgcccccctggcctggatcaaccaggagaacctggagagcatcgacctgagctacaacaagctgtaccacgtgcccagctacctgcccaagagcctgctgcacctggtgctgctgggcaaccagatcgagagaatccccggctacgtgttcggccacatggagcccggcctggagtacctgtacctgagcttcaacaagctggccgacgacggcatggacagagtgagcttctacggcgcctaccacagcctgagagagctgttcctggaccacaacgacctgaagagcatcccccccggcatccaggagatgaaggccctgcacttcctgagactgaacaacaacaagatcagaaacatcctgcccgaggagatctgcaacgccgaggaggacgacgacagcaacctggagcacctgcacctggagaacaactacatcaagatcagagagatccccagctacaccttcagctgcatcagaagctacagcagcatcgtgctgaagccccagaacatcaagtag

SEQ ID NO: 81077 - DNA, 495 bp, Artificial Sequence
  Description of Artificial Sequence: Synthetic coding sequence
atgaagatcgccgtgctgttctgcttcttcctgctgatcatcttccagaccgacttcggcaagaacgaggagatccccagaaagcagagaagaaagatctaccacagaagactgagaaagagcagcaccagccacaagcacagaagcaacagacagctgggcatccagcagaccaccgtgttcacccccgtggccagactgcccatcgtgaacttcgactacagcatggaggagaagttcgagagcttcagcagcttccccggcgtggagagcagctacaacgtgctgcccggcaagaagggccactgcctggtgaagggcatcaccatgtacaacaaggccgtgtggagccccgagccctgcaccacctgcctgtgcagcgacggcagagtgctgtgcgacgagaccatgtgccacccccagagatgcccccagaccgtgatccccgagggcgagtgctgccccgtgtgcagcgccaccggcaccgagatctag

SEQ ID NO: 81078 - DNA, 483 bp, Artificial Sequence
  Description of Artificial Sequence: Synthetic coding sequence
atgaagatcgccgtgctgttctgcttcttcctgctgatcatcttccagaccgacttcggcaagaacgaggagatccccagaaagcagagaagaaagatctaccacagaagactgagaaagagcagcaccagccacaagcacagaagcaacagacagctgggcatccagcagaccaccgtgttcacccccgtggccagactgcccatcgtgaacttcgactacagcatggaggagaagttcgagagcttcagcagcttccccggcgtggagagcagctacaacgtgctgcccggcaagaagggccactgcctggtgaagggcatcaccatgtacaacaaggccgtgtggagccccgagccctgcaccacctgcctgtgcagcgacggcagagtgctgtgcgacgagaccatgtgccacccccagagatgcccccagaccgtgatccccgagggcgagtgctgccccgtgtgcagcgccacctag

SEQ ID NO: 81079 - DNA, 1932 bp, Artificial Sequence
  Description of Artificial Sequence: Synthetic coding sequence
atgaagatcgccgtgctgttctgcttcttcctgctgatcatcttccagaccgacttcggcaagaacgaggagatccccagaaagcagagaagaaagatctaccacagaagactgagaaagagcagcaccagccacaagcacagaagcaacagacagctgggcatccagcagaccaccgtgttcacccccgtggccagactgcccatcgtgaacttcgactacagcatggaggagaagttcgagagcttcagcagcttccccggcgtggagagcagctacaacgtgctgcccggcaagaagggccactgcctggtgaagggcatcaccatgtacaacaaggccgtgtggagccccgagccctgcaccacctgcctgtgcagcgacggcagagtgctgtgcgacgagaccatgtgccacccccagagatgcccccagaccgtgatccccgagggcgagtgctgccccgtgtgcagcgccaccgagcagagagagcccaccaacctgctgcacaagcagctgccccccccccaggtgggcatggacagaatcgtgagaaaggaggccctgcagagcgaggaggacgaggaggtgaaggaggaggacaccgagcagaagagagagacccccgagagcagaaaccagggccagctgtacagcgagggcgacagcagaggcggcgacagaaagcagagacccggcgaggagagaagactggcccaccagcagcagagacagggcagagaggaggaggaggacgaggaggaggagggcgaggagggcgaggaggacgaggaggacgaggaggaccccgtgagaggcgacatgttcagaatgcccagcagaagccccctgcccgccccccccagaggcaccctgagactgcccagcggctgcagcctgagctacagaaccatcagctgcatcaacgccatgctgacccagatcccccccctgaccgccccccagatcaccagcctggagctgaccggcaacagcatcgccagcatccccgacgaggccttcaacggcctgcccaacctggagagactggacctgagcaagaacaacatcaccagcagcggcatcggccccaaggccttcaagctgctgaagaagctgatgagactgaacatggacggcaacaacctgatccagatccccagccagctgcccagcaccctggaggagctgaaggtgaacgagaacaacctgcaggccatcgacgaggagagcctgagcgacctgaaccagctggtgaccctggagctggagggcaacaacctgagcgaggccaacgtgaaccccctggccttcaagcccctgaagagcctggcctacctgagactgggcaagaacaagttcagaatcatcccccagggcctgcccggcagcatcgaggagctgtacctggagaacaaccagatcgaggagatcaccgagatctgcttcaaccacaccagaaagatcaacgtgatcgtgctgagatacaacaagatcgaggagaacagaatcgcccccctggcctggatcaaccaggagaacctggagagcatcgacctgagctacaacaagctgtaccacgtgcccagctacctgcccaagagcctgctgcacctggtgctgctgggcaaccagatcgagagaatccccggctacgtgttcggccacatggagcccggcctggagtacctgtacctgagcttcaacaagctggccgacgacggcatggacagagtgagcttctacggcgcctaccacagcctgagagagctgttcctggaccacaacgacctgaagagcatcccccccggcatccaggagatgaaggccctgcacttcctgagactgaacaacaacaagatcagatgcgtgagcgacgccgtgctggagaccgtgaccaacagaagcgacgtggccttccccctgtggtag

SEQ ID NO: 81080 - DNA, 1779 bp, Artificial Sequence
  Description of Artificial Sequence: Synthetic coding sequence
atggagatgcaggacctgaccagcccccacagcagactgagcggcagcagcgagagccccagcggccccaagctgggcaacagccacatcaacagcaacagcatgacccccaacggcaccgaggtgaagaccgagcccatgagcagcagcgagaccgccagcaccaccgccgacggcagcctgaacaacttcagcggcagcgccatcggcagcagcagcttcagccccagacccacccaccagttcagccccccccagatctaccccagcaacagaccctacccccacatcctgcccacccccagcagccagaccatggccgcctacggccagacccagttcaccaccggcatgcagcaggccaccgcctacgccacctacccccagcccggccagccctacggcatcagcagctacggcgccctgtgggccggcatcaagaccgagggcggcctgagccagagccagagccccggccagaccggcttcctgagctacggcaccagcttcagcaccccccagcccggccaggccccctacagctaccagatgcagggcagcagcttcaccaccagcagcggcatctacaccggcaacaacagcctgaccaacagcagcggcttcaacagcagccagcaggactaccccagctaccccagcttcggccagggccagtacgcccagtactacaacagcagcccctaccccgcccactacatgaccagcagcaacaccagccccaccacccccagcaccaacgccacctaccagctgcaggagccccccagcggcatcaccagccaggccgtgaccgaccccaccgccgagtacagcaccatccacagccccagcacccccatcaaggacagcgacagcgacagactgagaagaggcagcgacggcaagagcagaggcagaggcagaagaaacaacaaccccagccccccccccgacagcgacctggagagagtgttcatctgggacctggacgagaccatcatcgtgttccacagcctgctgaccggcagctacgccaacagatacggcagagacccccccaccagcgtgagcctgggcctgagaatggaggagatgatcttcaacctggccgacacccacctgttcttcaacgacctggaggagtgcgaccaggtgcacatcgacgacgtgagcagcgacgacaacggccaggacctgagcacctacaacttcggcaccgacggcttccccgccgccgccaccagcgccaacctgtgcctggccaccggcgtgagaggcggcgtggactggatgagaaagctggccttcagatacagaagagtgaaggagatctacaacacctacaagaacaacgtgggcggcctgctgggccccgccaagagagaggcctggctgcagctgagagccgagatcgaggccctgaccgacagctggctgaccctggccctgaaggccctgagcctgatccacagcagaaccaactgcgtgaacatcctggtgaccaccacccagctgatccccgccctggccaaggtgctgctgtacggcctgggcatcgtgttccccatcgagaacatctacagcgccaccaagatcggcaaggagagctgcttcgagagaatcatccagagattcggcagaaaggtggtgtacgtggtgatcggcgacggcgtggaggaggagcagggcgccaagaagcacgccatgcccttctggagaatcagcagccacagcgacctgatggccctgcaccacgccctggagctggagtacctgtag

SEQ ID NO: 81081 - DNA, 1680 bp, Artificial Sequence
  Description of Artificial Sequence: Synthetic coding sequence
atgctgctgttcccccaggtggccgtgaagaccgagcccatgagcagcagcgagaccgccagcaccaccgccgacggcagcctgaacaacttcagcggcagcgccatcggcagcagcagcttcagccccagacccacccaccagttcagccccccccagatctaccccagcaacagaccctacccccacatcctgcccacccccagcagccagaccatggccgcctacggccagacccagttcaccaccggcatgcagcaggccaccgcctacgccacctacccccagcccggccagccctacggcatcagcagctacggcgccctgtgggccggcatcaagaccgagggcggcctgagccagagccagagccccggccagaccggcttcctgagctacggcaccagcttcagcaccccccagcccggccaggccccctacagctaccagatgcagggcagcagcttcaccaccagcagcggcatctacaccggcaacaacagcctgaccaacagcagcggcttcaacagcagccagcaggactaccccagctaccccagcttcggccagggccagtacgcccagtactacaacagcagcccctaccccgcccactacatgaccagcagcaacaccagccccaccacccccagcaccaacgccacctaccagctgcaggagccccccagcggcatcaccagccaggccgtgaccgaccccaccgccgagtacagcaccatccacagccccagcacccccatcaaggacagcgacagcgacagactgagaagaggcagcgacggcaagagcagaggcagaggcagaagaaacaacaaccccagccccccccccgacagcgacctggagagagtgttcatctgggacctggacgagaccatcatcgtgttccacagcctgctgaccggcagctacgccaacagatacggcagagacccccccaccagcgtgagcctgggcctgagaatggaggagatgatcttcaacctggccgacacccacctgttcttcaacgacctggaggagtgcgaccaggtgcacatcgacgacgtgagcagcgacgacaacggccaggacctgagcacctacaacttcggcaccgacggcttccccgccgccgccaccagcgccaacctgtgcctggccaccggcgtgagaggcggcgtggactggatgagaaagctggccttcagatacagaagagtgaaggagatctacaacacctacaagaacaacgtgggcggcctgctgggccccgccaagagagaggcctggctgcagctgagagccgagatcgaggccctgaccgacagctggctgaccctggccctgaaggccctgagcctgatccacagcagaaccaactgcgtgaacatcctggtgaccaccacccagctgatccccgccctggccaaggtgctgctgtacggcctgggcatcgtgttccccatcgagaacatctacagcgccaccaagatcggcaaggagagctgcttcgagagaatcatccagagattcggcagaaaggtggtgtacgtggtgatcggcgacggcgtggaggaggagcagggcgccaagaagcacgccatgcccttctggagaatcagcagccacagcgacctgatggccctgcaccacgccctggagctggagtacctgtag

SEQ ID NO: 81082 - DNA, 1779 bp, Artificial Sequence; identical to SEQ ID NO: 81080
  Description of Artificial Sequence: Synthetic coding sequence

SEQ ID NO: 81083 - DNA, 1683 bp, Artificial Sequence
  Description of Artificial Sequence: Synthetic coding sequence
atgctgatgatctacgtgcagctggtggtgaagaccgagcccatgagcagcagcgagaccgccagcaccaccgccgacggcagcctgaacaacttcagcggcagcgccatcggcagcagcagcttcagccccagacccacccaccagttcagccccccccagatctaccccagcaacagaccctacccccacatcctgcccacccccagcagccagaccatggccgcctacggccagacccagttcaccaccggcatgcagcaggccaccgcctacgccacctacccccagcccggccagccctacggcatcagcagctacggcgccctgtgggccggcatcaagaccgagggcggcctgagccagagccagagccccggccagaccggcttcctgagctacggcaccagcttcagcaccccccagcccggccaggccccctacagctaccagatgcagggcagcagcttcaccaccagcagcggcatctacaccggcaacaacagcctgaccaacagcagcggcttcaacagcagccagcaggactaccccagctaccccagcttcggccagggccagtacgcccagtactacaacagcagcccctaccccgcccactacatgaccagcagcaacaccagccccaccacccccagcaccaacgccacctaccagctgcaggagccccccagcggcatcaccagccaggccgtgaccgaccccaccgccgagtacagcaccatccacagccccagcacccccatcaaggacagcgacagcgacagactgagaagaggcagcgacggcaagagcagaggcagaggcagaagaaacaacaaccccagccccccccccgacagcgacctggagagagtgttcatctgggacctggacgagaccatcatcgtgttccacagcctgctgaccggcagctacgccaacagatacggcagagacccccccaccagcgtgagcctgggcctgagaatggaggagatgatcttcaacctggccgacacccacctgttcttcaacgacctggaggagtgcgaccaggtgcacatcgacgacgtgagcagcgacgacaacggccaggacctgagcacctacaacttcggcaccgacggcttccccgccgccgccaccagcgccaacctgtgcctggccaccggcgtgagaggcggcgtggactggatgagaaagctggccttcagatacagaagagtgaaggagatctacaacacctacaagaacaacgtgggcggcctgctgggccccgccaagagagaggcctggctgcagctgagagccgagatcgaggccctgaccgacagctggctgaccctggccctgaaggccctgagcctgatccacagcagaaccaactgcgtgaacatcctggtgaccaccacccagctgatccccgccctggccaaggtgctgctgtacggcctgggcatcgtgttccccatcgagaacatctacagcgccaccaagatcggcaaggagagctgcttcgagagaatcatccagagattcggcagaaaggtggtgtacgtggtgatcggcgacggcgtggaggaggagcagggcgccaagaagcacgccatgcccttctggagaatcagcagccacagcgacctgatggccctgcaccacgccctggagctggagtacctgtag

SEQ ID NO: 81084 - DNA, 1674 bp, Artificial Sequence
  Description of Artificial Sequence: Synthetic coding sequence
atggagatgcaggacctgaccagcccccacagcagactgagcggcagcagcgagagccccagcggccccaagctgggcaacagccacatcaacagcaacagcatgacccccaacggcaccgaggtgaagaccgagcccatgagcagcagcgagaccgccagcaccaccgccgacggcagcctgaacaacttcagcggcagcgccatcggcagcagcagcttcagccccagacccacccaccagttcagccccccccagatctaccccagcaacagaccctacccccacatcctgcccacccccagcagccagaccatggccgcctacggccagacccagttcaccaccggcatgcagcaggccaccgcctacgccacctacccccagcccggccagccctacggcatcagcagctacggcatcaagaccgagggcggcctgagccagagccagagccccggccagaccggcttcctgagctacggcaccagcttcagcaccccccagcccggccaggccccctacagctaccagatgcagggcagcagcttcaccaccagcagcggcatctacaccggcaacaacagcctgaccaacagcagcggcttcaacagcagccagcaggactaccccagctaccccagcttcggccagggccagtacgcccagtactacaacagcagcccctaccccgcccactacatgaccagcagcaacaccagccccaccacccccagcaccaacgccacctaccagctgcaggagccccccagcggcatcaccagccaggccgtgaccgaccccaccgccgagtacagcaccatccacagccccagcacccccatcaaggacagcgacagcgacagactgagaagaggcagcgacggcaagagcagaggcagaggcagaagaaacaacaaccccagccccccccccgacagcgacctggagagagtgttcatctgggacctggacgagaccatcatcgtgttccacagcctgctgaccggcagctacgccaacagatacggcagagagtgcgaccaggtgcacatcgacgacgtgagcagcgacgacaacggccaggacctgagcacctacaacttcggcaccgacggcttccccgccgccgccaccagcgccaacctgtgcctggccaccggcgtgagaggcggcgtggactggatgagaaagctggccttcagatacagaagagtgaaggagatctacaacacctacaagaacaacgtgggcggcctgctgggccccgccaagagagaggcctggctgcagctgagagccgagatcgaggccctgaccgacagctggctgaccctggccctgaaggccctgagcctgatccacagcagaaccaactgcgtgaacatcctggtgaccaccacccagctgatccccgccctggccaaggtgctgctgtacggcctgggcatcgtgttccccatcgagaacatctacagcgccaccaagatcggcaaggagagctgcttcgagagaatcatccagagattcggcagaaaggtggtgtacgtggtgatcggcgacggcgtggaggaggagcagggcgccaagaagcacgccatgcccttctggagaatcagcagccacagcgacctgatggccctgcaccacgccctggagctggagtacctgtag

SEQ ID NO: 81085 - DNA, 1527 bp, Artificial Sequence
  Description of Artificial Sequence: Synthetic coding sequence
atggtggagctggtgatcagccccagcctgaccgtgaacagcgactgcctggacaagctgaagttcaacagagccgacgccgccgtgtggaccctgagcgacagacagggcatcaccaagagcgcccccctgagagtgagccagctgttcagcagaagctgccccagagtgctgcccagacagcccagcaccgccatggccgcctacggccagacccagtacagcgccggcatccagcaggccaccccctacaccgcctaccccccccccgcccaggcctacggcatccccagctacagcatcaagaccgaggacagcctgaaccacagccccggccagagcggcttcctgagctacggcagcagcttcagcaccagccccaccggccagagcccctacacctaccagatgcacggcaccaccggcttctaccagggcggcaacggcctgggcaacgccgccggcttcggcagcgtgcaccaggactaccccagctaccccggcttcccccagagccagtacccccagtactacggcagcagctacaaccccccctacgtgcccgccagcagcatctgccccagccccctgagcaccagcacctacgtgctgcaggaggccagccacaacgtgcccaaccagagcagcgagagcctggccggcgagtacaacacccacaacggccccagcacccccgccaaggagggcgacaccgacagaccccacagagccagcgacggcaagctgagaggcagaagcaagagaagcagcgaccccagccccgccggcgacaacgagatcgagagagtgttcgtgtgggacctggacgagaccatcatcatcttccacagcctgctgaccggcaccttcgccagcagatacggcaaggactgcgaccagatccacgtggacgacgtgagcagcgacgacaacggccaggacctgagcacctacaacttcagcgccgacggcttccacagcagcgcccccggcgccaacctgtgcctgggcagcggcgtgcacggcggcgtggactggatgagaaagctggccttcagatacagaagagtgaaggagatgtacaacacctacaagaacaacgtgggcggcctgatcggcacccccaagagagagacctggctgcagctgagagccgagctggaggccctgaccgacctgtggctgacccacagcctgaaggccctgaacctgatcaacagcagacccaactgcgtgaacgtgctggtgaccaccacccagctgatccccgccctggccaaggtgctgctgtacggcctgggcagcgtgttccccatcgagaacatctacagcgccaccaagaccggcaaggagagctgcttcgagagaatcatgcagagattcggcagaaaggccgtgtacgtggtgatcggcgacggcgtggaggaggagcagggcgccaagaagcacaacatgcccttctggagaatcagctgccacgccgacctggaggccctgagacacgccctggagctggagtacctgtag

SEQ ID NO: 81086 - DNA, 1617 bp, Artificial Sequence
  Description of Artificial Sequence: Synthetic coding sequence
atggtggagctggtgatcagccccagcctgaccgtgaacagcgactgcctggacaagctgaagttcaacagagccgacgccgccgtgtggaccctgagcgacagacagggcatcaccaagagcgcccccctgagagtgagccagctgttcagcagaagctgccccagagtgctgcccagacagcccagcaccgccatggccgcctacggccagacccagtacagcgccggcatccagcaggccaccccctacaccgcctaccccccccccgcccaggcctacggcatccccagctacagcatcaagaccgaggacagcctgaaccacagccccggccagagcggcttcctgagctacggcagcagcttcagcaccagccccaccggccagagcccctacacctaccagatgcacggcaccaccggcttctaccagggcggcaacggcctgggcaacgccgccggcttcggcagcgtgcaccaggactaccccagctaccccggcttcccccagagccagtacccccagtactacggcagcagctacaaccccccctacgtgcccgccagcagcatctgccccagccccctgagcaccagcacctacgtgctgcaggaggccagccacaacgtgcccaaccagagcagcgagagcctggccggcgagtacaacacccacaacggccccagcacccccgccaaggagggcgacaccgacagaccccacagagccagcgacggcaagctgagaggcagaagcaagagaagcagcgaccccagccccgccggcgacaacgagatcgagagagtgttcgtgtgggacctggacgagaccatcatcatcttccacagcctgctgaccggcaccttcgccagcagatacggcaaggacaccaccaccagcgtgagaatcggcctgatgatggaggagatgatcttcaacctggccgacacccacctgttcttcaacgacctggaggactgcgaccagatccacgtggacgacgtgagcagcgacgacaacggccaggacctgagcacctacaacttcagcgccgacggcttccacagcagcgcccccggcgccaacctgtgcctgggcagcggcgtgcacggcggcgtggactggatgagaaagctggccttcagatacagaagagtgaaggagatgtacaacacctacaagaacaacgtgggcggcctgatcggcacccccaagagagagacctggctgcagctgagagccgagctggaggccctgaccgacctgtggctgacccacagcctgaaggccctgaacctgatcaacagcagacccaactgcgtgaacgtgctggtgaccaccacccagctgatccccgccctggccaaggtgctgctgtacggcctgggcagcgtgttccccatcgagaacatctacagcgccaccaagaccggcaaggagagctgcttcgagagaatcatgcagagattcggcagaaaggccgtgtacgtggtgatcggcgacggcgtggaggaggagcagggcgccaagaagcacaacatgcccttctggagaatcagctgccacgccgacctggaggccctgagacacgccctggagctggagtacctgtag

SEQ ID NO: 81087 - DNA, 1380 bp, Artificial Sequence
  Description of Artificial Sequence: Synthetic coding sequence
atggtggagctggtgatcagccccagcctgaccgtgaacagcgactgcctggacaagctgaagttcaacagagccgacgccgccgtgtggaccctgagcgacagacagggcatcaccaagagcgcccccctgagagtgagccagctgttcagcagaagctgccccagagtgctgcccagacagcccagcaccgccatggccgcctacggccagacccagtacagcgccggcatccagcaggccaccccctacaccgcctaccccccccccgcccaggcctacggcatccccagctacagcatcaagaccgaggacagcctgaaccacagccccggccagagcggcttcctgagctacggcagcagcttcagcaccagccccaccggccagagcccctacacctaccagatgcacggcaccaccggcttctaccagggcggcaacggcctgggcaacgccgccggcttcggcagcgtgcaccaggactaccccagctaccccggcttcccccagagccagtacccccagtactacggcagcagctacaaccccccctacgtgcccgccagcagcatctgccccagccccctgagcaccagcacctacgtgctgcaggaggccagccacaacgtgcccaaccagagcagcgagagcctggccggcgagtacaacacccacaacggccccagcacccccgccaaggagggcgacaccgacagaccccacagagccagcgacggcaagctgagaggcagaagcaagagaagcagcgaccccagccccgccggcgacaacgagatcgagagagtgttcgtgtgggacctggacgagaccatcatcatcttccacagcctgctgaccggcaccttcgccagcagatacggcaaggacaccaccaccagcgtgagaatcggcctgatgatggaggagatgatcttcaacctggccgacacccacctgttcttcaacgacctggaggactgcgaccagatccacgtggacgacgtgagcagcgacgacaacggccaggacctgagcacctacaacttcagcgccgacggcttccacagcagcgcccccggcgccaacctgtgcctgggcagcggcgtgcacggcggcgtggactggatgagaaagctggccttcagatacagaagagtgaaggagatgtacaacacctacaagaacaacgtgggcggcaaggagagctgcttcgagagaatcatgcagagattcggcagaaaggccgtgtacgtggtgatcggcgacggcgtggaggaggagcagggcgccaagaagcacaacatgcccttctggagaatcagctgccacgccgacctggaggccctgagacacgccctggagctggagtacctgtag

SEQ ID NO: 81088 - DNA, 1527 bp, Artificial Sequence
  Description of Artificial Sequence: Synthetic coding sequence
atggtggagctggtgatcagccccagcctgaccgtgaacagcgactgcctggacaagctgaagttcaacagagccgacgccgccgtgtggaccctgagcgacagacagggcatcaccaagagcgcccccctgagagtgagccagctgttcagcagaagctgccccagagtgctgcccagacagcccagcaccgccatggccgcctacggccagacccagtacagcgccggcatccagcaggccaccccctacaccgcctaccccccccccgcccaggcctacggcatccccagctacagcatcaagaccgaggacagcctgaaccacagccccggccagagcggcttcctgagctacggcagcagcttcagcaccagccccaccggccagagcccctacacctaccagatgcacggcaccaccggcttctaccagggcggcaacggcctgggcaacgccgccggcttcggcagcgtgcaccaggactaccccagctaccccggcttcccccagagccagtacccccagtactacggcagcagctacaaccccccctacgtgcccgccagcagcatctgccccagccccctgagcaccagcacctacgtgctgcaggaggccagccacaacgtgcccaaccagagcagcgagagcctggccggcgagtacaacacccacaacggccccagcacccccgccaaggagggcgacaccgacagaccccacagagccagcgacggcaagctgagaggcagaagcaagagaagcagcgaccccagccccgccggcgacaacgagatcgagagagtgttcgtgtgggacctggacgagaccatcatcatcttccacagcctgctgaccggcaccttcgccagcagatacggcaaggactgcgaccagatccacgtggacgacgtgagcagcgacgacaacggccaggacctgagcacctacaacttcagcgccgacggcttccacagcagcgcccccggcgccaacctgtgcctgggcagcggcgtgcacggcggcgtggactggatgagaaagctggccttcagatacagaagagtgaaggagatgtacaacacctacaagaacaacgtgggcggcctgatcggcacccccaagagagagacctggctgcagctgagagccgagctggaggccctgaccgacctgtggctgacccacagcctgaaggccctgaacctgatcaacagcagacagaactgcgtgaacgtgctggtgaccaccacccagctgatccccgccctggccaaggtgctgctgtacggcctgggcagcgtgttccccatcgagaacatctacagcgccaccaagaccggcaaggagagctgcttcgagagaatcatgcagagattcggcagaaaggccgtgtacgtggtgatcggcgacggcgtggaggaggagcagggcgccaagaagcacaacatgcccttctggagaatcagctgccacgccgacctggaggccctgagacacgccctggagctggagtacctgtag

SEQ ID NO: 81089 - DNA, 1611 bp, Artificial Sequence
  Description of Artificial Sequence: Synthetic coding sequence
atggaggaggagcaggacctgcccgagcagcccgtgaagaaggccaagatgcaggagagcggcgagcagaccatcagccaggtgagcaaccccgacgtgagcgaccagaagcccgagaccagcagcctggccagcaacctgcccatgagcgaggagatcatgacctgcaccgactacatccccagaagcagcaacgactacaccagccagatgtacagcgccaagccctacgcccacatcctgagcgtgcccgtgagcgagaccgcctaccccggccagacccagtaccagaccctgcagcagacccagccctacgccgtgtacccccaggccacccagacctacggcctgccccccttcgccagcagcaccaacgccagcctgatcagcaccagcagcaccatcgccaacatccccgccgccgccgtggccagcatcagcaaccaggactaccccacctacaccatcctgggccagaaccagtaccaggcctgctaccccagcagcagcttcggcgtgaccggccagaccaacagcgacgccgagagcaccaccctggccgccaccacctaccagagcgagaagcccagcgtgatggcccccgcccccgccgcccagagactgagcagcggcgaccccagcaccagccccagcctgagccagaccacccccagcaaggacaccgacgaccagagcagaaagaacatgaccagcaagaacagaggcaagagaaaggccgacgccaccagcagccaggacagcgagctggagagagtgttcctgtgggacctggacgagaccatcatcatcttccacagcctgctgaccggcagctacgcccagaagtacggcaaggaccccaccgtggtgatcggcagcggcctgaccatggaggagatgatcttcgaggtggccgacacccacctgttcttcaacgacctggaggagtgcgaccaggtgcacgtggaggacgtggccagcgacgacaacggccaggacctgagcaactacagcttcagcaccgacggcttcagcggcagcggcggcagcggcagccacggcagcagcgtgggcgtgcagggcggcgtggactggatgagaaagctggccttcagatacagaaaggtgagagagatctacgacaagcacaagagcaacgtgggcggcctgctgagcccccagagaaaggaggccctgcagagactgagagccgagatcgaggtgctgaccgacagctggctgggcaccgccctgaagagcctgctgctgatccagagcagaaagaactgcgtgaacgtgctgatcaccaccacccagctggtgcccgccctggccaaggtgctgctgtacggcctgggcgagatcttccccatcgagaacatctacagcgccaccaagatcggcaaggagagctgcttcgagagaatcgtgagcagattcggcaagaaggtgacctacgtggtgatcggcgacggcagagacgaggagatcgccgccaagcagcagctgtacttcctggacatggaggccctgggctgccagctggagcccaccgccctgatcctgttcatccagctgagcggcaacctgagcaactacaacaagctgtag

SEQ ID NO: 81090 - DNA, 1251 bp, Artificial Sequence
  Description of Artificial Sequence: Synthetic coding sequence
atgatcatcccccacaagtgcatcctgcagaccagcagcaccaacgccagcctgatcagcaccagcagcaccatcgccaacatccccgccgccgccgtggccagcatcagcaaccaggactaccccacctacaccatcctgggccagaaccagtaccaggcctgctaccccagcagcagcttcggcgtgaccggccagaccaacagcgacgccgagagcaccaccctggccgccaccacctaccagagcgagaagcccagcgtgatggcccccgcccccgccgcccagagactgagcagcgaccccagcaccagccccagcctgagccagaccacccccagcaaggacaccgacgaccagagcagaaagaacatgaccagcaagaacagaggcaagagaaaggccgacgccaccagcagccaggacagcgagctggagagagtgttcctgtgggacctggacgagaccatcatcatcttccacagcctgctgaccggcagctacgcccagaagtacggcaaggaccccaccgtggtgatcggcagcggcctgaccatggaggagatgatcttcgaggtggccgacacccacctgttcttcaacgacctggaggagtgcgaccaggtgcacgtggaggacgtggccagcgacgacaacggccaggacctgagcaactacagcttcagcaccgacggcttcagcggcagcggcggcagcggcagccacggcagcagcgtgggcgtgcagggcggcgtggactggatgagaaagctggccttcagatacagaaaggtgagagagatctacgacaagcacaagagcaacgtgggcggcctgctgagcccccagagaaaggaggccctgcagagactgagagccgagatcgaggtgctgaccgacagctggctgggcaccgccctgaagagcctgctgctgatccagagcagaaagaactgcgtgaacgtgctgatcaccaccacccagctggtgcccgccctggccaaggtgctgctgtacggcctgggcgagatcttccccatcgagaacatctacagcgccaccaagatcggcaaggagagctgcttcgagagaatcgtgagcagattcggcaagaaggtgacctacgtggtgatcggcgacggcagagacgaggagatcgccgccaagcagcacaacatgcccttctggagaatcaccaaccacggcgacctggtgagcctgcaccaggccctggagctggacttcctgtag

SEQ ID NO: 81091 - DNA, 1722 bp, Artificial Sequence
  Description of Artificial Sequence: Synthetic coding sequence
atggaggaggagcaggacctgcccgagcagcccgtgaagaaggccaagatgcaggagagcggcgagcagaccatcagccaggtgagcaaccccgacgtgagcgaccagaagcccgagaccagcagcctggccagcaacctgcccatgagcgaggagatcatgacctgcaccgactacatccccagaagcagcaacgactacaccagccagatgtacagcgccaagccctacgcccacatcctgagcgtgcccgtgagcgagaccgcctaccccggccagacccagtaccagaccctgcagcagacccagccctacgccgtgtacccccaggccacccagacctacggcctgccccccttcggcgccctgtggcccggcatgaagcccgagagcggcctgatccagacccccagccccagccagcacagcgtgctgacctgcaccaccggcctgaccaccagccagcccagccccgcccactacagctaccccatccaggccagcagcaccaacgccagcctgatcagcaccagcagcaccatcgccaacatccccgccgccgccgtggccagcatcagcaaccaggactaccccacctacaccatcctgggccagaaccagtaccaggcctgctaccccagcagcagcttcggcgtgaccggccagaccaacagcgacgccgagagcaccaccctggccgccaccacctaccagagcgagaagcccagcgtgatggcccccgcccccgccgcccagagactgagcagcggcgaccccagcaccagccccagcctgagccagaccacccccagcaaggacaccgacgaccagagcagaaagaacatgaccagcaagaacagaggcaagagaaaggccgacgccaccagcagccaggacagcgagctggagagagtgttcctgtgggacctggacgagaccatcatcatcttccacagcctgctgaccggcagctacgcccagaagtacggcaaggaccccaccgtggtgatcggcagcggcctgaccatggaggagatgatcttcgaggtggccgacacccacctgttcttcaacgacctggaggagtgcgaccaggtgcacgtggaggacgtggccagcgacgacaacggccaggacctgagcaactacagcttcagcaccgacggcttcagcggcagcggcggcagcggcagccacggcagcagcgtgggcgtgcagggcggcgtggactggatgagaaagctggccttcagatacagaaaggtgagagagatctacgacaagcacaagagcaacgtgggcggcctgctgagcccccagagaaaggaggccctgcagagactgagagccgagatcgaggtgctgaccgacagctggctgggcaccgccctgaagagcctgctgctgatccagagcagaaagaactgcgtgaacgtgctgatcaccaccacccagctggtgcccgccctggccaaggtgctgctgtacggcctgggcgagatcttccccatcgagaacatctacagcgccaccaagatcggcaaggagagctgcttcgagagaatcgtgagcagattcggcaagaaggtgacctacgtggtgatcggcgacggcagagacgaggagatcgccgccaagcagcacaacatgcccttctggagaatcaccaaccacggcgacctggtgagcctgcaccaggccctggagctggacttcctgtag

SEQ ID NO: 81092 - DNA, 1344 bp, Artificial Sequence
  Description of Artificial Sequence: Synthetic coding sequence
atgaagcccgagagcggcctgatccagacccccagccccagccagcacagcgtgctgacctgcaccaccggcctgaccaccagccagcccagccccgcccactacagctaccccatccaggccagcagcaccaacgccagcctgatcagcaccagcagcaccatcgccaacatccccgccgccgccgtggccagcatcagcaaccaggactaccccacctacaccatcctgggccagaaccagtaccaggcctgctaccccagcagcagcttcggcgtgaccggccagaccaacagcgacgccgagagcaccaccctggccgccaccacctaccagagcgagaagcccagcgtgatggcccccgcccccgccgcccagagactgagcagcggcgaccccagcaccagccccagcctgagccagaccacccccagcaaggacaccgacgaccagagcagaaagaacatgaccagcaagaacagaggcaagagaaaggccgacgccaccagcagccaggacagcgagctggagagagtgttcctgtgggacctggacgagaccatcatcatcttccacagcctgctgaccggcagctacgcccagaagtacggcaaggaccccaccgtggtgatcggcagcggcctgaccatggaggagatgatcttcgaggtggccgacacccacctgttcttcaacgacctggaggagtgcgaccaggtgcacgtggaggacgtggccagcgacgacaacggccaggacctgagcaactacagcttcagcaccgacggcttcagcggcagcggcggcagcggcagccacggcagcagcgtgggcgtgcagggcggcgtggactggatgagaaagctggccttcagatacagaaaggtgagagagatctacgacaagcacaagagcaacgtgggcggcctgctgagcccccagagaaaggaggccctgcagagactgagagccgagatcgaggtgctgaccgacagctggctgggcaccgccctgaagagcctgctgctgatccagagcagaaagaactgcgtgaacgtgctgatcaccaccacccagctggtgcccgccctggccaaggtgctgctgtacggcctgggcgagatcttccccatcgagaacatctacagcgccaccaagatcggcaaggagagctgcttcgagagaatcgtgagcagattcggcaagaaggtgacctacgtggtgatcggcgacggcagagacgaggagatcgccgccaagcagcacaacatgcccttctggagaatcaccaaccacggcgacctggtgagcctgcaccaggccctggagctggacttcctgtag

SEQ ID NO: 81093 - DNA, 1584 bp, Artificial Sequence
  Description of Artificial Sequence: Synthetic coding sequence
atggaggaggagcaggacctgcccgagcagcccgtgaagaaggccaagatgcaggagagcggcgagcagaccatcagccaggtgagcaaccccgacgtgagcgaccagaagcccgagaccagcagcctggccagcaacctgcccatgagcgaggagatcatgacctgcaccgactacatccccagaagcagcaacgactacaccagccagatgtacagcgccaagccctacgcccacatcctgagcgtgcccgtgagcgagaccgcctaccccggccagacccagtaccagaccctgcagcagacccagccctacgccgtgtacccccaggccacccagacctacggcctgccccccttcgccagcagcaccaacgccagcctgatcagcaccagcagcaccatcgccaacatccccgccgccgccgtggccagcatcagcaaccaggactaccccacctacaccatcctgggccagaaccagtaccaggcctgctaccccagcagcagcttcggcgtgaccggccagaccaacagcgacgccgagagcaccaccctggccgccaccacctaccagagcgagaagcccagcgtgatggcccccgcccccgccgcccagagactgagcagcggcgaccccagcaccagccccagcctgagccagaccacccccagcaaggacaccgacgaccagagcagaaagaacatgaccagcaagaacagaggcaagagaaaggccgacgccaccagcagccaggacagcgagctggagagagtgttcctgtgggacctggacgagaccatcatcatcttccacagcctgctgaccggcagctacgcccagaagtacggcaaggaccccaccgtggtgatcggcagcggcctgaccatggaggagatgatcttcgaggtggccgacacccacctgttcttcaacgacctggaggagtgcgaccaggtgcacgtggaggacgtggccagcgacgacaacggccaggacctgagcaactacagcttcagcaccgacggcttcagcggcagcggcggcagcggcagccacggcagcagcgtgggcgtgcagggcggcgtggactggatgagaaagctggccttcagatacagaaaggtgagagagatctacgacaagcacaagagcaacgtgggcggcctgctgagcccccagagaaaggaggccctgcagagactgagagccgagatcgaggtgctgaccgacagctggctgggcaccgccctgaagagcctgctgctgatccagagcagaaagaactgcgtgaacgtgctgatcaccaccacccagctggtgcccgccctggccaaggtgctgctgtacggcctgggcgagatcttccccatcgagaacatctacagcgccaccaagatcggcaaggagagctgcttcgagagaatcgtgagcagattcggcaagaaggtgacctacgtggtgatcggcgacggcagagacgaggagatcgccgccaagcagcacaacatgcccttctggagaatcaccaaccacggcgacctggtgagcctgcaccaggccctggagctggacttcctgtag

SEQ ID NO: 81094 - DNA, 1563 bp, Artificial Sequence
  Description of Artificial Sequence: Synthetic coding sequence
atgacctgcaccgactacatccccagaagcagcaacgactacaccagccagatgtacagcgccaagccctacgcccacatcctgagcgtgcccgtgagcgagaccgcctaccccggccagacccagtaccagaccctgcagcagacccagccctacgccgtgtacccccaggccacccagacctacggcctgccccccttcggcgccctgtggcccggcatgaagcccgagagcggcctgatccagacccccagccccagccagcacagcgtgctgacctgcaccaccggcctgaccaccagccagcccagccccgcccactacagctaccccatccaggccagcagcaccaacgccagcctgatcagcaccagcagcaccatcgccaacatccccgccgccgccgtggccagcatcagcaaccaggactaccccacctacaccatcctgggccagaaccagtaccaggcctgctaccccagcagcagcttcggcgtgaccggccagaccaacagcgacgccgagagcaccaccctggccgccaccacctaccagagcgagaagcccagcgtgatggcccccgcccccgccgcccagagactgagcagcggcgaccccagcaccagccccagcctgagccagaccacccccagcaaggacaccgacgaccagagcagaaagaacatgaccagcaagaacagaggcaagagaaaggccgacgccaccagcagccaggacagcgagctggagagagtgttcctgtgggacctggacgagaccatcatcatcttccacagcctgctgaccggcagctacgcccagaagtacggcaaggaccccaccgtggtgatcggcagcggcctgaccatggaggagatgatcttcgaggtggccgacacccacctgttcttcaacgacctggaggagtgcgaccaggtgcacgtggaggacgtggccagcgacgacaacggccaggacctgagcaactacagcttcagcaccgacggcttcagcggcagcggcggcagcggcagccacggcagcagcgtgggcgtgcagggcggcgtggactggatgagaaagctggccttcagatacagaaaggtgagagagatctacgacaagcacaagagcaacgtgggcggcctgctgagcccccagagaaaggaggccctgcagagactgagagccgagatcgaggtgctgaccgacagctggctgggcaccgccctgaagagcctgctgctgatccagagcagaaagaactgcgtgaacgtgctgatcaccaccacccagctggtgcccgccctggccaaggtgctgctgtacggcctgggcgagatcttccccatcgagaacatctacagcgccaccaagatcggcaaggagagctgcttcgagagaatcgtgagcagattcggcaagaaggtgacctacgtggtgatcggcgacggcagagacgaggagatcgccgccaagcagcacaacatgcccttctggagaatcaccaaccacggcgacctggtgagcctgcaccaggccctggagctggacttcctgtag

SEQ ID NO: 81095 - DNA, 1920 bp, Artificial Sequence
  Description of Artificial Sequence: Synthetic coding sequence
atggaggacagccaggacctgaacgagcagagcgtgaagaagacctgcaccgagagcgacgtgagccagagccagaacagcagaagcatggagatgcaggacctggccagcccccacaccctggtgggcggcggcgacacccccggcagcagcaagctggagaagagcaacctgagcagcaccagcgtgaccaccaacggcaccggcggcgagaacatgaccgtgctgaacaccgccgactggctgctgagctgcaacacccccagcagcgccaccatgagcctgctggccgtgaagaccgagcccctgaacagcagcgagaccaccgccaccaccggcgacggcgccctggacaccttcaccggcagcgtgatcaccagcagcggctacagccccagaagcgcccaccagtacagcccccagctgtaccccagcaagccctacccccacatcctgagcacccccgccgcccagaccatgagcgcctacgccggccagacccagtacagcggcatgcagcagcccgccgtgtacaccgcctacagccagaccggccagccctacagcctgcccacctacgacctgggcgtgatgctgcccgccatcaagaccgagagcggcctgagccagacccagagccccctgcagagcggctgcctgagctacagccccggcttcagcaccccccagcccggccagaccccctacagctaccagatgcccggcagcagcttcgcccccagcagcaccatctacgccaacaacagcgtgagcaacagcaccaacttcagcggcagccagcaggactaccccagctacaccgccttcggccagaaccagtacgcccagtactacagcgccagcacctacggcgcctacatgaccagcaacaacaccgccgacggcacccccagcagcaccagcacctaccagctgcaggagagcctgcccggcctgaccaaccagcccggcgagttcgacaccatgcagagccccagcacccccatcaaggacctggacgagagaacctgcagaagcagcggcagcaagagcagaggcagaggcagaaagaacaaccccagccccccccccgacagcgacctggagagagtgttcgtgtgggacctggacgagaccatcatcgtgttccacagcctgctgaccggcagctacgcccagaagtacggcaaggacccccccatggccgtgaccctgggcctgagaatggaggagatgatcttcaacctggccgacacccacctgttcttcaacgacctggaggagtgcgaccaggtgcacatcgacgacgtgagcagcgacgacaacggccaggacctgagcacctacagcttcgccaccgacggcttccacgccgccgccagcagcgccaacctgtgcctgcccaccggcgtgagaggcggcgtggactggatgagaaagctggccttcagatacagaagagtgaaggagctgtacaacacctacaagaacaacgtgggcggcctgctgggccccgccaagagagacgcctggctgcagctgagagccgagatcgagggcctgaccgacagctggctgaccaacgccctgaagagcctgagcatcatcagcaccagaagcaactgcatcaacgtgctggtgaccaccacccagctgatccccgccctggccaaggtgctgctgtacagcctgggcggcgccttccccatcgagaacatctacagcgccaccaagatcggcaaggagagctgcttcgagagaatcgtgagcagattcggcaccaacatcacctacgtggtgatcggcgacggcagagacgaggagcacgccgccaaccagcacaacatgcccttctggagaatcagcagccacagcgacctgctggccctgcaccaggccctggagctggagtacctgtag

SEQ ID NO: 81096 - DNA, 1851 bp, Artificial Sequence
  Description of Artificial Sequence: Synthetic coding sequence
atggaggacagccaggacctgaacgagcagagcgtgaagaagacctgcaccgagagcgacgtgagccagagccagaacagcagaagcatggagatgcaggacctggccagcccccacaccctggtgggcggcggcgacacccccggcagcagcaagctggagaagagcaacctgagcagcaccagcgtgaccaccaacggcaccggcgtgagcctgctggccgtgaagaccgagcccctgaacagcagcgagaccaccgccaccaccggcgacggcgccctggacaccttcaccggcagcgtgatcaccagcagcggctacagccccagaagcgcccaccagtacagcccccagctgtaccccagcaagccctacccccacatcctgagcacccccgccgcccagaccatgagcgcctacgccggccagacccagtacagcggcatgcagcagcccgccgtgtacaccgcctacagccagaccggccagccctacagcctgcccacctacgacctgggcgtgatgctgcccgccatcaagaccgagagcggcctgagccagacccagagccccctgcagagcggctgcctgagctacagccccggcttcagcaccccccagcccggccagaccccctacagctaccagatgcccggcagcagcttcgcccccagcagcaccatctacgccaacaacagcgtgagcaacagcaccaacttcagcggcagccagcaggactaccccagctacaccgccttcggccagaaccagtacgcccagtactacagcgccagcacctacggcgcctacatgaccagcaacaacaccgccgacggcacccccagcagcaccagcacctaccagctgcaggagagcctgcccggcctgaccaaccagcccggcgagttcgacaccatgcagagccccagcacccccatcaaggacctggacgagagaacctgcagaagcagcggcagcaagagcagaggcagaggcagaaagaacaaccccagccccccccccgacagcgacctggagagagtgttcgtgtgggacctggacgagaccatcatcgtgttccacagcctgctgaccggcagctacgcccagaagtacggcaaggacccccccatggccgtgaccctgggcctgagaatggaggagatgatcttcaacctggccgacacccacctgttcttcaacgacctggaggagtgcgaccaggtgcacatcgacgacgtgagcagcgacgacaacggccaggacctgagcacctacagcttcgccaccgacggcttccacgccgccgccagcagcgccaacctgtgcctgcccaccggcgtgagaggcggcgtggactggatgagaaagctggccttcagatacagaagagtgaaggagctgtacaacacctacaagaacaacgtgggcggcctgctgggccccgccaagagagacgcctggctgcagctgagagccgagatcgagggcctgaccgacagctggctgaccaacgccctgaagagcctgagcatcatcagcaccagaagcaactgcatcaacgtgctggtgaccaccacccagctgatccccgccctggccaaggtgctgctgtacagcctgggcggcgccttccccatcgagaacatctacagcgccaccaagatcggcaaggagagctgcttcgagagaatcatgcagagattcggcagaaaggtggtgtacgtggtgatcggcgacggcgtggaggaggagcaggccgccaagaagcacaacatgcccttctggagaatcagcagccacagcgacctgctggccctgcaccaggccctggagctggagtacctgtag

SEQ ID NO: 81097 - DNA, 1920 bp, Artificial Sequence
  Description of Artificial Sequence: Synthetic coding sequence
atggaggacagccaggacctgaacgagcagagcgtgaagaagacctgcaccgagagcgacgtgagccagagccagaacagcagaagcatggagatgcaggacctggccagcccccacaccctggtgggcggcggcgacacccccggcagcagcaagctggagaagagcaacctgagcagcaccagcgtgaccaccaacggcaccggcggcgagaacatgaccgtgctgaacaccgccgactggctgctgagctgcaacacccccagcagcgccaccatgagcctgctggccgtgaagaccgagcccctgaacagcagcgagaccaccgccaccaccggcgacggcgccctggacaccttcaccggcagcgtgatcaccagcagcggctacagccccagaagcgcccaccagtacagcccccagctgtaccccagcaagccctacccccacatcctgagcacccccgccgcccagaccatgagcgcctacgccggccagacccagtacagcggcatgcagcagcccgccgtgtacaccgcctacagccagaccggccagccctacagcctgcccacctacgacctgggcgtgatgctgcccgccatcaagaccgagagcggcctgagccagacccagagccccctgcagagcggctgcctgagctacagccccggcttcagcaccccccagcccggccagaccccctacagctaccagatgcccggcagcagcttcgcccccagcagcaccatctacgccaacaacagcgtgagcaacagcaccaacttcagcggcagccagcaggactaccccagctacaccgccttcggccagaaccagtacgcccagtactacagcgccagcacctacggcgcctacatgaccagcaacaacaccgccgacggcacccccagcagcaccagcacctaccagctgcaggagagcctgcccggcctgaccaaccagcccggcgagttcgacaccatgcagagccccagcacccccatcaaggacctggacgagagaacctgcagaagcagcggcagcaagagcagaggcagaggcagaaagaacaaccccagccccccccccgacagcgacctggagagagtgttcgtgtgggacctggacgagaccatcatcgtgttccacagcctgctgaccggcagctacgcccagaagtacggcaaggacccccccatggccgtgaccctgggcctgagaatggaggagatgatcttcaacctggccgacacccacctgttcttcaacgacctggaggagtgcgaccaggtgcacatcgacgacgtgagcagcgacgacaacggccaggacctgagcacctacagcttcgccaccgacggcttccacgccgccgccagcagcgccaacctgtgcctgcccaccggcgtgagaggcggcgtggactggatgagaaagctggccttcagatacagaagagtgaaggagctgtacaacacctacaagaacaacgtgggcggcctgctgggccccgccaagagagacgcctggctgcagctgagagccgagatcgagggcctgaccgacagctggctgaccaacgccctgaagagcctgagcatcatcagcaccagaagcaactgcatcaacgtgctggtgaccaccacccagctgatccccgccctggccaaggtgctgctgtacagcctgggcggcgccttccccatcgagaacatctacagcgccaccaagatcggcaaggagagctgcttcgagagaatcatgcagagattcggcagaaaggtggtgtacgtggtgatcggcgacggcgtggaggaggagcaggccgccaagaagcacaacatgcccttctggagaatcagcagccacagcgacctgctggccctgcaccaggccctggagctggagtacctgtag

SEQ ID NO: 81098 - DNA, 9498 bp, Artificial Sequence
  Description of Artificial Sequence: Synthetic coding sequence
atgaccgacaagagcatcgtgatcctgagcctgatggtgttccacagcagcttcatcaacggcaagacctgcagaagacagctggtggaggagtggcacccccagcccagcagctacgtggtgaactggaccctgaccgagaacatctgcctggacttctacagagactgctggttcctgggcgtgaacaccaagatcgacaccagcggcaaccaggccgtgccccagatctgccccctgcagatccagctgggcgacatcctggtgatcagcagcgagcccagcctgcagttccccgagatcaacctgatgaacgtgagcgagaccagcttcgtgggctgcgtgcagaacaccaccaccgaggaccagctgctgttcggctgcagactgaagggcatgcacaccgtgaacagcaagtggctgagcgtgggcacccactacttcatcaccgtgatggccagcggccccagcccctgccccctgggcctgagactgaacgtgaccgtgaagcagcagttctgccaggagagcctgagcagcgagttctgcagcggccacggcaagtgcctgagcgaggcctggagcaagacctacagctgccactgccagccccccttcagcggcaagtactgccaggagctggacgcctgcagcttcaagccctgcaagaacaacggcagctgcatcaacaagagagagaactgggacgagcaggcctacgagtgcgtgtgccacccccccttcaccggcaagaactgcagcgagatcatcggccagtgccagccccacgtgtgcttccacggcaactgcagcaacatcaccagcaacagcttcatctgcgagtgcgacgagcagttcagcggccccttctgcgaggtgagcgccaagccctgcgtgagcctgctgttctggaagagaggcatctgccccaacagcagcagcgcctacacctacgagtgccccaagggcagcagcagccagaacggcgagaccgacgtgagcgagttcagcctggtgccctgccagaacggcaccgactgcatcaagatcagcaacgacgtgatgtgcatctgcagccccatcttcaccgacctgctgtgcaagagcatccagaccagctgcgagagcttccccctgagaaacaacgccacctgcaagaagtgcgagaaggactacccctgcagctgcatcagcggcttcaccgagaagaactgcgagaaggccatcgaccactgcaagctgctgagcatcaactgcctgaacgaggagtggtgcttcaacatcatcggcagattcaagtacgtgtgcatccccggctgcaccaagaacccctgctggttcctgaagaacgtgtacctgatccaccagcacctgtgctactgcggcgtgaccttccacggcatctgccaggacaagggccccgcccagttcgagtacgtgtggcagctgggcttcgccggcagcgagggcgagaagtgccagggcgtgatcgacgcctacttcttcctggccgccaactgcaccgaggacgccacctacgtgaacgaccccgaggacaacaacagcagctgctggttcccccacgagggcaccaaggagatctgcgccaacggctgcagctgcctgagcgaggaggacagccaggagtacagatacctgtgcttcctgagatgggccggcaacatgtacctggagaacaccaccgacgaccaggagaacgagtgccagcacgaggccgtgtgcaaggacgagatcaacagacccagatgcagctgcagcctgagctacatcggcagactgtgcgtggtgaacgtggactactgcctgggcaaccacagcatcagcgtgcacggcctgtgcctggccctgagccacaactgcaactgcagcggcctgcagagatacgagagaaacatctgcgagatcgacaccgaggactgcaagagcgccagctgcaagaacggcaccaccagcacccacctgagaggctacttcttcagaaagtgcgtgcccggcttcaagggcacccagtgcgagatcgacatcgacgagtgcgccagccacccctgcaagaacggcgccacctgcatcgaccagcccggcaactacttctgccagtgcgtgccccccttcaaggtggtggacggcttcagctgcctgtgcaaccccggctacgtgggcatcagatgcgagcaggacatcgacgactgcatcctgaacgcctgcgagcacaacagcacctgcaaggacctgcacctgagctaccagtgcgtgtgcctgagcgactgggagggcaacttctgcgagcaggagagcaacgagtgcaagatgaacccctgcaagaacaacagcacctgcaccgacctgtacaagagctacagatgcgagtgcaccagcggctggaccggccagaactgcagcgaggagatcaacgagtgcgacagcgacccctgcatgaacggcggcctgtgccacgagagcaccatccccggccagttcgtgtgcctgtgcccccccctgtacaccggccagttctgccaccagagatacaacctgtgcgacctgctgcacaacccctgcagaaacaacagcacctgcctggccctggtggacgccaaccagcactgcatctgcagagaggagttcgagggcaagaactgcgagatcgacgtgaaggactgcctgttcctgagctgccaggactacggcgactgcgaggacatggtgaacaacttcagatgcatctgcagacccggcttcagcggcagcctgtgcgagatcgagatcaacgagtgcagcagcgagccctgcaagaacaacggcacctgcgtggacctgaccaacagattcttctgcaactgcgagcccgagtaccacggccccttctgcgagctggacgtgaacaagtgcaagatcagcccctgcctggacgaggagaactgcgtgtacagaaccgacggctacaactgcctgtgcgcccccggctacaccggcatcaactgcgagatcaacctggacgagtgcctgagcgagccctgcctgcacgacggcgtgtgcatcgacggcatcaaccactacacctgcgactgcaagagcggcttcttcggcacccactgcgagaccaacgccaacgactgcctgagcaacccctgcctgcacggcagatgcaccgagctgatcaacgagtacccctgcagctgcgacgccgacggcaccagcacccagtgcaagatcaagatcaacgactgcaccagcatcccctgcatgaacgagggcttctgccagaagagcgcccacggcttcacctgcatctgccccagaggctacaccggcgcctactgcgagaagagcatcgacaactgcgccgagcccgagctgaacagcgtgatctgcctgaacggcggcatctgcgtggacggccccggccacaccttcgactgcagatgcctgcccggcttcagcggccagttctgcgagatcaacatcaacgagtgcagcagcagcccctgcctgcacggcgccgactgcgaggaccacatcaacggctacgtgtgcaagtgccagcccggctggagcggccaccactgcgagaacgagctggagtgcatccccaacagctgcgtgcacgagctgtgcatggagaacgagcccggcagcacctgcctgtgcacccccggcttcatgacctgcagcatcggcctgctgtgcggcgacgagatcagaagaatcacctgcctgacccccatcttccagagaaccgaccccatcagcacccagacctacaccatcccccccagcgagaccctggtgagcagcttccccagcatcaaggccaccagaatccccgccatcatggacacctaccccgtggaccagggccccaagcagaccggcatcgtgaagcacgacatcctgcccaccaccggcctggccaccctgagaatcagcacccccctggagagctacctgctgcaggagctgatcgtgaccagagagctgagcgccaagcacagcctgctgagcagcgccgacgtgagcagcagcagattcctgaacttcggcatcagagaccccgcccagatcgtgcaggacaagaccagcgtgagccacatgcccatcagaaccagcgccgccaccctgggcttcttcttccccgacagaagagccagaacccccttcatcatgagcagcctgatgagcgacttcatcttccccacccagagcctgctgttcgagaactgccagaccgtggccctgagcgccacccccaccaccagcgtgatcagaagcatccccggcgccgacatcgagctgaacagacagagcctgctgagcagaggcttcctgctgatcgccgccagcatcagcgccacccccgtggtgagcagaggcgcccaggaggacatcgaggagtacagcgccgacagcctgatcagcagaagagagcactggagactgctgagccccagcatgagccccatcttccccgccaaggtgatcatcagcaagcaggtgaccatcctgaacagcagcgccctgcacagattcagcaccaaggccttcaaccccagcgagtaccaggccatcaccgaggccagcagcaaccagagactgaccaacatcaagagccaggccgccgacagcctgagagagctgagccagacctgcgccacctgcagcatgaccgagatcaagagcagcagagagttcagcgaccaggtgctgcacagcaagcagagccacttctacgagaccttctggatgaacagcgccatcctggccagctggtacgccctgatgggcgcccagaccatcaccagcggccacagcttcagcagcgccaccgagatcacccccagcgtggccttcaccgaggtgcccagcctgttccccagcaagaagagcgccaagagaaccatcctgagcagcagcctggaggagagcatcaccctgagcagcaacctggacgtgaacctgtgcctggacaagacctgcctgagcatcgtgcccagccagaccatcagcagcgacctgatgaacagcgacctgaccagcaagatgaccaccgacgagctgagcgtgagcgagaacatcctgaagctgctgaagatcagacagtacggcatcaccatgggccccaccgaggtgctgaaccaggagagcctgctggacatggagaagagcaagggcagccacaccctgttcaagctgcaccccagcgacagcagcctggacttcgagctgaacctgcagatctaccccgacgtgaccctgaagacctacagcgagatcacccacgccaacgacttcaagaacaacctgccccccctgaccggcagcgtgcccgacttcagcgaggtgaccaccaacgtggccttctacaccgtgagcgccacccccgccctgagcatccagaccagcagcagcatgagcgtgatcagacccgactggccctacttcaccgactacatgaccagcctgaagaaggaggtgaagaccagcagcgagtggagcaagtgggagctgcagcccagcgtgcagtaccaggagttccccaccgccagcagacacctgcccttcaccagaagcctgaccctgagcagcctggagagcatcctggccccccagagactgatgatcagcgacttcagctgcgtgagatactacggcgacagctacctggagttccagaacgtggccctgaacccccagaacaacatcagcctggagttccagaccttcagcagctacggcctgctgctgtacgtgaagcaggacagcaacctggtggacggcttcttcatccagctgttcatcgagaacggcaccctgaagtaccacttctactgccccggcgaggccaagttcaagagcatcaacaccaccgtgagagtggacaacggccagaagtacaccctgctgatcagacaggagctggacccctgcaacgccgagctgaccatcctgggcagaaacacccagatctgcgagagcatcaaccacgtgctgggcaagcccctgcccaagagcggcagcgtgttcatcggcggcttccccgacctgcacggcaagatccagatgcccgtgcccgtgaagaacttcaccggctgcatcgaggtgatcgagatcaacaactggagaagcttcatccccagcaaggccgtgaagaactaccacatcaacaactgcagaagccagggcttcatgctgagccccaccgccagcttcgtggacgccagcgacgtgacccagggcgtggacaccatgtggaccagcgtgagccccagcgtggccgcccccagcgtgtgccagcaggacgtgtgccacaacggcggcacctgccacgccatcttcctgagcagcggcatcgtgagcttccagtgcgactgccccctgcacttcaccggcagattctgcgagaaggacgccggcctgttcttccccagcttcaacggcaacagctacctggagctgcccttcctgaagttcgtgctggagaaggagcacaacagaaccgtgaccatctacctgaccatcaagaccaacagcctgaacggcaccatcctgtacagcaacggcaacaactgcggcaagcagttcctgcacctgttcctggtggagggcagacccagcgtgaagtacggctgcggcaacagccagaacatcctgaccgtgagcgccaactacagcatcaacaccaacgccttcacccccatcaccatcagatacaccacccccgtgggcagccccggcgtggtgtgcatgatcgagatgaccgccgacggcaagccccccgtgcagaagaaggacaccgagatcagccacgccagccaggcctacttcgagagcatgttcctgggccacatccccgccaacgtgcagatccacaagaaggccggccccgtgtacggcttcagaggctgcatcctggacctgcaggtgaacaacaaggagttcttcatcatcgacgaggccagacacggcaagaacatcgagaactgccacgtgccctggtgcgcccaccacctgtgcagaaacaacggcacctgcatcagcgacaacgagaacctgttctgcgagtgccccagactgtacagcggcaagctgtgccagttcgccagctgcgagaacaacccctgcggcaacggcgccacctgcgtgcccaagagcggcaccgacatcgtgtgcctgtgcccctacggcagaagcggccccctgtgcaccgacgccatcaacatcacccagcccagattcagcggcaccgacgccttcggctacaccagcttcctggcctacagcagaatcagcgacatcagcttccactacgagttccacctgaagttccagctggccaacaaccacagcgccctgcagaacaacctgatcttcttcaccggccagaagggccacggcctgaacggcgacgacttcctggccgtgggcctgctgaacggcagcgtggtgtacagctacaacctgggcagcggcatcgccagcatcagaagcgagcccctgaacctgagcctgggcgtgcacaccgtgcacctgggcaagttcttccaggagggctggctgaaggtggacgaccacaagaacaagagcatcatcgcccccggcagactggtgggcctgaacgtgttcagccagttctacgtgggcggctacagcgagtacacccccgacctgctgcccaacggcgccgacttcaagaacggcttccagggctgcatcttcaccctgcaggtgagaaccgagaaggacggccacttcagaggcctgggcaaccccgagggccaccccaacgccggcagaagcgtgggccagtgccacgccagcccctgcagcctgatgaagtgcggcaacggcggcacctgcatcgagagcggcaccagcgtgtactgcaactgcaccaccggctggaagggcagcttctgcaccgagaccgtgagcacctgcgaccccgagcacgaccccccccaccactgcagcagaggcgccacctgcatcagcctgccccacggctacacctgcttctgccccctgggcaccaccggcatctactgcgagcaggccctgatcctgatcgtgatcctggagaagcccaagcccgccgagagaaaggtgaagaaggaggccctgagcatcagcgaccccagcttcagaagcaacgagctgagctggatgagcttcgccagcttccacgtgagaaagaagacccacatccagctgcagttccagcccctggccgccgacggcatcctgttctacgccgcccagcacctgaaggcccagagcggcgacttcctgtgcatcagcctggtgaacagcagcgtgcagctgagatacaacctgggcgacagaaccatcatcctggagaccctgcagaaggtgaccatcaacggcagcacctggcacatcatcaaggccggcagagtgggcgccgagggctacctggacctggacggcatcaacgtgaccgagaaggccagcaccaagatgagcagcctggacaccaacaccgacttctacatcggcggcgtgagcagcctgaacctggtgaaccccatggccatcgagaacgagcccgtgggcttccagggctgcatcagacaggtgatcatcaacaaccaggagctgcagctgaccgagttcggcgccaagggcggcagcaacgtgggcgactgcgacggcaccgcctgcggctacaacacctgcagaaacggcggcgagtgcaccgtgaacggcaccaccttcagctgcagatgcctgcccgactgggccggcaacacctgcaaccagagcgtgagctgcctgaacaacctgtgcctgcaccagagcctgtgcatccccgaccagagcttcagctacagctgcctgtgcaccctgggctgggtgggcagatactgcgagaacaagaccagcttcagcaccgccaagttcatgggcaacagctacatcaagtacatcgaccccaactacagaatgagaaacctgcagttcaccaccatcagcctgaacttcagcaccaccaagaccgagggcctgatcgtgtggatgggcatcgcccagaacgaggagaacgacttcctggccatcggcctgcacaaccagaccctgaagatcgccgtgaacctgggcgagagaatcagcgtgcccatgagctacaacaacggcaccttctgctgcaacaagtggcaccacgtggtggtgatccagaaccagaccctgatcaaggcctacatcaacaacagcctgatcctgagcgaggacatcgacccccacaagaacttcgtggccctgaactacgacggcatctgctacctgggcggcttcgagtacggcagaaaggtgaacatcgtgacccaggagatcttcaagaccaacttcgtgggcaagatcaaggacgtggtgttcttccaggagcccaagaacatcgagctgatcaagctggagggctacaacgtgtacgacggcgacgagcagaacgaggtgacctag

SEQ ID NO: 81099 - DNA, 1785 bp, Artificial Sequence
  Description of Artificial Sequence: Synthetic coding sequence
atgaccgacaagagcatcgtgatcctgagcctgatggtgttccacagcagcttcatcaacggcaagacctgcagaagacagctggtggaggagtggcacccccagcccagcagctacgtggtgaactggaccctgaccgagaacatctgcctggacttctacagagactgctggttcctgggcgtgaacaccaagatcgacaccagcggcaaccaggccgtgccccagatctgccccctgcagatccagctgggcgacatcctggtgatcagcagcgagcccagcctgcagttccccgagatcaacctgatgaacgtgagcgagaccagcttcgtgggctgcgtgcagaacaccaccaccgaggaccagctgctgttcggctgcagactgaagggcatgcacaccgtgaacagcaagtggctgagcgtgggcacccactacttcatcaccgtgatggccagcggccccagcccctgccccctgggcctgagactgaacgtgaccgtgaagcagcagttctgccaggagagcctgagcagcgagttctgcagcggccacggcaagtgcctgagcgaggcctggagcaagacctacagctgccactgccagccccccttcagcggcaagtactgccaggagctggacgcctgcagcttcaagccctgcaagaacaacggcagctgcatcaacaagagagagaactgggacgagcaggcctacgagtgcgtgtgccacccccccttcaccggcaagaactgcagcgagatcatcggccagtgccagccccacgtgtgcttccacggcaactgcagcaacatcaccagcaacagcttcatctgcgagtgcgacgagcagttcagcggccccttctgcgaggtgagcgccaagccctgcgtgagcctgctgttctggaagagaggcatctgccccaacagcagcagcgcctacacctacgagtgccccaagggcagcagcagccagaacggcgagaccgacgtgagcgagttcagcctggtgccctgccagaacggcaccgactgcatcaagatcagcaacgacgtgatgtgcatctgcagccccatcttcaccgacctgctgtgcaagagcatccagaccagctgcgagagcttccccctgagaaacaacgccacctgcaagaagtgcgagaaggactacccctgcagctgcatcagcggcttcaccgagaagaactgcgagaaggccatcgaccactgcaagctgctgagcatcaactgcctgaacgaggagtggtgcttcaacatcatcggcagattcaagtacgtgtgcatccccggctgcaccaagaacccctgctggttcctgaagaacgtgtacctgatccaccagcacctgtgctactgcggcgtgaccttccacggcatctgccaggacaagggccccgcccagttcgagtacgtgtggcagctgggcttcgccggcagcgagggcgagaagtgccagggcgtgatcgacgcctacttcttcctggccgccaactgcaccgaggacgccacctacgtgaacgaccccgaggacaacaacagcagctgctggttcccccacgagggcaccaaggagatctgcgccaacggctgcagctgcctgagcgaggaggacagccaggagtacagatacctgtgcttcctgagatgggccggcaacatgtacctggagaacaccaccgacgaccaggagaacgagtgccagcacgaggccgtgtgcaaggacgagatcaacagacccagatacctgtgcatcatctag

SEQ ID NO: 81100 - DNA, 9498 bp, Artificial Sequence; identical to SEQ ID NO: 81098
  Description of Artificial Sequence: Synthetic coding sequence

SEQ ID NO: 81101 - DNA, 9435 bp, Artificial Sequence
  Description of Artificial Sequence: Synthetic coding sequence
atgaccgacaagagcatcgtgatcctgagcctgatggtgttccacagcagcttcatcaacggcaagacctgcagaagacagctggtggaggagtggcacccccagcccagcagctacgtggtgaactggaccctgaccgagaacatctgcctggacttctacagagactgctggttcctgggcgtgaacaccaagatcgacaccagcggcaaccaggccgtgccccagatctgccccctgcagatccagctgggcgacatcctggtgatcagcagcgagcccagcctgcagttccccgagatcaacctgatgaacgtgagcgagaccagcttcgtgggctgcgtgcagaacaccaccaccgaggaccagctgctgttcggctgcagactgaagggcatgcacaccgtgaacagcaagtggctgagcgtgggcacccactacttcatcaccgtgatggccagcggccccagcccctgccccctgggcctgagactgaacgtgaccgtgaagcagcagttctgccaggagagcctgagcagcgagttctgcagcggccacggcaagtgcctgagcgaggcctggagcaagacctacagctgccactgccagccccccttcagcggcaagtactgccaggagctggacgcctgcagcttcaagccctgcaagaacaacggcagctgcatcaacaagagagagaactgggacgagcaggcctacgagtgcgtgtgccacccccccttcaccggcaagaactgcagcgagatcatcggccagtgccagccccacgtgtgcttccacggcaactgcagcaacatcaccagcaacagcttcatctgcgagtgcgacgagcagttcagcggccccttctgcgaggtgagcgccaagccctgcgtgagcctgctgttctggaagagaggcatctgccccaacagcagcagcgcctacacctacgagtgccccaagggcagcagcagccagaacggcgagaccgacgtgagcgagttcagcctggtgccctgccagaacggcaccgactgcatcaagatcagcaacgacgtgatgtgcatctgcagccccatcttcaccgacctgctgtgcaagagcatccagaccagctgcgagagcttccccctgagaaacaacgccacctgcaagaagtgcgagaaggactacccctgcagctgcatcagcggcttcaccgagaagaactgcgagaaggccatcgaccactgcaagctgctgagcatcaactgcctgaacgaggagtggtgcttcaacatcatcggcagattcaagtacgtgtgcatccccggctgcaccaagaacccctgctggttcctgaagaacgtgtacctgatccaccagcacctgtgctactgcggcgtgaccttccacggcatctgccaggacaagggccccgcccagttcgagtacgtgtggcagctgggcttcgccggcagcgagggcgagaagtgccagggcgtgatcgacgcctacttcttcctggccgccaactgcaccgaggacgccacctacgtgaacgaccccgaggacaacaacagcagctgctggttcccccacgagggcaccaaggagatctgcgccaacggctgcagctgcctgagcgaggaggacagccaggagtacagatacctgtgcttcctgagatgggccggcaacatgtacctggagaacaccaccgacgaccaggagaacgagtgccagcacgaggccgtgtgcaaggacgagatcaacagacccagatgcagctgcagcctgagctacatcggcagactgtgcgtggtgaacgtggactactgcctgggcaaccacagcatcagcgtgcacggcctgtgcctggccctgagccacaactgcaactgcagcggcctgcagagatacgagagaaacatctgcgagatcgacaccgaggactgcaagagcgccagctgcaagaacggcaccaccagcacccacctgagaggctacttcttcagaaagtgcgtgcccggcttcaagggcacccagtgcgagatcgacatcgacgagtgcgccagccacccctgcaagaacggcgccacctgcatcgaccagcccggcaactacttctgccagtgcgtgccccccttcaaggtggtggacggcttcagctgcctgtgcaaccccggctacgtgggcatcagatgcgagcaggacatcgacgactgcatcctgaacgcctgcgagcacaacagcacctgcaaggacctgcacctgagctaccagtgcgtgtgcctgagcgactgggagggcaacttctgcgagcaggagagcaacgagtgcaagatgaacccctgcaagaacaacagcacctgcaccgacctgtacaagagctacagatgcgagtgcaccagcggctggaccggccagaactgcagcgaggagatcaacgagtgcgacagcgacccctgcatgaacggcggcctgtgccacgagagcaccatccccggccagttcgtgtgcctgtgcccccccctgtacaccggccagttctgccaccagagatacaacctgtgcgacctgctgcacaacccctgcagaaacaacagcacctgcctggccctggtggacgccaaccagcactgcatctgcagagaggagttcgagggcaagaactgcgagatcgacgtgaaggactgcctgttcctgagctgccaggactacggcgactgcgaggacatggtgaacaacttcagatgcatctgcagacccggcttcagcggcagcctgtgcgagatcgagatcaacgagtgcagcagcgagccctgcaagaacaacggcacctgcgtggacctgaccaacagattcttctgcaactgcgagcccgagtaccacggccccttctgcgagctggacgtgaacaagtgcaagatcagcccctgcctggacgaggagaactgcgtgtacagaaccgacggctacaactgcctgtgcgcccccggctacaccggcatcaactgcgagatcaacctggacgagtgcctgagcgagccctgcctgcacgacggcgtgtgcatcgacggcatcaaccactacacctgcgactgcaagagcggcttcttcggcacccactgcgagaccaacgccaacgactgcctgagcaacccctgcctgcacggcagatgcaccgagctgatcaacgagtacccctgcagctgcgacgccgacggcaccagcacccagtgcaagatcaagatcaacgactgcaccagcatcccctgcatgaacgagggcttctgccagaagagcgcccacggcttcacctgcatctgccccagaggctacaccggcgcctactgcgagaagagcatcgacaactgcgccgagcccgagctgaacagcgtgatctgcctgaacggcggcatctgcgtggacggccccggccacaccttcgactgcagatgcctgcccggcttcagcggccagttctgcgagatcaacatcaacgagtgcagcagcagcccctgcctgcacggcgccgactgcgaggaccacatcaacggctacgtgtgcaagtgccagcccggctggagcggccaccactgcgagaacgagctggagtgcatccccaacagctgcgtgcacgagctgtgcatggagaacgagcccggcagcacctgcctgtgcacccccggcttcatgacctgcagcatcggcctgctgtgcggcgacgagatcagaagaatcacctgcctgacccccatcttccagagaaccgaccccatcagcacccagacctacaccatcccccccagcgagaccctggtgagcagcttccccagcatcaaggccaccagaatccccgccatcatggacacctaccccgtggaccagggccccaagcagaccggcatcgtgaagcacgacatcctgcccaccaccggcctggccaccctgagaatcagcacccccctggagagctacctgctgcaggagctgatcgtgaccagagagctgagcgccaagcacagcctgctgagcagcgccgacgtgagcagcagcagattcctgaacttcggcatcagagaccccgcccagatcgtgcaggacaagaccagcgtgagccacatgcccatcagaaccagcgccgccaccctgggcttcttcttccccgacagaagagccagaacccccttcatcatgagcagcctgatgagcgacttcatcttccccacccagagcctgctgttcgagaactgccagaccgtggccctgagcgccacccccaccaccagcgtgatcagaagcatccccggcgccgacatcgagctgaacagacagagcctgctgagcagaggcttcctgctgatcgccgccagcatcagcgccacccccgtggtgagcagaggcgcccaggaggacatcgaggagtacagcgccgacagcctgatcagcagaagagagcactggagactgctgagccccagcatgagccccatcttccccgccaaggtgatcatcagcaagcaggtgaccatcctgaacagcagcgccctgcacagattcagcaccaaggccttcaaccccagcgagtaccaggccatcaccgaggccagcagcaaccagagactgaccaacatcaagagccaggccgccgacagcctgagagagctgagccagacctgcgccacctgcagcatgaccgagatcaagagcagcagagagttcagcgaccaggtgctgcacagcaagcagagccacttctacgagaccttctggatgaacagcgccatcctggccagctggtacgccctgatgggcgcccagaccatcaccagcggccacagcttcagcagcgccaccgagatcacccccagcgtggccttcaccgaggtgcccagcctgttccccagcaagaagagcgccaagagaaccatcctgagcagcagcctggaggagagcatcaccctgagcagcaacctggacgtgaacctgtgcctggacaagacctgcctgagcatcgtgcccagccagaccatcagcagcgacctgatgaacagcgacctgaccagcaagatgaccaccgacgagctgagcgtgagcgagaacatcctgaagctgctgaagatcagacagtacggcatcaccatgggccccaccgaggtgctgaaccaggagagcctgctggacatggagaagagcaagggcagccacaccctgttcaagctgcaccccagcgacagcagcctggacttcgagctgaacctgcagatctaccccgacgtgaccctgaagacctacagcgagatcacccacgccaacgacttcaagaacaacctgccccccctgaccggcagcgtgcccgacttcagcgaggtgaccaccaacgtggccttctacaccgtgagcgccacccccgccctgagcatccagaccagcagcagcatgagcgtgatcagacccgactggccctacttcaccgactacatgaccagcctgaagaaggaggtgaagaccagcagcgagtggagcaagtgggagctgcagcccagcgtgcagtaccaggagttccccaccgccagcagacacctgcccttcaccagaagcctgaccctgagcagcctggagagcatcctggccccccagagactgatgatcagcgacttcagctgcgtgagatactacggcgacagctacctggagttccagaacgtggccctgaacccccagaacaacatcagcctggagttccagaccttcagcagctacggcctgctgctgtacgtgaagcaggacagcaacctggtggacggcttcttcatccagctgttcatcgagaacggcaccctgaagtaccacttctactgccccggcgaggccaagttcaagagcatcaacaccaccgtgagagtggacaacggccagaagtacaccctgctgatcagacaggagctggacccctgcaacgccgagctgaccatcctgggcagaaacacccagatctgcgagagcatcaaccacgtgctgggcaagcccctgcccaagagcggcagcgtgttcatcggcggcttccccgacctgcacggcaagatccagatgcccgtgcccgtgaagaacttcaccggctgcatcgaggtgatcgagatcaacaactggagaagcttcatccccagcaaggccgtgaagaactaccacatcaacaactgcagaagccagggcttcatgctgagccccaccgccagcttcgtggacgccagcgacgtgacccagggcgtggacaccatgtggaccagcgtgagccccagcgtggccgcccccagcgtgtgccagcaggacgtgtgccacaacggcggcacctgccacgccatcttcctgagcagcggcatcgtgagcttccagtgcgactgccccctgcacttcaccggcagattctgcgagaaggacgccggcctgttcttccccagcttcaacggcaacagctacctggagctgcccttcctgaagttcgtgctggagaaggagcacaacagaaccgtgaccatctacctgaccatcaagaccaacagcctgaacggcaccatcctgtacagcaacggcaacaactgcggcaagcagttcctgcacctgttcctggtggagggcagacccagcgtgaagtacggctgcggcaacagccagaacatcctgaccgtgagcgccaactacagcatcaacaccaacgccttcacccccatcaccatcagatacaccacccccgtgggcagccccggcgtggtgtgcatgatcgagatgaccgccgacggcaagccccccgtgcagaagaaggacaccgagatcagccacgccagccaggcctacttcgagagcatgttcctgggccacatccccgccaacgtgcagatccacaagaaggccggccccgtgtacggcttcagaggctgcatcctggacctgcaggtgaacaacaaggagttcttcatcatcgacgaggccagacacggcaagaacatcgagaactgccacgtgccctggtgcgcccaccacctgtgcagaaacaacggcacctgcatcagcgacaacgagaacctgttctgcgagtgccccagactgtacagcggcaagctgtgccagttcgccagctgcgagaacaacccctgcggcaacggcgccacctgcgtgcccaagagcggcaccgacatcgtgtgcctgtgcccctacggcagaagcggccccctgtgcaccgacgccatcaacatcacccagcccagattcagcggcaccgacgccttcggctacaccagcttcctggcctacagcagaatcagcgacatcagcttccactacgagttccacctgaagttccagctggccaacaaccacagcgccctgcagaacaacctgatcttcttcaccggccagaagggccacggcctgaacggcgacgacttcctggccgtgggcctgctgaacggcagcgtggtgtacagctacaacctgggcagcggcatcgccagcatcagaagcgagcccctgaacctgagcctgggcgtgcacaccgtgcacctgggcaagttcttccaggagggctggctgaaggtggacgaccacaagaacaagagcatcatcgcccccggcagactggtgggcctgaacgtgttcagccagttctacgtgggcggctacagcgagtacacccccgacctgctgcccaacggcgccgacttcaagaacggcttccagggctgcatcttcaccctgcaggtgagaaccgagaaggacggccacttcagaggcctgggcaaccccgagggccaccccaacgccggcagaagcgtgggccagtgccacgccagcccctgcagcctgatgaagtgcggcaacggcggcacctgcatcgagagcggcaccagcgtgtactgcaactgcaccaccggctggaagggcagcttctgcaccgagaccgtgagcacctgcgaccccgagcacgaccccccccaccactgcagcagaggcgccacctgcatcagcctgccccacggctacacctgcttctgccccctgggcaccaccggcatctactgcgagcaggccctgagcatcagcgaccccagcttcagaagcaacgagctgagctggatgagcttcgccagcttccacgtgagaaagaagacccacatccagctgcagttccagcccctggccgccgacggcatcctgttctacgccgcccagcacctgaaggcccagagcggcgacttcctgtgcatcagcctggtgaacagcagcgtgcagctgagatacaacctgggcgacagaaccatcatcctggagaccctgcagaaggtgaccatcaacggcagcacctggcacatcatcaaggccggcagagtgggcgccgagggctacctggacctggacggcatcaacgtgaccgagaaggccagcaccaagatgagcagcctggacaccaacaccgacttctacatcggcggcgtgagcagcctgaacctggtgaaccccatggccatcgagaacgagcccgtgggcttccagggctgcatcagacaggtgatcatcaacaaccaggagctgcagctgaccgagttcggcgccaagggcggcagcaacgtgggcgactgcgacggcaccgcctgcggctacaacacctgcagaaacggcggcgagtgcaccgtgaacggcaccaccttcagctgcagatgcctgcccgactgggccggcaacacctgcaaccagagcgtgagctgcctgaacaacctgtgcctgcaccagagcctgtgcatccccgaccagagcttcagctacagctgcctgtgcaccctgggctgggtgggcagatactgcgagaacaagaccagcttcagcaccgccaagttcatgggcaacagctacatcaagtacatcgaccccaactacagaatgagaaacctgcagttcaccaccatcagcctgaacttcagcaccaccaagaccgagggcctgatcgtgtggatgggcatcgcccagaacgaggagaacgacttcctggccatcggcctgcacaaccagaccctgaagatcgccgtgaacctgggcgagagaatcagcgtgcccatgagctacaacaacggcaccttctgctgcaacaagtggcaccacgtggtggtgatccagaaccagaccctgatcaaggcctacatcaacaacagcctgatcctgagcgaggacatcgacccccacaagaacttcgtggccctgaactacgacggcatctgctacctgggcggcttcgagtacggcagaaaggtgaacatcgtgacccaggagatcttcaagaccaacttcgtgggcaagatcaaggacgtggtgttcttccaggagcccaagaacatcgagctgatcaagctggagggctacaacgtgtacgacggcgacgagcagaacgaggtgacctag

SEQ ID NO: 81102 - DNA, 1785 bp, Artificial Sequence; identical to SEQ ID NO: 81099
  Description of Artificial Sequence: Synthetic coding sequence

SEQ ID NO: 81103 - DNA, 1860 bp, Artificial Sequence
  Description of Artificial Sequence: Synthetic coding sequence
atgaccgacaagagcatcgtgatcctgagcctgatggtgttccacagcagcttcatcaacggcaagacctgcagaagacagctggtggaggagtggcacccccagcccagcagctacgtggtgaactggaccctgaccgagaacatctgcctggacttctacagagactgctggttcctgggcgtgaacaccaagatcgacaccagcggcaaccaggccgtgccccagatctgccccctgcagatccagctgggcgacatcctggtgatcagcagcgagcccagcctgcagttccccgagatcaacctgatgaacgtgagcgagaccagcttcgtgggctgcgtgcagaacaccaccaccgaggaccagctgctgttcggctgcagactgaagggcatgcacaccgtgaacagcaagtggctgagcgtgggcacccactacttcatcaccgtgatggccagcggccccagcccctgccccctgggcctgagactgaacgtgaccgtgaagcagcagttctgccaggagagcctgagcagcgagttctgcagcggccacggcaagtgcctgagcgaggcctggagcaagacctacagctgccactgccagccccccttcagcggcaagtactgccaggagctggacgcctgcagcttcaagccctgcaagaacaacggcagctgcatcaacaagagagagaactgggacgagcaggcctacgagtgcgtgtgccacccccccttcaccggcaagaactgcagcgagatcatcggccagtgccagccccacgtgtgcttccacggcaactgcagcaacatcaccagcaacagcttcatctgcgagtgcgacgagcagttcagcggccccttctgcgaggtgagcgccaagccctgcgtgagcctgctgttctggaagagaggcatctgccccaacagcagcagcgcctacacctacgagtgccccaagggcagcagcagccagaacggcgagaccgacgtgagcgagttcagcctggtgccctgccagaacggcaccgactgcatcaagatcagcaacgacgtgatgtgcatctgcagccccatcttcaccgacctgctgtgcaagagcatccagaccagctgcgagagcttccccctgagaaacaacgccacctgcaagaagtgcgagaaggactacccctgcagctgcatcagcggcttcaccgagaagaactgcgagaaggccatcgaccactgcaagctgctgagcatcaactgcctgaacgaggagtggtgcttcaacatcatcggcagattcaagtacgtgtgcatccccggctgcaccaagaacccctgctggttcctgaagaacgtgtacctgatccaccagcacctgtgctactgcggcgtgaccttccacggcatctgccaggacaagggccccgcccagttcgagtacgtgtggcagctgggcttcgccggcagcgagggcgagaagtgccagggcgtgatcgacgcctacttcttcctggccgccaactgcaccgaggacgccacctacgtgaacgaccccgaggacaacaacagcagctgctggttcccccacgagggcaccaaggagatctgcgccaacggctgcagctgcctgagcgaggaggacagccaggagtacagatacctgtgcttcctgagatgggccggcaacatgtacctggagaacaccaccgacgaccaggagaacgagtgccagcacgaggccgtgtgcaaggacgagatcaacagacccagaagaatcctgaacaccgtgatcccccaccagatccagcagcacatcgagagattcatccagcacgaccaggtgggcttcatcgtgagaatctag

SEQ ID NO: 81104 - DNA, 1764 bp, Artificial Sequence
  Description of Artificial Sequence: Synthetic coding sequence
atgggctgggacctgggcaccagactgttccagagacaggagcagagaagcagactgagcagaatctggctggagaagaccagagtgttcctggagggcagcaccagaacccccgccctgccccactgcctgttctggctgctgcaggtgcccagcacccaggaccccctgttccccggctacggcccccagtgccccgtggacctggccggccccccctgcctgagacccctgttcggcggcctgggcggctactggagagccctgcagagaggcagagagggcagaaccatgaccagcagagccagcgagctgagccccggcagaagcgtgaccgccggcatcatcatcgtgggcgacgagatcctgaagggccacacccaggacaccaacaccttcttcctgtgcagaaccctgagaagcctgggcgtgcaggtgtgcagagtgagcgtggtgcccgacgaggtggccaccatcgccgccgaggtgaccagcttcagcaacagattcacccacgtgctgaccgccggcggcatcggccccacccacgacgacgtgaccttcgaggccgtggcccaggccttcggcgacgagctgaagccccaccccaagctggaggccgccaccaaggccctgggcggcgagggctgggagaagctgagcctggtgcccagcagcgccagactgcactacggcaccgacccctgcaccggccagcccttcagattccccctggtgagcgtgagaaacgtgtacctgttccccggcatccccgagctgctgagaagagtgctggagggcatgaagggcctgttccagaaccccgccgtgcagttccacagcaaggagctgtacgtggccgccgacgaggccagcatcgcccccatcctggccgaggcccaggcccacttcggcagaagactgggcctgggcagctaccccgactggggcagcaactactaccaggtgaagctgaccctggacagcgaggaggagggccccctggaggagtgcctggcctacctgaccgccagactgccccagggcagcctggtgccctacatgcccaacgccgtggagcaggccagcgaggccgtgtacaagctggccgagagcggcagcagcctgggcaagaaggtggccggcgccctgcagaccatcgagaccagcctggcccagtacagcctgacccagctgtgcgtgggcttcaacggcggcaaggactgcaccgccctgctgcacctgttccacgccgccgtgcagagaaagctgcccgacgtgcccaaccccctgcagatcctgtacatcagaagcatcagccccttccccgagctggagcagttcctgcaggacaccatcaagagatacaacctgcagatgctggaggccgagggcagcatgaagcaggccctgggcgagctgcaggccagacacccccagctggaggccgtgctgatgggcaccagaagaaccgacccctacagctgcagcctgtgccccttcagccccaccgaccccggctggcccgccttcatgagaatcaaccccctgctggactggacctacagagacatctgggacttcctgagacagctgttcgtgccctactgcatcctgtacgacagaggctacaccagcctgggcagcagagagaacaccgtgagaaaccccgccctgaagtgcctgagccccggcggccaccccacctacagacccgcctacctgctggagaacgaggaggaggagagaaacagcagaacctag

SEQ ID NO: 81105 - DNA, 513 bp, Artificial Sequence
  Description of Artificial Sequence: Synthetic coding sequence
atgaagggcctgttccagaaccccgccgtgcagttccacagcaaggagctgtacgtggccgccgacgaggccagcatcgcccccatcctggccgaggcccaggcccacttcggcagaagactgggcctgggcagctaccccgactggggcagcaactactaccaggtgaagctgaccctggacagcgaggaggagggccccctggaggagtgcctggcctacctgaccgccagactgccccagggcagcctggtgccctacatgcccaacgccgtggagcaggccagcgaggccgtgtacaagctggccgagagcggcaactacctgatgttccagacccccagcagaagctgcatcagcgccgccagccccctgagcctgagctggaacagcttctacagaaccctgagcagagagcaggccatccccgagaaccagatcgccagcccccccagcgaggccaagggcgccgaggagccctggatgggccccttccccggccagcagggctag

SEQ ID NO: 81106 - DNA, 1473 bp, Artificial Sequence
  Description of Artificial Sequence: Synthetic coding sequence
atgaccagcagagccagcgagctgagccccggcagaagcgtgaccgccggcatcatcatcgtgggcgacgagatcctgaagggccacacccaggacaccaacaccttcttcctgtgcagaaccctgagaagcctgggcgtgcaggtgtgcagagtgagcgtggtgcccgacgaggtggccaccatcgccgccgaggtgaccagcttcagcaacagattcacccacgtgctgaccgccggcggcatcggccccacccacgacgacgtgaccttcgaggccgtggcccaggccttcggcgacgagctgaagccccaccccaagctggaggccgccaccaaggccctgggcggcgagggctgggagaagctgagcctggtgcccagcagcgccagactgcactacggcaccgacccctgcaccggccagcccttcagattccccctggtgagcgtgagaaacgtgtacctgttccccggcatccccgagctgctgagaagagtgctggagggcatgaagggcctgttccagaaccccgccgtgcagttccacagcaaggagctgtacgtggccgccgacgaggccagcatcgcccccatcctggccgaggcccaggcccacttcggcagaagactgggcctgggcagctaccccgactggggcagcaactactaccaggtgaagctgaccctggacagcgaggaggagggccccctggaggagtgcctggcctacctgaccgccagactgccccagggcagcctggtgccctacatgcccaacgccgtggagcaggccagcgaggccgtgtacaagctggccgagagcggcagcagcctgggcaagaaggtggccggcgccctgcagaccatcgagaccagcctggcccagtacagcctgacccagctgtgcgtgggcttcaacggcggcaaggactgcaccgccctgctgcacctgttccacgccgccgtgcagagaaagctgcccgacgtgcccaaccccctgcagatcctgtacatcagaagcatcagccccttccccgagctggagcagttcctgcaggacaccatcaagagatacaacctgcagatgctggaggccgagggcagcatgaagcaggccctgggcgagctgcaggccagacacccccagctggaggccgtgctgatgggcaccagaagaaccgacccctacagctgcagcctgtgccccttcagccccaccgaccccggctggcccgccttcatgagaatcaaccccctgctggactggacctacagagacatctgggacttcctgagacagctgttcgtgccctactgcatcctgtacgacagaggctacaccagcctgggcagcagagagaacaccgtgagaaaccccgccctgaagtgcctgagccccggcggccaccccacctacagacccgcctacctgctggagaacgaggaggaggagagaaacagcagaacctag

SEQ ID NO: 81107 - DNA, 387 bp, Artificial Sequence
  Description of Artificial Sequence: Synthetic coding sequence
atgctggaggccgagggcagcatgaagcaggccctgggcgagctgcaggccagacacccccagctggaggccgtgctgatgggcaccagaagaaccgacccctacagctgcagcctgtgccccttcagccccaccgaccccggctggcccgccttcatgagaatcaaccccctgctggactggacctacagagacatctgggacttcctgagacagctgttcgtgccctactgcatcctgtacgacagaggctacaccagcctgggcagcagagagaacaccgtgagaaaccccgccctgaagtgcctgagccccggcggccaccccacctacagacccgcctacctgctggagaacgaggaggaggagagaaacagcagaacctag

SEQ ID NO: 81108 - DNA, 885 bp, Artificial Sequence
  Description of Artificial Sequence: Synthetic coding sequence
atgcagcccagcagcagcaccccccccctgcacccctacagcaccgacggcctgatcttccccttcaacccccagggccacacccaggacaccaacaccttcttcctgtgcagaaccctgagaagcctgggcgtgcaggtgtgcagagtgagcgtggtgcccgacgaggtggccaccatcgccgccgaggtgaccagcttcagcaacagattcacccacgtgctgaccgccggcggcatcggccccacccacgacgacgtgaccttcgaggccgtggcccaggccttcggcgacgagctgaagccccaccccaagctggaggccgccaccaaggccctgggcggcgagggctgggagaagctgagcctggtgcccagcagcgccagactgcactacggcaccgacccctgcaccggccagcccttcagattccccctggtgagcgtgagaaacgtgtacctgttccccggcatccccgagctgctgagaagagtgctggagggcatgaagggcctgttccagaaccccgccgtgcagttccacagcaaggagctgtacgtggccgccgacgaggccagcatcgcccccatcctggccgaggcccaggcccacttcggcagaagactgggcctgggcagctaccccgactggggcagcaactactaccaggtgaagctgaccctggacagcgaggaggagggccccctggaggagtgcctggcctacctgaccgccagactgccccagggcagcctggtgccctacatgcccaacgccgtggagcaggccagcgaggccgtgtacaagctggccgagagcggcagagacctgatggaggagggccactacgcccagagccactggtggcaccccagaagccagtag

SEQ ID NO: 81109 - DNA, 1341 bp, Artificial Sequence
  Description of Artificial Sequence: Synthetic coding sequence
atgaccagcagagccagcgagctgagccccggcagaagcgtgaccgccggcatcatcatcgtgggcgacgagatcctgaagggccacacccaggacaccaacaccttcttcctgtgcagaaccctgagaagcctgggcgtgcaggtgtgcagagtgagcgtggtgcccgacgaggtggccaccatcgccgccgaggtgaccagcttcagcaacagattcacccacgtgctgaccgccggcggcatcggccccacccacgacgacgtgaccttcgaggccgtggcccaggccttcggcgacgagctgaagccccaccccaagctggaggccgccaccaaggccctgggcggcgagggctgggagaagctgagcctggtgcccagcagcgccagactgcactacggcaccgacccctgcaccggccagcccttcagattccccctggtgagcgtgagaaacgtgtacctgttccccggcatccccgagctgctgagaagagtgctggagggcatgaagggcctgttccagaaccccgccgtgcagttccacagcaaggagctgtacgtggccgccgacgaggccagcatcgcccccatcctggccgaggcccaggcccacttcggcagaagactgggcctgggcagctaccccgactggggcagcaactactaccaggtgaagctgaccctggacagcgaggaggagggccccctggaggagtgcctggcctacctgaccgccagactgccccagggcagcctggtgccctacatgcccaacgccgtggagcaggccagcgaggccgtgtacaagctggccgagagcggcagcagcctgggcaagaaggtggccggcgccctgcagaccatcgagaccagcctggcccagtacagcctgacccagctgtgcgtgggcttcaacggcggcaaggactgcaccgccctgctgcacctgttccacgccgccgtgcagagaaagctgcccgacgtgcccaaccccctgcagatcctgtacatcagaagcatcagccccttccccgagctggagcagttcctgcaggacaccatcaagagatacaacctgcagatgctggaggccgagggcagcatgaagcaggccctgggcgagctgcaggccagacacccccagctggaggccgtgctgatgggcaccagaagaaccgacccctacagctgcagcctgtgccccttcagccccaccgaccccggctggcccgccttcatgagaatcaaccccctgctggactggacctacagagacatctgggacttcctgagacagctgttcgtgccctactgcatcctgtacgacagaggctag

SEQ ID NO: 81110 - DNA, 1371 bp, Artificial Sequence
  Description of Artificial Sequence: Synthetic coding sequence
atgggctgggacctgggcaccagactgttccagagacaggagcagagaagcagactgagcagaatctggctggagaagaccagagtgttcctggagggcagcaccagaacccccgccctgccccactgcctgttctggctgctgcaggtgcccagcacccaggaccccctgttccccggctacggcccccagtgccccgtggacctggccggccccccctgcctgagacccctgttcggcggcctgggcggctactggagagccctgcagagaggcagagagggcagaaccatgaccagcagagccagcgagctgagccccggcagaagcgtgaccgccggcatcatcatcgtgggcgacgagatcctgaagggccacacccaggacaccaacaccttcttcctgtgcagaaccctgagaagcctgggcgtgcaggtgtgcagagtgagcgtggtgcccgacgaggtggccaccatcgccgccgaggtgaccagcttcagcaacagattcacccacgtgctgaccgccggcggcatcggccccacccacgacgacgtgaccttcgaggccgtggcccaggccttcggcgacgagctgaagccccaccccaagctggaggccgccaccaaggccctgggcggcgagggctgggagaagctgagcctggtgcccagcagcgccagactgcactacggcaccgacccctgcaccggccagcccttcagattccccctggtgagcgtgagaaacgtgtacctgttccccggcatccccgagctgctgagaagagtgctggagggcatgaagggcctgttccagaaccccgccgtgcagttccacagcaaggagctgtacgtggccgccgacgaggccagcatcgcccccatcctggccgaggcccaggcccacttcggcagaagactgggcctgggcagctaccccgactggggcagcaactactaccaggtgaagctgaccctggacagcgaggaggagggccccctggaggagtgcctggcctacctgaccgccagactgccccagggcagcctggtgccctacatgcccaacgccgtggagcaggccagcgaggccgtgtacaagctggccgagagcggcagcagcctgggcaagaaggtggccggcgccctgcagaccatcgagaccagcctggcccagtacagcctgacccagctgtgcgtgggcttcaacggcggcaaggactgcaccgccctgctgcacctgttccacgccgccgtgcagagaaagctgcccgacgtgcccaaccccctgcagatcctgtacatcagaagcatcagccccttccccgagctggagcagttcctgcaggacaccatcaagagatactag

SEQ ID NO: 81111 - DNA, 1017 bp, Artificial Sequence
  Description of Artificial Sequence: Synthetic coding sequence
atgcagcccagcagcagcaccccccccctgcacccctacagcaccgacggcctgatcttccccttcaacccccagggccacacccaggacaccaacaccttcttcctgtgcagaaccctgagaagcctgggcgtgcaggtgtgcagagtgagcgtggtgcccgacgaggtggccaccatcgccgccgaggtgaccagcttcagcaacagattcacccacgtgctgaccgccggcggcatcggccccacccacgacgacgtgaccttcgaggccgtggcccaggccttcggcgacgagctgaagccccaccccaagctggaggccgccaccaaggccctgggcggcgagggctgggagaagctgagcctggtgcccagcagcgccagactgcactacggcaccgacccctgcaccggccagcccttcagattccccctggtgagcgtgagaaacgtgtacctgttccccggcatccccgagctgctgagaagagtgctggagggcatgaagggcctgttccagaaccccgccgtgcagttccacagcaaggagctgtacgtggccgccgacgaggccagcatcgcccccatcctggccgaggcccaggcccacttcggcagaagactgggcctgggcagctaccccgactggggcagcaactactaccaggtgaagctgaccctggacagcgaggaggagggccccctggaggagtgcctggcctacctgaccgccagactgccccagggcagcctggtgccctacatgcccaacgccgtggagcaggccagcgaggccgtgtacaagctggccgagagcggcaactacctgatgttccagacccccagcagaagctgcatcagcgccgccagccccctgagcctgagctggaacagcttctacagaaccctgagcagagagcaggccatccccgagaaccagatcgccagcccccccagcgaggccaagggcgccgaggagccctggatgggccccttccccggccagcagggctag

SEQ ID NO: 81112 - DNA, 1461 bp, Artificial Sequence
  Description of Artificial Sequence: Synthetic coding sequence
atgatcagaagagtgctgccccacggcatgggcagaggcctgctgaccagaagacccggcaccagaagaggcggcttcagcctggactgggacggcaaggtgagcgagatcaagaagaagatcaagagcatcctgcccggcagaagctgcgacctgctgcaggacaccagccacctgccccccgagcacagcgacgtggtgatcgtgggcggcggcgtgctgggcctgagcgtggcctactggctgaagaagctggagagcagaagaggcgccatcagagtgctggtggtggagagagaccacacctacagccaggccagcaccggcctgagcgtgggcggcatctgccagcagttcagcctgcccgagaacatccagctgagcctgttcagcgccagcttcctgagaaacatcaacgagtacctggccgtggtggacgccccccccctggacctgagattcaaccccagcggctacctgctgctggccagcgagaaggacgccgccgccatggagagcaacgtgaaggtgcagagacaggagggcgccaaggtgagcctgatgagccccgaccagctgagaaacaagttcccctggatcaacaccgagggcgtggccctggccagctacggcatggaggacgagggctggttcgacccctggtgcctgctgcagggcctgagaagaaaggtgcagagcctgggcgtgctgttctgccagggcgaggtgaccagattcgtgagcagcagccagagaatgctgaccaccgacgacaaggccgtggtgctgaagagaatccacgaggtgcacgtgaagatggacagaagcctggagtaccagcccgtggagtgcgccatcgtgatcaacgccgccggcgcctggagcgcccagatcgccgccctggccggcgtgggcgagggcccccccggcaccctgcagggcaccaagctgcccgtggagcccagaaagagatacgtgtacgtgtggcactgcccccagggccccggcctggagacccccctggtggccgacaccagcggcgcctacttcagaagagagggcctgggcagcaactacctgggcggcagaagccccaccgagcaggaggagcccgaccccgccaacctggaggtggaccacgacttcttccaggacaaggtgtggccccacctggccctgagagtgcccgccttcgagaccctgaaggtgcagagcgcctgggccggctactacgactacaacaccttcgaccagaacggcgtggtgggcccccaccccctggtggtgaacatgtacttcgccaccggcttcagcggccacggcctgcagcaggcccccggcatcggcagagccgtggccgagatggtgctgaagggcagattccagaccatcgacctgagccccttcctgttcaccagattctacctgggcgagaagatccaggagaacaacatcatctag

SEQ ID NO: 81113 - DNA, 951 bp, Artificial Sequence
  Description of Artificial Sequence: Synthetic coding sequence
atggagagcaacgtgaaggtgcagagacaggagggcgccaaggtgagcctgatgagccccgaccagctgagaaacaagttcccctggatcaacaccgagggcgtggccctggccagctacggcatggaggacgagggctggttcgacccctggtgcctgctgcagggcctgagaagaaaggtgcagagcctgggcgtgctgttctgccagggcgaggtgaccagattcgtgagcagcagccagagaatgctgaccaccgacgacaaggccgtggtgctgaagagaatccacgaggtgcacgtgaagatggacagaagcctggagtaccagcccgtggagtgcgccatcgtgatcaacgccgccggcgcctggagcgcccagatcgccgccctggccggcgtgggcgagggcccccccggcaccctgcagggcaccaagctgcccgtggagcccagaaagagatacgtgtacgtgtggcactgcccccagggccccggcctggagacccccctggtggccgacaccagcggcgcctacttcagaagagagggcctgggcagcaactacctgggcggcagaagccccaccgagcaggaggagcccgaccccgccaacctggaggtggaccacgacttcttccaggacaaggtgtggccccacctggccctgagagtgcccgccttcgagaccctgaaggtgcagagcgcctgggccggctactacgactacaacaccttcgaccagaacggcgtggtgggcccccaccccctggtggtgaacatgtacttcgccaccggcttcagcggccacggcctgcagcaggcccccggcatcggcagagccgtggccgagatggtgctgaagggcagattccagaccatcgacctgagccccttcctgttcaccagattctacctgggcgagaagatccaggagaacaacatcatctag

SEQ ID NO: 81114 - DNA, 1419 bp, Artificial Sequence
  Description of Artificial Sequence: Synthetic coding sequence
atggcccacaccggcagaaccgtgggcagactgggcgagggcgactgggacggcaaggtgagcgagatcaagaagaagatcaagagcatcctgcccggcagaagctgcgacctgctgcaggacaccagccacctgccccccgagcacagcgacgtggtgatcgtgggcggcggcgtgctgggcctgagcgtggcctactggctgaagaagctggagagcagaagaggcgccatcagagtgctggtggtggagagagaccacacctacagccaggccagcaccggcctgagcgtgggcggcatctgccagcagttcagcctgcccgagaacatccagctgagcctgttcagcgccagcttcctgagaaacatcaacgagtacctggccgtggtggacgccccccccctggacctgagattcaaccccagcggctacctgctgctggccagcgagaaggacgccgccgccatggagagcaacgtgaaggtgcagagacaggagggcgccaaggtgagcctgatgagccccgaccagctgagaaacaagttcccctggatcaacaccgagggcgtggccctggccagctacggcatggaggacgagggctggttcgacccctggtgcctgctgcagggcctgagaagaaaggtgcagagcctgggcgtgctgttctgccagggcgaggtgaccagattcgtgagcagcagccagagaatgctgaccaccgacgacaaggccgtggtgctgaagagaatccacgaggtgcacgtgaagatggacagaagcctggagtaccagcccgtggagtgcgccatcgtgatcaacgccgccggcgcctggagcgcccagatcgccgccctggccggcgtgggcgagggcccccccggcaccctgcagggcaccaagctgcccgtggagcccagaaagagatacgtgtacgtgtggcactgcccccagggccccggcctggagacccccctggtggccgacaccagcggcgcctacttcagaagagagggcctgggcagcaactacctgggcggcagaagccccaccgagcaggaggagcccgaccccgccaacctggaggtggaccacgacttcttccaggacaaggtgtggccccacctggccctgagagtgcccgccttcgagaccctgaaggtgcagagcgcctgggccggctactacgactacaacaccttcgaccagaacggcgtggtgggcccccaccccctggtggtgaacatgtacttcgccaccggcttcagcggccacggcctgcagcaggcccccggcatcggcagagccgtggccgagatggtgctgaagggcagattccagaccatcgacctgagccccttcctgttcaccagattctacctgggcgagaagatccaggagaacaacatcatctag

SEQ ID NO: 81115 - DNA, 501 bp, Artificial Sequence
  Description of Artificial Sequence: Synthetic coding sequence
atggcccagagactgctgctgagaagattcctggccagcgtgatcagcagaaagcccagccagggccagtggccccccctgaccagcagagccctgcagaccccccagtgcagccccggcggcctgaccgtgacccccaaccccgccagaaccatctacaccaccagaatcagcctgaccaccttcaacatccaggacggccccgacttccaggacagagtggtgaacagcgagacccccgtggtggtggacttccacgcccagtggtgcggcccctgcaagatcctgggccccagactggagaagatggtggccaagcagcacggcaaggtggtgatggccaaggtggacatcgacgaccacaccgacctggccatcgagtacgaggtgagcgccgtgcccaccgtgctggccatgaagaacggcgacgtggtggacaagttcgtgggcatcaaggacgaggaccagctggaggccttcctgaagaagctgatcggctag

SEQ ID NO: 81116 - DNA, 2055 bp, Artificial Sequence; identical to SEQ ID NO: 80903
  Description of Artificial Sequence: Synthetic coding sequence

SEQ ID NO: 81117 - DNA, 2055 bp, Artificial Sequence; identical to SEQ ID NO: 80903
  Description of Artificial Sequence: Synthetic coding sequence

SEQ ID NO: 81118 - DNA, 261 bp, Artificial Sequence
  Description of Artificial Sequence: Synthetic coding sequence
atgggcctgagcgccgccgcccccctgtggggcccccccggcctgctgctggccatcgccctgcaccccgccctgagcgtgccccccagaagagactactgcgtgctgggcgccggccccgccggcctgcagatggcctacttcctgcagagagccggcagagactacgccgtgttcgagagagcccccagacccggcagcttcttcaccagataccccagacacagaaagctgatcagcatcaacaagagatacacctag

SEQ ID NO: 81119 - DNA, 729 bp, Artificial Sequence
  Description of Artificial Sequence: Synthetic coding sequence
atgttcctgctgagcggcgacccctgcttcaagaccccccccagcaccgccaagagcatcagcatccccggccaggacagcagcctgcagctgacctgcaagggcggcggcaccagcagcggcggcagcagcaccaacagcctgaccggcagcagaccccccaaggccagacccaccatcctgagcagcggcctgcccgaggagcccgaccagaacctgagcagccccgaggaggtgttccacagcggccacagcagaaacagcagctacgccagccagcagagcaagatcagcggctacagcaccgagcacagcagaagcagcagcctgagcgacctgacccacagaagaaacaccagcaccagcagcagcgccagcggcggcctgggcatgaccgtggagggccccgagggcagcgagagagagcacagaccccccgagaagccccccagaccccccagacccctgcacctgagcgacagaagcttcagaagaaagaaggacagcgtggagagccaccccacctgggtggacgacaccagaatcgacgccgacgccatcgtggagaagatcgtgcagagccaggacttcaccgacggcagcaacaccgaggacagcaacctgagactgttcgtgagcagagacggcagcgccaccctgagcggcatccagctggccaccagagtgagcagcggcgtgtacgagcccgtggtgatcgagagccactag

SEQ ID NO: 81120 - DNA, 1155 bp, Artificial Sequence
  Description of Artificial Sequence: Synthetic coding sequence
atggccttcctgatgaagaagaagaagttcaagttccagaccaccttcaccctggaggagctgaccgccgtgcccttcgtgaacggcgtgctgttctgcaaggtgagactgctggacggcggcgacttcgtgagcctgagcagcagagaggaggtgcaggagaactgcgtgagatggagaaagagattcaccttcgtgtgcaagatgagcgccaaccccgccaccggcctgctggacccctgcgtgttcagagtgagcgtgagaaaggagctgaagggcggcaaggcctacagcaagctgggcttcgccgacctgaacctggccgagttcgccggcagcggcagcaccgtgagatgctgcctgctggagggctacgacaccaagaacaccagacaggacaacagcatcctgaaggtgaccatcggcatgttcctgctgagcggcgacccctgcttcaagaccccccccagcaccgccaagagcatcagcatccccggccaggacagcagcctgcagctgacctgcaagggcggcggcaccagcagcggcggcagcagcaccaacagcctgaccggcagcagaccccccaaggccagacccaccatcctgagcagcggcctgcccgaggagcccgaccagaacctgagcagccccgaggaggtgttccacagcggccacagcagaaacagcagctacgccagccagcagagcaagatcagcggctacagcaccgagcacagcagaagcagcagcctgagcgacctgacccacagaagaaacaccagcaccagcagcagcgccagcggcggcctgggcatgaccgtggagggccccgagggcagcgagagagagcacagaccccccgagaagccccccagaccccccagacccctgcacctgagcgacagaagcttcagaagaaagaaggacagcgtggagagccaccccacctgggtggacgacaccagaatcgacgccgacgccatcgtggagaagatcgtgcagagccaggacttcaccgacggcagcaacaccgaggacagcaacctgagactgttcgtgagcagagacggcagcgccaccctgagcggcatccagctggccaccagagtgagcagcggcgtgtacgagcccgtggtgatcgagagccactag

SEQ ID NO: 81121 - DNA, 435 bp, Artificial Sequence
  Description of Artificial Sequence: Synthetic coding sequence
atgtacagcgagatccagagagagagagccgacatcggcggcctgatggccagacccgagtacagagagtggaaccccgagctgatcaagcccaagaagctgctgaaccccgtgaaggccagcagaagccaccaggagctgcacagagagctgctgatgaaccacagaagaggcctgggcgtggacagcaagcccgagctgcagagagtgctggagcacagaagaagaaaccagctgatcaagaagaagaaggaggagctggaggccaagagactgcagtgccccttcgagcaggagctgctgagaagacagcagagactgaaccagctggagaagccccccgagaaggaggaggaccacgcccccgagttcatcaaggtgagagagaacctgagaagaatcgccaccctgaccagcgaggagagagagctgtag

SEQ ID NO: 81122 - DNA, 435 bp, Artificial Sequence; identical to SEQ ID NO: 81121
  Description of Artificial Sequence: Synthetic coding sequence

SEQ ID NO: 81123 - DNA, 519 bp, Artificial Sequence
  Description of Artificial Sequence: Synthetic coding sequence
atggcccagagactgggcgagtgggccagaggccccagcgacgccaccggcctgtacagagccgtgctgctgagaagcgccgccatgtacagcgagatccagagagagagagccgacatcggcggcctgatggccagacccgagtacagagagtggaaccccgagctgatcaagcccaagaagctgctgaaccccgtgaaggccagcagaagccaccaggagctgcacagagagctgctgatgaaccacagaagaggcctgggcgtggacagcaagcccgagctgcagagagtgctggagcacagaagaagaaaccagctgatcaagaagaagaaggaggagctggaggccaagagactgcagtgccccttcgagcaggagctgctgagaagacagcagagactgaaccagctggagaagccccccgagaaggaggaggaccacgcccccgagttcatcaaggtgagagagaacctgagaagaatcgccaccctgaccagcgaggagagagagctgtag

SEQ ID NO: 81124 - DNA, 408 bp, Artificial Sequence
  Description of Artificial Sequence: Synthetic coding sequence
atgtacagcgagatccagagagagagagccgacatcggcggcctgatggccagacccgagtacagagagtggaaccccgagctgatcaagcccaagaagctgctgaaccccgtgaaggccagcagaagccaccaggagctgcacagagagctgctgatgaaccacagaagaggcctgggcgtggacagcaagcccgagctgcagagagtgctggagcacagaagaagaaaccagctgatcaagaagaagaaggaggagctggaggccaagagactgcagtgccccttcgagcaggagctgctgagaagacagcagagactgaaccaggtgggcgacggccaccccgccggcaccacccacccccccggcctgagcagcagagaggagctgtgctgcggccacagctag

SEQ ID NO: 81125 - DNA, 318 bp, Artificial Sequence
  Description of Artificial Sequence: Synthetic coding sequence
atgtacagcgagatccagagagagagagccgacatcggcggcctgatggccagacccgagtacagagagtggaaccccgagctgatcaagcccaagaagctgctgaaccccgtgaaggccagcagaagccaccaggagctgcacagagagctgctgatgaaccacagaagaggcctgggcgtggacagcaagcccgagctgcagagagtgctggagcacagaagaagaaaccagctgatcaagaagaagaaggaggagctggaggccaagagactgcagtgccccttcgagcaggagctgctgagaagacagcagtag

SEQ ID NO: 81126 - DNA, 528 bp, Artificial Sequence
  Description of Artificial Sequence: Synthetic coding sequence
atgggcgccgcccagggcaagaagaagacctacagcccccaggccagattccacagcgagaacgagaagcagagaagaaacggcagcgccgccatgtacagcgagatccagagagagagagccgacatcggcggcctgatggccagacccgagtacagagagtggaaccccgagctgatcaagcccaagaagctgctgaaccccgtgaaggccagcagaagccaccaggagctgcacagagagctgctgatgaaccacagaagaggcctgggcgtggacagcaagcccgagctgcagagagtgctggagcacagaagaagaaaccagctgatcaagaagaagaaggaggagctggaggccaagagactgcagtgccccttcgagcaggagctgctgagaagacagcagagactgaaccagctggagaagccccccgagaaggaggaggaccacgcccccgagttcatcaaggtgagagagaacctgagaagaatcgccaccctgaccagcgaggagagagagctgtag

SEQ ID NO: 81127 - DNA, 789 bp, Artificial Sequence
  Description of Artificial Sequence: Synthetic coding sequence
atggcccccggcagcccccccggccccgccatcgccaccatgaagctgaacgagagaagcctggccttctacgccacctgcgacgcccccgtggacaacgccggcttcctgtacaagaagggcggcagacacgccgcctaccacagaagatggttcgtgctgagaggcaacatgctgttctacttcgaggacgccgccagcagagagcccgtgggcgtgatcatcctggagggctgcaccgtggagctggtggaggccgccgaggagttcgccttcgccgtgagattcgccggcaccagagccagaacctacgtgctggccgccgagagccaggacgccatggagggctgggtgaaggccctgagcagagccagcttcgactacctgagactggtggtgagagagctggagcagcagctggccgccgtgagaggcggcggcggcatggccctgccccagccccagccccagagcctgcccctgccccccagcctgcccagcgccctggcccccgtgcccagcctgcccagcgcccccgcccccgtgcccgccctgcccctgcccagaagacccagcgccctgccccccaaggagaacggctgcgccgtgtggagcaccgaggccaccttcagacccggccccgagccccccccccccccccccagaagaagagccagcgccccccacggccccctggacatggcccccttcgccagactgcacgagtgctacggccaggagatcagagccctgagaggccagtggctgagcagcagagtgcagccctag

SEQ ID NO: 81128 - DNA, 750 bp, Artificial Sequence
  Description of Artificial Sequence: Synthetic coding sequence
atgaagctgaacgagagaagcctggccttctacgccacctgcgacgcccccgtggacaacgccggcttcctgtacaagaagggcggcagacacgccgcctaccacagaagatggttcgtgctgagaggcaacatgctgttctacttcgaggacgccgccagcagagagcccgtgggcgtgatcatcctggagggctgcaccgtggagctggtggaggccgccgaggagttcgccttcgccgtgagattcgccggcaccagagccagaacctacgtgctggccgccgagagccaggacgccatggagggctgggtgaaggccctgagcagagccagcttcgactacctgagactggtggtgagagagctggagcagcagctggccgccgtgagaggcggcggcggcatggccctgccccagccccagccccagagcctgcccctgccccccagcctgcccagcgccctggcccccgtgcccagcctgcccagcgcccccgcccccgtgcccgccctgcccctgcccagaagacccagcgccctgccccccaaggagaacggctgcgccgtgtggagcaccgaggccaccttcagacccggccccgagccccccccccccccccccagaagaagagccagcgccccccacggccccctggacatggcccccttcgccagactgcacgagtgctacggccaggagatcagagccctgagaggccagtggctgagcagcagagtgcagccctag

SEQ ID NO: 81129 - DNA, 267 bp, Artificial Sequence
  Description of Artificial Sequence: Synthetic coding sequence
atgaagctgaacgagagaagcctggccttctacgccacctgcgacgcccccgtggacaacgccggcttcctgtacaagaagggcggcagacacgccgcctaccacagaagatggttcgtgctgagaggcaacatgctgttctacttcgaggacgccgccagcagagagcccgtgggcgtgatcatcctggtggccgtggccctgtggcccagagccctgagcgtgagcccctggtggctgagccagggcagccccgacaccccctag

SEQ ID NO: 81130 - DNA, 849 bp, Artificial Sequence
  Description of Artificial Sequence: Synthetic coding sequence
atgcaggccagctgcaccagaagagtgggcggcaccagacccaccaccggcgccggcagctgctgcgccggcacctgcagcagcaccagcagaaccctgcccgccgtgagcccctgggccagcagcagctggagagccgccctgtggagctggtggagaccccccagaagcagccccagcctgtgcgccctgagaggccccggcagagcccccacctgctggcccctgagagtgagaatgccctggagagccggcagcagaccctgcagagtgcccgccagcaccacctgcggctggtggtgcgccagctggagcagcagctggagactgtacgtggccggcgtggcctggccctgccccagccccagccccagcccctgcccctgccccagaccctgccccctgccctggccccagagccacccctgcctgctgccccagcccagaagccagccctgcccctgccccgccggccccgtgcccagcagacccagaagaatggccgccctgagcggcgccctgagaccccccagcggcctggaccccagccccctgcaccacagactggccgccggccccagacaccccaccggcccctggacctggccccccagccccggctgcaccagcgccatggccagaagaagcggcccctgcgtggccagcggcagcgccgccggcagcagccccgaggccaccagagcccccgtgctgggcggccacaagctgtacgccctgtgggacagacccggccccggcgagaccggcggcgccgaccccgagggcaaccacggccagggctggccccccggccccgagtggcccggcttcggcggctgcagactgtag

SEQ ID NO: 81131 - DNA, 354 bp, Artificial Sequence
  Description of Artificial Sequence: Synthetic coding sequence
atgaagctgaacgagagaagcctggccttctacgccacctgcgacgcccccgtggacaacgccggcttcctgtacaagaagggcggcagacacgccgcctaccacagaagatggttcgtgctgagaggcaacatgctgttctacttcgaggacgccgccagcagagagcccgtgggcgtgatcatcctggagggctgcaccgtggagctggtggaggccgccgaggagttcgccttcgccgtgagattcgccggcaccagagccagaacctacgtgctggccgccgagagccaggacgccatggagggctgggtgaaggccctgagcagagccagcttcgactacctgagatag

SEQ ID NO: 81132 - DNA, 750 bp, Artificial Sequence; identical to SEQ ID NO: 81128
  Description of Artificial Sequence: Synthetic coding sequence

SEQ ID NO: 81133 - DNA, 750 bp, Artificial Sequence; identical to SEQ ID NO: 81128
  Description of Artificial Sequence: Synthetic coding sequence

SEQ ID NO: 81134 - DNA, 225 bp, Artificial Sequence
  Description of Artificial Sequence: Synthetic coding sequence
atgaagctgaacgagagaagcctggccttctacgccacctgcgacgcccccgtggacaacgccggcttcctgtacaagaagggcggcagacacgccgcctaccacagaagatggttcgtgctgagaggcaacatgctgttctacttcgaggacgccgccagcagagagcccgtgggcgtgatcatcctggagggctgcaccgtggagctggtggaggccgcctag

SEQ ID NO: 81135 - DNA, 243 bp, Artificial Sequence
  Description of Artificial Sequence: Synthetic coding sequence
atgaagctgaacgagagaagcctggccttctacgccacctgcgacgcccccgtggacaacgccggcttcctgtacaagaagggcggcagacacgccgcctaccacagaagatggttcgtgctgagaggcaacatgctgttctacttcgaggacgccgccagcagagagcccgtgggcgtgatcatcctggagggctgcaccgtggagctggtggaggccgccgaggagttcgccttcgcctag

SEQ ID NO: 81136 - DNA, 780 bp, Artificial Sequence
  Description of Artificial Sequence: Synthetic coding sequence
atgaagctgaacgagagaagcgtggcccactacgccctgagcgacagccccgccgaccacatgggcttcctgagaacctggggcggccccggcaccccccccacccccagcggcaccggcagaagatgctggttcgtgctgaagggcaacctgctgttcagcttcgagagcagagagggcagagcccccctgagcctggtggtgctggagggctgcaccgtggagctggccgaggcccccgtgcccgaggagttcgccttcgccatctgcttcgacgcccccggcgtgagaccccacctgctggccgccgagggccccgccgcccaggaggcctgggtgaaggtgctgagcagagccagcttcggctacatgagactggtggtgagagagctggagagccagctgcaggacgccagacagagcctggccctgcagagaagaagcagctggaagagcgtggccagcagatgcaagccccaggcccccaaccacagagccgccggcctggagaacggccactgcctgagcaaggacagcagccccgtgggcctggtggaggaggccggcagcagaagcgccggctggggcctggccgagtgggagctgcagggccccgccagcctgctgctgggcaagggccagagccccgtgagccccgagaccagctgcttcagcaccctgcacgactggtacggccaggagatcgtggagctgagacagtgctggcagaagagagcccagggcagccacagcaagtgcgaggagcaggacagaccctag

SEQ ID NO: 81137 - DNA, 327 bp, Artificial Sequence
  Description of Artificial Sequence: Synthetic coding sequence
atgaagctgaacgagagaagcgtggcccactacgccctgagcgacagccccgccgaccacatgggcttcctgagaacctggggcggccccggcaccccccccacccccagcggcaccggcagaagatgctggttcgtgctgaagggcaacctgctgttcagcttcgagagcagagagggcagagcccccctgagcctggtggtgctggagggctgcaccgtggagctggccgaggcccccgtgcccgaggagttcgccttcgccatctgcttcgacgcccccggcgtgagaccccacctgctggccgccgagggccccgccgcctag

SEQ ID NO: 81138 - DNA, 729 bp, Artificial Sequence
  Description of Artificial Sequence: Synthetic coding sequence
atgaccatccccggcggcacccccagcctgaagatcctgtggctgaaccaggagcccgagatccaggtgagaagactggacaccctgctggcctgcttcaacctgagcagcagcagagaggagctgcaggccgtggagagccccttccaggccctgtgctgcctgctgatctacctgttcgtgcaggtggacaccctgtgcctggaggacctgcacgccttcatcgcccaggccctgtgcctgcagggcaagagcaccagccagctggtgaacctgcagcccgactacatcaaccccagagccgtgcagctgggcagcctgctggtgagaggcctgaccaccctggtgctggtgaacagcgcctgcggcttcccctggaagaccagcgacttcatgccctggaacgtgttcgacggcaagctgttccaccagaagtacctgcagagcgagaagggctacgccgtggaggtgctgctggagcagaacagaagcagactgaccaagttccacaacctgaaggccgtggtgtgcaaggcctgcatgaaggagaacagaagaatcaccggcagagcccactggggcagccaccacgccggcagatggggcagacagggcagcagctaccacagaaccggcagcggctacagcagaagcagccagggccagccctggagagaccagggccccggcagcagacagtacgagcacgaccagtggagaagatactag

SEQ ID NO: 81139 - DNA, 2733 bp, Artificial Sequence
  Description of Artificial Sequence: Synthetic coding sequence
atgggcgtgagaggcctgcagggcttcgtgggcagcacctgcccccacatctgcaccgtggtgaacttcaaggagctggccgagcaccacagaagcaagtaccccggctgcacccccaccatcgtggtggacgccatgtgctgcctgagatactggtacacccccgagagctggatctgcggcggccagtggagagagtacttcagcgccctgagagacttcgtgaagaccttcaccgccgccggcatcaagctgatcttcttcttcgacggcatggtggagcaggacaagagagacgagtgggtgaagagaagactgaagaacaacagagagatcagcagaatcttccactacatcaagagccacaaggagcagcccggcagaaacatgttcttcatccccagcggcctggccgtgttcaccagattcgccctgaagaccctgggccaggagaccctgtgcagcctgcaggaggccgactacgaggtggccagctacggcctgcagcacaactgcctgggcatcctgggcgaggacaccgactacctgatctacgacacctgcccctacttcagcatcagcgagctgtgcctggagagcctggacaccgtgatgctgtgcagagagaagctgtgcgagagcctgggcctgtgcgtggccgacctgcccctgctggcctgcctgctgggcaacgacatcatccccgagggcatgttcgagagcttcagatacaagtgcctgagcagctacaccagcgtgaaggagaacttcgacaagaagggcaacatcatcctggccgtgagcgaccacatcagcaaggtgctgtacctgtaccagggcgagaagaagctggaggagatcctgcccctgggccccaacaaggccctgttctacaagggcatggccagctacctgctgcccggccagaagagcccctggttcttccagaagcccaagggcgtgatcaccctggacaagcaggtgatcagcaccagcagcgacgccgagagcagagaggaggtgcccatgtgcagcgacgccgagagcagacaggaggtgcccatgtgcaccggccccgagagcagaagagaggtgcccgtgtacaccgacagcgagcccagacaggaggtgcccatgtgcagcgaccccgagcccagacaggaggtgcccacctgcaccggccccgagagcagaagagaggtgcccatgtgcagcgaccccgagcccagacaggaggtgcccatgtgcaccggccccgaggccagacaggaggtgcccatgtacaccgacagcgagcccagacaggaggtgcccatgtacaccgacagcgagcccagacaggaggtgcccatgtacaccggcagcgagcccagacaggaggtgcccatgtacaccggccccgagagcagacaggaggtgcccatgtacaccggccccgagagcagacaggaggtgctgatcagaaccgaccccgagagcagacaggagatcatgtgcaccggccacgagagcaagcaggaggtgcccatctgcaccgaccccatcagcaagcaggaggacagcatgtgcacccacgccgagatcaaccagaagctgcccgtggccaccgacttcgagttcaagctggaggccctgatgtgcaccaaccccgagatcaagcaggaggaccccaccaacgtgggccccgaggtgaagcagcaggtgaccatggtgagcgacaccgagatcctgaaggtggccagaacccaccacgtgcaggccgagagctacctggtgtacaacatcatgagcagcggcgagatcgagtgcagcaacaccctggaggacgagctggaccaggccctgcccagccaggccttcatctacagacccatcagacagagagtgtacagcctgctgctggaggactgccaggacgtgaccagcacctgcctggccgtgaaggagtggttcgtgtaccccggcaaccccctgagacaccccgacctggtgagacccctgcagatgaccatccccggcggcacccccagcctgaagatcctgtggctgaaccaggagcccgagatccaggtgagaagactggacaccctgctggcctgcttcaacctgagcagcagcagagaggagctgcaggccgtggagagccccttccaggccctgtgctgcctgctgatctacctgttcgtgcaggtggacaccctgtgcctggaggacctgcacgccttcatcgcccaggccctgtgcctgcagggcaagagcaccagccagctggtgaacctgcagcccgactacatcaaccccagagccgtgcagctgggcagcctgctggtgagaggcctgaccaccctggtgctggtgaacagcgcctgcggcttcccctggaagaccagcgacttcatgccctggaacgtgttcgacggcaagctgttccaccagaagtacctgcagagcgagaagggctacgccgtggaggtgctgctggagcagaacagaagcagactgaccaagttccacaacctgaaggccgtggtgtgcaaggcctgcatgaaggagaacagaagaatcaccggcagagcccactggggcagccaccacgccggcagatggggcagacagggcagcagctaccacagaaccggcagcggctacagcagaagcagccagggccagccctggagagaccagggccccggcagcagacagtacgagcacgaccagtggagaagatactag

SEQ ID NO: 81140 - DNA, 2802 bp, Artificial Sequence
  Description of Artificial Sequence: Synthetic coding sequence
atgttcggccccagaggcagcaccagcgccggcgccggcagaaaggagatcctgagcagaagcagcgtgatgggcgtgagaggcctgcagggcttcgtgggcagcacctgcccccacatctgcaccgtggtgaacttcaaggagctggccgagcaccacagaagcaagtaccccggctgcacccccaccatcgtggtggacgccatgtgctgcctgagatactggtacacccccgagagctggatctgcggcggccagtggagagagtacttcagcgccctgagagacttcgtgaagaccttcaccgccgccggcatcaagctgatcttcttcttcgacggcatggtggagcaggacaagagagacgagtgggtgaagagaagactgaagaacaacagagagatcagcagaatcttccactacatcaagagccacaaggagcagcccggcagaaacatgttcttcatccccagcggcctggccgtgttcaccagattcgccctgaagaccctgggccaggagaccctgtgcagcctgcaggaggccgactacgaggtggccagctacggcctgcagcacaactgcctgggcatcctgggcgaggacaccgactacctgatctacgacacctgcccctacttcagcatcagcgagctgtgcctggagagcctggacaccgtgatgctgtgcagagagaagctgtgcgagagcctgggcctgtgcgtggccgacctgcccctgctggcctgcctgctgggcaacgacatcatccccgagggcatgttcgagagcttcagatacaagtgcctgagcagctacaccagcgtgaaggagaacttcgacaagaagggcaacatcatcctggccgtgagcgaccacatcagcaaggtgctgtacctgtaccagggcgagaagaagctggaggagatcctgcccctgggccccaacaaggccctgttctacaagggcatggccagctacctgctgcccggccagaagagcccctggttcttccagaagcccaagggcgtgatcaccctggacaagcaggtgatcagcaccagcagcgacgccgagagcagagaggaggtgcccatgtgcagcgacgccgagagcagacaggaggtgcccatgtgcaccggccccgagagcagaagagaggtgcccgtgtacaccgacagcgagcccagacaggaggtgcccatgtgcagcgaccccgagcccagacaggaggtgcccacctgcaccggccccgagagcagaagagaggtgcccatgtgcagcgaccccgagcccagacaggaggtgcccatgtgcaccggccccgaggccagacaggaggtgcccatgtacaccgacagcgagcccagacaggaggtgcccatgtacaccgacagcgagcccagacaggaggtgcccatgtacaccggcagcgagcccagacaggaggtgcccatgtacaccggccccgagagcagacaggaggtgcccatgtacaccggccccgagagcagacaggaggtgctgatcagaaccgaccccgagagcagacaggagatcatgtgcaccggccacgagagcaagcaggaggtgcccatctgcaccgaccccatcagcaagcaggaggacagcatgtgcacccacgccgagatcaaccagaagctgcccgtggccaccgacttcgagttcaagctggaggccctgatgtgcaccaaccccgagatcaagcaggaggaccccaccaacgtgggccccgaggtgaagcagcaggtgaccatggtgagcgacaccgagatcctgaaggtggccagaacccaccacgtgcaggccgagagctacctggtgtacaacatcatgagcagcggcgagatcgagtgcagcaacaccctggaggacgagctggaccaggccctgcccagccaggccttcatctacagacccatcagacagagagtgtacagcctgctgctggaggactgccaggacgtgaccagcacctgcctggccgtgaaggagtggttcgtgtaccccggcaaccccctgagacaccccgacctggtgagacccctgcagatgaccatccccggcggcacccccagcctgaagatcctgtggctgaaccaggagcccgagatccaggtgagaagactggacaccctgctggcctgcttcaacctgagcagcagcagagaggagctgcaggccgtggagagccccttccaggccctgtgctgcctgctgatctacctgttcgtgcaggtggacaccctgtgcctggaggacctgcacgccttcatcgcccaggccctgtgcctgcagggcaagagcaccagccagctggtgaacctgcagcccgactacatcaaccccagagccgtgcagctgggcagcctgctggtgagaggcctgaccaccctggtgctggtgaacagcgcctgcggcttcccctggaagaccagcgacttcatgccctggaacgtgttcgacggcaagctgttccaccagaagtacctgcagagcgagaagggctacgccgtggaggtgctgctggagcagaacagaagcagactgaccaagttccacaacctgaaggccgtggtgtgcaaggcctgcatgaaggagaacagaagaatcaccggcagagcccactggggcagccaccacgccggcagatggggcagacagggcagcagctaccacagaaccggcagcggctacagcagaagcagccagggccagccctggagagaccagggccccggcagcagacagtacgagcacgaccagtggagaagatactag

SEQ ID NO: 81141 - DNA, 2769 bp, Artificial Sequence
  Description of Artificial Sequence: Synthetic coding sequence
atggacagacagatgatcctgagcagaagcagcgtgatgggcgtgagaggcctgcagggcttcgtgggcagcacctgcccccacatctgcaccgtggtgaacttcaaggagctggccgagcaccacagaagcaagtaccccggctgcacccccaccatcgtggtggacgccatgtgctgcctgagatactggtacacccccgagagctggatctgcggcggccagtggagagagtacttcagcgccctgagagacttcgtgaagaccttcaccgccgccggcatcaagctgatcttcttcttcgacggcatggtggagcaggacaagagagacgagtgggtgaagagaagactgaagaacaacagagagatcagcagaatcttccactacatcaagagccacaaggagcagcccggcagaaacatgttcttcatccccagcggcctggccgtgttcaccagattcgccctgaagaccctgggccaggagaccctgtgcagcctgcaggaggccgactacgaggtggccagctacggcctgcagcacaactgcctgggcatcctgggcgaggacaccgactacctgatctacgacacctgcccctacttcagcatcagcgagctgtgcctggagagcctggacaccgtgatgctgtgcagagagaagctgtgcgagagcctgggcctgtgcgtggccgacctgcccctgctggcctgcctgctgggcaacgacatcatccccgagggcatgttcgagagcttcagatacaagtgcctgagcagctacaccagcgtgaaggagaacttcgacaagaagggcaacatcatcctggccgtgagcgaccacatcagcaaggtgctgtacctgtaccagggcgagaagaagctggaggagatcctgcccctgggccccaacaaggccctgttctacaagggcatggccagctacctgctgcccggccagaagagcccctggttcttccagaagcccaagggcgtgatcaccctggacaagcaggtgatcagcaccagcagcgacgccgagagcagagaggaggtgcccatgtgcagcgacgccgagagcagacaggaggtgcccatgtgcaccggccccgagagcagaagagaggtgcccgtgtacaccgacagcgagcccagacaggaggtgcccatgtgcagcgaccccgagcccagacaggaggtgcccacctgcaccggccccgagagcagaagagaggtgcccatgtgcagcgaccccgagcccagacaggaggtgcccatgtgcaccggccccgaggccagacaggaggtgcccatgtacaccgacagcgagcccagacaggaggtgcccatgtacaccgacagcgagcccagacaggaggtgcccatgtacaccggcagcgagcccagacaggaggtgcccatgtacaccggccccgagagcagacaggaggtgcccatgtacaccggccccgagagcagacaggaggtgctgatcagaaccgaccccgagagcagacaggagatcatgtgcaccggccacgagagcaagcaggaggtgcccatctgcaccgaccccatcagcaagcaggaggacagcatgtgcacccacgccgagatcaaccagaagctgcccgtggccaccgacttcgagttcaagctggaggccctgatgtgcaccaaccccgagatcaagcaggaggaccccaccaacgtgggccccgaggtgaagcagcaggtgaccatggtgagcgacaccgagatcctgaaggtggccagaacccaccacgtgcaggccgagagctacctggtgtacaacatcatgagcagcggcgagatcgagtgcagcaacaccctggaggacgagctggaccaggccctgcccagccaggccttcatctacagacccatcagacagagagtgtacagcctgctgctggaggactgccaggacgtgaccagcacctgcctggccgtgaaggagtggttcgtgtaccccggcaaccccctgagacaccccgacctggtgagacccctgcagatgaccatccccggcggcacccccagcctgaagatcctgtggctgaaccaggagcccgagatccaggtgagaagactggacaccctgctggcctgcttcaacctgagcagcagcagagaggagctgcaggccgtggagagccccttccaggccctgtgctgcctgctgatctacctgttcgtgcaggtggacaccctgtgcctggaggacctgcacgccttcatcgcccaggccctgtgcctgcagggcaagagcaccagccagctggtgaacctgcagcccgactacatcaaccccagagccgtgcagctgggcagcctgctggtgagaggcctgaccaccctggtgctggtgaacagcgcctgcggcttcccctggaagaccagcgacttcatgccctggaacgtgttcgacggcaagctgttccaccagaagtacctgcagagcgagaagggctacgccgtggaggtgctgctggagcagaacagaagcagactgaccaagttccacaacctgaaggccgtggtgtgcaaggcctgcatgaaggagaacagaagaatcaccggcagagcccactggggcagccaccacgccggcagatggggcagacagggcagcagctaccacagaaccggcagcggctacagcagaagcagccagggccagccctggagagaccagggccccggcagcagacagtacgagcacgaccagtggagaagatactag

SEQ ID NO: 81142 - DNA, 3291 bp, Artificial Sequence
  Description of Artificial Sequence: Synthetic coding sequence
atgggcgtgcagggcttccaggagttcctggagaagagatgccccggcgccgtggtgcccgtggacctgctgaagctggccagaaccgtgagcagacagcagcagcagcagcacctgcacagacagctgccccccaccgccgccctggcccccggcgcccccagagccgccagaggcagcgtgcccctgcagccccccctgccccccgccgccctgggcgcctacagcggcggcgccggccccatcagacaccaccaccccgcccaccacttccaccaccacggccaggcccagcccggcctgcacccccccctgcccccccccccccccccccagctgcccggcgccagagtgctggtggacgccggcagcgccctgcccagactgtacggcggctaccagaccgactgggtgtgcggcggccagtggaacgccatgctgggctacctgagcgccctgtgccaggcctgcgcctaccccggcggcgacggcctggagctggtggtgatgttccccggcggcctgggcaaggacagactggccgagtggggcagaagatgccaggccgagagacagaccgcccagctgatcgtgggccacgtgggcaacaagggcacccccccccccagagcctggttcctgccccccgcctgcctgagccactgcgtgagactggccctgatcagattcagagtgaaggtgttccagagcctggaggaccaccacctggaggtggtggccttcttcagagagaacggcttccacggcctgctggcccacgacagcgagtacgccctgtacaacatccccagctactacagcagccacgccctgaagctgagctggaacggcaagaacctgaccaccaaccagttcctgatgcaggaggtggccaagcagctgggcctgaagagaatgaacttccccatcttcgccgccctgctgggcaaccacatcctgcccgacgaggacctggccgccttccactggagcctgctgggccccgagcaccccctggccagcctgaaggtgagagcccaccagctggtgctgcccccctgcgacgtggtgatcaaggccgtgagcgagtacgtgagcagcatcaaggaccccagcaacctggacgtggtgggcaaggacgtgttcaagcagagccagagcagaaccgaggacaagatcgagagattcaagaaggccgtggagtactacagcgtgaccaccaagctgagcagcctgcccgtgggccccagcttcctgggcttcagaaacaacagactgggcaacccccccctgcccagaaaccaggtgggcaccatcagcgccggcaagcccatgttcagccaccaggtgccccagaaggtgaagtaccccccccccttccccgtgggccccaacagcagcctgctgttcagcagccacgccctgggcgagagccacgccttcagcgaggaccccatgctgcagaacagccccttcgccaactgggccgtgagctacgacagcagcgccagccagttccccaactacctgcccagcaaggccagcccccccctgggccccgacagcagccacagcagcagcagcgacggcgacgagcccaacggcgccagcagcgaccacatcaccgaggccttccaccaccagcccgagtggggcaaccccaacagagacagaggcagctgggcccagcccgtggacaccggcgtgagcgaggccagcctgggcgacggcgagccccacatccccagcctgctgagcatgagcaccagaaaccacatggacatcaccatcccccccctgccccccgtggcccccgaggtgctgagagtggccgagcacagacacagaagaggcctgatgtacccctacatctaccacgtgctgaccaagggcgagatcaagatccccgtgtgcatcgaggacgagtgcaacatggagctgccccccgccgccctgctgttcagaagcgccagacagtacgtgtacggcgtgctgttcagcctggccgagacccagagaaagatggagagactggccatgagaagaagactgcccgtggaggtgcccagcgtgatcctgaaggagtggagcgcctacaagggcaagagcccccagacccccgagctggtgagcgccctgaccttcagagagtggacctgccccaacctgaagaagctgtggctgggcaaggccgtggaggacaagaacagaagaatgagagccttcctggcctgcatgaagagcgacacccccagcatgctgaaccccgccaacgtgcccacccacctgctgctgatgtgctgcgtgctgagatacatggtgcagtggcccggcggcagaatcctgcacagacacgagctggacaccttcctggcccaggccgtgagcacccagctgtacgagcccgacagactgcaggagctgaagatcgagaagctggacgccagaggcatccagctggccgccctgttcatgagcggcgtggacaccgccctgttcgccaacgacgcctgcggccagcccgtgccctgggagcactgctgcccctggatctacttcgacggcaagctgttccagagcaagctgatcaaggccggcagagagagagtgagcctggtggagctgtgcgacggccaggccgacctggccaccaaggtggagaagatgagacagagcatcctggagggcgtgaacatgaaccaccccccccccagcgccctgctgcccagccccaccttcgtgccccccatggtgcccagcctgtaccccgtgagcctgtacagcagagccatgggcagcatgcccctgcccccccagggcagaagcagaggcttcgccggcctgcaccccatccccccccagggcggcaagctggagatcgccggcatggtggtgggccagtgggccggcagcagaagcagcagaggcagaggcagcttcggcatgcaggtggtgagcgtgggcggccccggcaagggccacggcaaggagcagaccggcagaggcagcaagggccacaagaagggcaacaagcagggcagcagcgacggcgtgagcaagagcctggagctgcaccagggcagaagcagaagccaggtgaacggcaacagcggcgccctgatcaaggaggagaagagcgaccacagactgcccgcccccagccagtgcgccctgagcagagacagcaacgagtgcaacaacggcaacagatacctgcccatgaacaacagagagaagaaccacctgcaggagcagaagctggagaccgtggcccagagaaaggaggactag
